United States Patent 10,407,724 (METHODS AND COMPOSITIONS FOR SCREENING AND TREATING DEVELOPMENTAL DISORDERS) - sequence listing, part 56

SEQ ID NO: 1448 - DNA, 1745693 bp, Homo sapiens
tcaagataaggatgataagtgtacatgaagtattacagataaacaggactctctggcctctcctgtgtttatttggtaacgaatagtagataatctctatgatgggaaacgctgaatgacacgtgataatttcattcattcaacaagcaaatattccttaactattaggtgctgaccatacagaaatgacagtgatatgatcccaaatatatattgcttttgttgatttagcgcccaatattttatgttatttgtgagttaaacaccaaaacttagtgaaattacagaacttcttaagtgtaaaataaagcagtgtggttaggcaggattttgtcatataggcactatatgtagaatagtggtttcagtagatttgtcttcctctaaattcactcatgacttgcaatggatggatttttttctttgctgagcctcgtctgacagctgcacacgtttcctctggcttctctcttttaatcaagggtttttttgcaggagccttcattctccacatcacaactgggtgccggggcccagcaggactctggattcggatgatcttggttgaggcaatgtaagacattttcactgtttgcactacagcattcattaaatttttggctgcttggatcagggatgtgacactgtccaactgtagggaaaaaagagaaaaaagagctattattccaggaggttttgttaattattgccaagcgtgggcatggtggcatgtgcccgttgccccagctactcaggaggctgaggagggaggatcacttgagcccaggaggcaaaggttgcagtgagccaagatggcgtcactgcaccgcagcctgggtgacagtgaaaccccatataaaaaaataaataaataataaaaataaaaataactgagcctgatagtctattaatgtcacaataagctgctcaatattgtctatgcccaaacataaatcaataagttctgcctcatttttttgtatctagatggataagtgattatgttcaattaactcttatgctaattatgtaatgtgttttgcaaataaccctaatacgccaatttaaatagaatcctgttaaatattatcctgtataaatcttacttttattatagtgtctcttctgtgctttgtggtattatatggtttcagtttaacaacggtacaaattggaccaattctacaaatgtttacggataaaggacttgctcttaaaaacatatcaatagccatttactacaaaaaggtggagtttagcaacaataaaatacattttctgtttcctcataaaatgttaacatttcgtccatgtaagtagtttgtatagaatacctggatcttttctcaaaaacactaaatacctataaatccttgacaactatgtcaatttggaatgtctgctagcaaacccttgccaaaaccctattgtaattagtgatagctaagaggaatattcaaaaagacatggtacatattccttctcttgcttttggaagtttctcacagagattgtgtcaaaacactagaatgctttctactcgtaggacactagtctaactccctatagtttggattcaagactgttaccagacatacgccttacatgaggattctaagcctacgtgaacctcacttccactggtgtggatctcactttcttgcacctggtctgtcacctgggaaagcagcttcccaatcacagggcagtgtgaactgccatgccaactgcttcttctgagactcctgctgagagaaaaacctgatgctgcttggaaagatatatggtctgtccagtaacctttttggtaaattggtaccaaatgtagcctatgatcttgagtctcaaggtgtacctgaattcaaagacccctgttggatgttggtcctgcacaaaagcaatttttgaaagacaaatgtcaagagtttggttccaagtgtcagaagagcttaaaataattgctaatatctattatatgctgtagtatgcagttgacataaagtaactcatagcaaccctatgaggtaagtactcttattatcttcattttatggatgaagaaacaaaggaactggaaggtctggtgacttgctcaaagtaacacagatattagatagtagggctggaactggaaccaagtaagtctggttctaccttgcgttttttctcattacataaacctgcctccaagaatatcctacttccaatatgtgattatttttcgatatcaaatagttaaataaattatactaaccttaacagagtgtctaaaattttaaagttgactagccagcaactctgcttttaagaagcttgctcttatttttgtaatgcatgttgctaccaggagcaatagagtatcttatttgccaatgcattttgttaggattgtggtttgaaaatttatatactaatttccaagttgtgtttctttggaagagcaaatagaagtactcagtcacccttataggccccaaaccatttaaagacatttagattaagactatttcataacaaaacatttttaaattttaaaacctgggtctcaatacacatatcaataaggcaaagaagaaccataaacaaatcacattataggttctaggacatggaagtacataacatttatctttaaatcttttaaatgtgtcagtataaatacaatcctgattaaccaaacttttttttcttattctccaataaaattaagtcaatttgtttgcttggttttgcaaaaataacaggatttgatcctaggactccagagtttcttctcaatgtagttatttttaaagttgtattcgttcatttacacactactacaaagatactacccgagactgggttatttataaaggaaagaggtttaattgactcacagttctgcatgtctggcagggaggcctcaggaaacttacaatcatggcagaaggggaagcagacacatcttacatggcaacaggagagagacagcaaacaaaagcagggaaaactgccttataaaaccatcgatctcatgagaactcactatcacgagaacagcatgggggaaactgcctccatgatccagtcacctccctccctcaatatgtggggaattacaggtcgctccctcacacttggggattacaattgaagatgagatttgggtggggacacaaagcctaaccatatcaaaagtaatcagttaaactatttggaaatgaagttagcataggcaatgtcaaagggcatatgtatatgtaatggcagattacaactgacagcataaactatttctaaaaagacttaaggatatttgtagtctttttaacttataggtgccatttgcacctcaagattgacctaatggtagtagttttatgccacagtaaatgcttaaatatattttctgtaaccaaaatgcattaacttattcaatgtttttatgatctactctgaatgtctcttttaagagctaattttatcccaatactggcttaatacattcttttgtttctgaacagatttttaaaagaacggttggcattgagagcattctcccttttcagatgcattcaaaaatgctaaacagccagggtggcttcacaggcaaatcagataaggagctttgttaaatccaggcaaagtggtgttgcatctccaaattgaaattgtcaagcttctaattaaattgagaaggtagttcattctttggatatgaagaatcattccaatgggccactgatataattggcacagtagatttgtcctttgtcaatgttccgttagaatgtgacaacaaaagacaacaacttaagttgaaaggggagaaatcaatgcatgaaataactaaaagaaaagtaaatgtaacactacagaaagggccatacataaaaggaaatatgacatttattcagttataatcttgtcctgtcaaaaagcatctataagatgctttttttcctaaagctaatttttttctgaaggagatactctaggccagaaacattttatatcccgtaaaaagaaataatcacaaacaatgccaattcaggtggctactcagaattccttttacttttatttaaaatgacctattataaaaatatacatattggtaataatcctaatatttagctatccttcaaccatgttgacttaaggcaaatgcttagctgaagaaccaattttccaaaatattacagccctaattaaacagattcagaaaaattagtatattctttcccatgtagagccagcaagagtgggttaggtatggcatggttctctcaacaccagtgtttcaaccttagcttcctcttctcagcaccatcaatcaggacactgagatctgccctctccatagcgggctgtataataatattaaaccctgcatcttgattatgcttcaggatctatgagctaagagtaacaaagcaccagcctccatccttgatcctacacttatgtctttcttgaccataagcaaggaacaactaggctgcgtgaaactaaaagaccaaatgacattagttttacaacccatgcagagcttccagaccacagatatttccacgtacctataattttcaactctttcaatctcgatcattctaccattttgataatatttggcaatatttaatatttcttagctcacttctctctctactacagatgtcttgcagaacaaaattatccatttccctaacactgagccaacaggtgactgtctaccatttttagagaatccccttgtattagtttgttctcacgctgctaataaagacatacctgagactgggtaatttataaaggaaagaggtttaattgactcacagtttcacagggctagggaggcctcacaatcatgtcttacatggcaatcaaggcaagaaggaacaaagtcatgtcttacatggtggcaggcaagagagtgtgtgcagaggaactgccctgttataaaaccatcagatcctgtgagacttattcaccatcatgagaacatcatgggaaaaacctgccccatgattcaattacctcccactgggtccctcccatgacacatggggattactacaattcaagatgagttttgggtagggacacaaagccaaaccacaacaccctcactgaacaaattagtttctagataaattaatggtccccaacctgaaactaacagaaaatgcatctgtgtgtttttagctaattcttgtatccattctacccaaacactagtctaaacttccactttcatcaaacctctagcccctcatattcccacttgttctgcagattacttcacttacaacaaatatgaaataagcaaacagacaacaacaataaaatcgaaacagtaaaaatgaaactgtccccaacttctatctttcattcttatccatttctattaaaatgaaaattatctggttctcttcctctctaccttcttgcagactttgcacatttaataacttctttcttctaatatatcttttcttttttttgagaaggggtctcgctctgttgtccagactggagtgcattggtgtgatctcagcttactgcaacttccacctcctgagttcaagcaattctcatgcctcagctccccaagtagctggcattacaggtgcatgccaccatgcctggctaatttttctgtttttagtagagacgggttttcaccatattggctaggtcagtccccaactcctgacctcaggtcatccgccttccttggcctcccaaagtgctgggattacaggcataagtcactgcacttggctcttcttgtaatatatctttattctattcctttctactgactttttcactgtagtatataagtgtttataaaaccatatcttaaaacatagccagacttattaaaaggttatctattatccctaaaactattttcctcacttatcacttcttaagccatctgattcctttcatataaatgcttcccctttatatatatgtatgtatacacataatatataaaatgacacatatatatcaaatatgtgataggatatataatcagacatcttatatattaatatgtaatgtatgctagatgtattatataatatataatagatactaaatatataatagattacatacatgttaaatatataacatatatgtgaaatttttcaattggtaacctgcataactgttttctttcaatcaaatcacatttataagatcaattatttctcattcttgaatgcttaattacatataaatatcacagtttatccattctactattaataggcttttaggtagtttggagctacttaaaatatataaatataaaataaataggaacttatgaatattctagtatgtgtcttttggtgaacaaatgtatacaattttatcaagtatgtacctgagagtgccactgtggaattatgaaaatgcatatattcagttttattggataattccagggatttccaaagtgcttctgcaaatttatatttctagcaacaatatatgagtgttccaatttttttttttttttttgagatggagtttcactcttgttgcccaggctggagtgcaatggttcaattttggctcactgcaacctctgcctcccgggttcaagcgattctcctgcctcagcctaccaagtagctgggattacaggcatgtgccaccacacctggctaattttgtatttttagtagagacagggtttctccatgttggtcaggctcgtcttgaactcccaaccttaggtgatccgcctgccttggcctcccaaagtgctgggattacaggcttgagtcttccaattgtcacacatcttcatctacattttttttcccatatttttcacattaggcatttttgcaagtatgtagagatattatattgaggtttaattggcatctcattaattactaatgaagctcagcatattctcctatggttacagctttgacttgcacatacagacattgttcaattcaatttttaataatccttatatatttttctatagtcttttagattttctatgtatgaaagcatatcatctatgaataaagacagttgtatctttactttttcattttttttaatttttgttctgtattattccactagacagaaatgccagtatacaagtgagcatacaaggtatttttgaatcatactctaactcagggagaatgatttcaatatgttttcactgattttttagttaactcacgtattaaacgagtctttaaaaatttttctagtaaatgaggacttactagtcttccttttactattgatttctaacctaaaatactattgtgattaaagaataagctctgaatgatttaaaacattttatatttgtggatgctttgtttatgacgtataatcaaatatcatatgctttaggtacactagaaaggaatgtgaattctagtattgttacatcagtgttctatttatgacaactggtttccttaagcctattatcagtcaagatccttcccaccccaggtatcaggcatccacagatctgctatagagcaccacagattagatgtatattttctatagttgtatataaatggaattctatggtatgtaattttttgtgtgatgtttcacatggcattacatgtgtaagcttcacgtatgttgctgcatgtaccagtagtttattttatttattgctgagaagtattacattttatacatatactgcaatttgttaattcattatctttgtgactggcatttggtttgtttatttcatttgctataataaataaagttgttatggcattattgtacaactattttgtattgtatgtttttatttctcttgggtaaataactagaagaaaaactatgttctgttgttaagtatgtttctaacttcataagaaattaacaaactgttgaccaaagttattttaccattttgaattccaccagcaatgtatgagcattatagttattctgcatcctcagtcacacttggtattttgatattttgattctttttacattttaggaattttgatgagcataaagagaaatgtcactgttttgttttattcatcttctatggttaataatttttgtcctagcaaaaaatggctactacaatgttaaacagattttcctttatgctttcttccagatatttgaagttagagatttatgtttatgattatgcttactttgtattaatttttgtatatggagtaatgtgcagtacatttttttcatatacagatattgttcaagcatcatttagtcaaaatgattttcttttctttttaaataatcttggaattgctgtcaaaaataaattgatcatttatgtttggctctatttctgcttcatttctatgtctatctttataccagcatcatactatgacgctaacatcactttctcagggaagagttccacaatactaagactagattggatcctcttttttatgttcttatagaaatctatacttcatttaacattagattcatcagaaggcaatatgatccatgtaggtggagacaatgttcttttttacccttttattacttgacacagtctacaggagatatctggcatatgaataagttactggaaatatttcttatataaattgtagaattattaagtgcagaaaccacatgcaaaatactgtcaaaggcagacatgaattcaattattctcttgtattctgcacaaactgttaatattttccagacatttcataccctcactccatctaccaggaggtttctggcctctaaacatggcacaaaaacccttgatcaaataatgtttctcattatttatgtttaaaactcagaatgcaaatctgttggaagtcatgcttgtcagaaagttccaaagtcccaaattcccacttttagattattatttctcttttttttattatactttaaagttttagggtacatgtgcacaacgtgcaggttagttacatatgtatacatgtgctatgttggtgtgctgaacccagcaactcgtcatttaacattaggtatatctccaaatgctatccctcccccctcccctcacccacaacaggccccagtgtgtgatgttccccttcctgtgtccatgtgttctcattgttcaattctctcctatgagtgagaacatgtggtgtttggttttttgtccttgcgatagtttactgagaatgatggtttctagcttcatccatgtccctgcaaaggacatgaactcatcattttttgtgtctgcatagttttccatggtgtatatgtgccacattttcttaatccagtctatcattgttggacatttattaaaaactaacttcttgagaaatatgtcttattggcccaagaataaaacatcagttttatagtcgacaacctgtgtttgagtcccaactctgccacattctaaatacaaagcctggggagaaatcaattagcatatcttgggctcagtttcctttcagcataattacaatacaaatacatttcagtattgtttattaagatttaatgtgataacagctaatcttagatttgtgtatacacatacccatgcacataaatgaagctatagcttttctttctttcttttttttttttttggagacagagtctccctctgtcacctaggctggagtacagtggcgcaatctcggctcactgcaacctccaccttccgggttcacgccattctcctgtctcagcctccctagtagctgggactacaggcacccgccaccacgccctgctaatttttgtatttttagtacagacagggtttcaccatattggtcaggctggtctcaaattcctgaccttgtgatctgcctgccttggcctcccaaagtgttaggatacaggtgtgagccaccgtgcctggccaaagctatagcttttataagtttataaggtgaactggaaaataatattacaccaaatttgaggattttggtggaataaagcttaggacaaattctacccacggttgaaaatccagaaacagcacaagaacatttcttgacaattagaggtgaaggggcaggtactgtgactctttcccattatccacaacacatttgtgtgcacatgcatgtgcacacacctgtacttacacacacataagtatgtacacacacttcacacacttttcaaaatagtgtgaggtcagctcggttaatcacaatccttttggtgagtgtatcagtcagagctcagtaaaaaaaaaaaaaaaaaaaaaaaaaaacagaaactactgtaggtgcttcaaacatggaatttaacacaagaaattaattatataggcaacggaaaaactaagaagccaaatgtaaagcaaccctcacttcaccatcagcccaagttgttaccatcctggtgctgaaggaaatggagaagatgaacccatgccaagtagataaactaacacaaataaatgattgcttgtcagcagtctgtcaattttctcccattggttaactctagctgaaaatcagtaagtagtcaaaacatcttgactaggaaaatgttctgagagtaaaagtaaccatgactagcaaaatggatttttagcctgagcatgcatatcccctcatttttagtatgtcgtgatttcattcttaaaatctcatagtagttaatttttttatttctgtgattataatattgagtatgcttaaaaaataaagttcacacattcatactctcattcaaagaaatgtttgtacaaaatcaacattttgtataaatgtcatcttctctacctccatcactagaaaaaaaatatgatagagggatgggctttagctctcagcccttttacatattcttgatccttaagatgctgtcaaatatgcctattcatctctatacaaattccagtattttgttgggaaaatagaggctgcaagagcaatgggatgcatagattaattgtaaattaatacttatacacataagtatatatactgtacatgtttatataaagaatatggttttctgatttttaaataaaacatcagcttctctatttttttgaaatacagctgaagttttgccacatgttgaaaatttccttcatgacccagatttttcagggtctttgaagattcaaccatggtttaacttgaccctataaactatgtcattggctctattactaaattaatagctgactttcacaattatctataaagtgagagctatactgaaaagatgactagctttagacaattgcaacaacaaaatcaatgataaaggtaccagttttcagggctcttgtgtgcttttgaaatacatatctttctcgtagtctcatttaactggtagatgtgggcactgccatagcgccttgcctgctaggaactacaaacattacaatatgtactatgtcagttgtttaaacataggttaagcagcagcagcattaactcataccattattgcttcatcaacacactggaagtaaagggaagcagataacaagacagtacggtgctttggaaattattccagagatgcctggagcaacaaggttgttatctcagatgtgaggcatagaatatgtcaggtgtaaaaatgcaccctgaggaaaacaattaaagtgactgtcttctatttatttgagactcacacactctgtacctaagtgaatatcagaggttggagaagtgtctgtgatcgggaaatattaaagagttctgttcctgaatttagtctctcttcaaatcagaagtctctctcttcctgcctagagtgtcttataaaacacaaacaatcttccagagtctttctatagatcagcacagctgtctcctagctgagaggacgaggttcaaacacatttcagagcagctggttgttggcttcccagctgcttaggaaacaggaaattttattggcagcaatccccaacctgaaagcagtaggcatctaaactaatccccaggcattggaattcagcaaccaggagaagcaagaagccatgtgtggtttttaatcactgtgatgttggtctttgtgtaaattcaaagaataaagttctcaaggttacgtggatgaccatgtaggtgagagggtgtgtgtaagctgaagggaggagggaagtagagctgaggggttaagaatagggactctggaggtaaactacacaaattcaaacaaattctttctctctctgagtctgttttctcctctgttaaatggaaaaccaacgacatctaccttatagggttgtcagaaggacagaacgtgaggatccagattaatgatatagcagaatgggatgtatatatcctgtttcattgtcattactatgattgtcaaggttttgaaaacaacaataacactcctttatcaattgttattgcaaaaactgaaagaatgcacaaagctgaatttgtaataatggctcccattttgtaaacttgtgtcaagaccatatgctttaaaatattatctataatcctagtaacagccttgtgatgtaggtattatttttcccacttattagataaggtatctaagaactatgactcagataatttcagtgccttgcccaaggtaacacagatagtaagaggtaaacttgggattaattccaaatcgccgtaactccaaagccctcattctctcaaccatcttgtgctgctacttttttgagaaaaggaaatattttgtagctcattgaaaagatctcttaattgggactgttttgtcctggctaaggtctcccaacacagtcttcttattctacctctgaatactttgtactaagatattcttcctctctagtttgggagtctttttaaaattttttaaaaatccttcatcattgaactttgtccccacttggtttttctgaatggtgctccccagcttctcttgtcctccagaaacatgtgccaaatgtgattgctcgctcattctactgcaccttaattgcaccatttcaaggggaagattgacttttgtgattaaaaactgcttgaatttctgggcaatcctcatatgaactgaccccaatttttgaatgctatatgcctaataatagactgaatggtgcgtgtatgtatgcgctttccactttagattccctgggttttgtcttctcttttaaatctaactgttcaatttgaatatccatagataaaaaaaatacaacaatataatgataatagcacaatggtcacaaagaaagaagagggttgtcctctagaagaaagcttttaacctaggggtccagacacattggtgcatttcaattatttgtgacatgtctcacaagagccataatttgatagtaataataatagttcaaatattgaaattagaaaatgatttactgttttctcacaaattggagtggcttcaaggttatccctctaattatgcccttttactcacttgcattctgatatacttcctggagcaggaaagaaaggggaagggctaaagctagtttcctaggaatcaagcttagaagcccaccttattaagacagtgttcagtgaaatgggcctactcataagaaatgtgttctgcatgtgaatgtgcatcatagcaaaaaaacgaaaagtaaacatttgagattgtcttctccaggaactagagattaggactaaacagattaattgcctttaagatcttcctcataacaccagtgtaaaaaaaaatggccatgttctaagatcccagattcaaggtctaaagtatttttaataacctgtcttacccatttaataagttttcaattcattttcattcatcttccacaatgtcttctgtggcagacactatttgcccatttttccttgataatgataacctgattttattcaggcaattaaaccagacctgaccttttacaactgattggtctagaggtgtttcatgtgacccagtcccgaccagctgggtaggaggaaatctgctggagtggttctggcacagattcttttttgcatgtcatataaagagaatgctcagtctcttacttcttaagtgatggtgtaaaaacatgaaatttagagctgctgtatccatattgaaattatgaggaaacacataacagtaagaaacaaatgatgatagaaggaaatgttaaataatctaggtttaatgacattattaaactttgtaataaccataatctggacttcttgttatgatttaagtcattgataataagatttgttacttgcaattaaaagtactccttttccaaatcccattttcatttctctatttccagcctaaaatagttcagatgaagacaacgtaatcagtctcttagatgaggttccacattctaaccatcttggtaacttcagctgcagctgtttctctccagcactagttgcttcacatcacacccatgttcaaaaatatgcagactctccttgctctggatattcatgctgtgggcactcggtgtagcactggcttatctaactcccaggtcataactttacttaagcatgactagtccatttgctgttgctcatctacaactagttgatcctgccttcataatttgaattctaaattattattttatcgatggaatcacactcaccccactcacatctattttgatctttaaaatccagagttttgaagcaaagtttttgttacttcaataaaaacagtgtttgtaggtatggatcaaatcaacatggtattgagatattgtttaacaattccctcagaaagaaatacaaaaatatgggcagagaggtcaatcaaaaaaggaggatgacacactgagagaatggctgcatggaggaaccaaaggaaagcccctttaataagtaaaagatcttgggcaccaggaggtcagagttttcatcctaggtaatcattgattgaggaccgatataagatggccattgattttagggagctctgtagccttttagagaaaatactggggcttagtagtgcagaactcaaaatctcatagcctaagagaaacacagtaacactgagtgaggagtcagccaagcaaagaagtagcagtgcccagtgtgtccatatgactgtcccctattcactcccatgagcagctgaaatgataagacatgtacaagccagtgcaatttgagttattcctgttcatataacatgatatgtataacacttggattgctaagctctagaaaatttttggctacaacagtagtccgttgtcctaagaaactatatttcaacgtatcttcaatcttttgaaaaatctaccattcaaaggaagaataaagaatttgttttgcaagaagatgctaaaatgtgttttcgtaggctcctattatttcaagattttcagagatggatctgccaatgtcatggagataatttgcactaacttggttttttttaatcttatcgttctgcttataatcatgccatgcttctgttttgttctcttttaaaatatctggttattatgccttgatttatttgaattaagcagaaacggtgacagaggcaacttgtcctgtgctagagttttggtgatttgaaaagactggtttttatttttacagaaatcttattgaaaatgttccagttaaggaaaacctgctctagaagtgatgcagacaatgcagtttaaatgatgagaaaatgtggtgaatgctaatgttttatagcttttaattattttgtcctttgggttcagcgaaatggttgtgtatcttagggtcacggagaacattcattttctaagtgtgtgtgtgtaatttttcttctttatttctttgttaattttttaaattgacagataatattttatgtttttatcaagcacaacatgcattctagcttatggaaaggcttttgcactgagtatagaaggctaggggtattttcagtgggtgaacttttatggataatgatatgaccaagctatagggcagcgtttatgaatgcatattttattggaactgataaagaagtgagatggtctgtggaatagacagtcaagagtttagatagtgaggtttttgcaacagcatggaaagaaaagtatcaatcttgcttctttgttcagatacctgatgtatcttggtttcaggcttttcaatttattgttcaaaatgctaccagggaagacaaatgactaactccagttgtcttgtaacaacagtaaagctttggttagggagtttacaattggacttagaagacagactgcgcaagttcttcaaatccaaatttaataatagataaatgttgattaggattctttattttcttaagttaacttttagtatctggtattaatgtagttaggtgcaaaagagttctatgaatttgcaagtaccacagtcaaataattgttttgaatatataaacaaccatgaaaccaaatatatttatgaaataatacagtagttgttgctttgtattaacgctataaaaggggtctagaagtagactcttgatggcatcaagctgtcttgaagtccctattactctcatttgggccaataaaattatacattatttgttggacagtgtctacaactccaatgaacattcatacgctgaagaattccacatcttcagctctgacatttgggttccattattatcatatttccaattgccttttggaaatttacacttagatgtgctataaggatctcaaatgcaagccaaactttctccccagcagtgtagcataatgattaaaagtgattaaaaacacagacttcagaagcaaatagtctatgttgaaaacttttctctgtcacttattaaacaagtgaccatggatgatttatttaacttttctgggcctcagttttcccatctgaaaaacaggcataataatcatatctacctaatgaagtagacatgacaattacataaattatacggttatatatttatttaaacatttgtaatagtgtctggcacatacatatattaaaaacaggcacaataatcatatctacctaataaacttgttgacatgacaattacataagttatataactatatatattatataaatataaacatttgttatagtctgccacatagtatgcactatatataaacttttaagtactattacagtagcctccaaatctgtgcctattccactcatagtcaccacaatgtatttattgtatctcctaaagctcttaaatgtaaacccccttctttgactttacatctgcctaattaatgcaaatcaatgtcctttttacatgaaccattgaaatagcctcccattggtctcatagagttgtttccctttctttaatttatccaggattatctttctaaaatatgatttggataattactttcctgttttacaaacttcaagcagcaatagtaaccatagaataagttcagagtattgagcatgttatagtctcaaactatgattttgccaatcttattttccaccaatacaacttactcaccgtttctttctcacagtatgaaatgaaagtcatgcttccatgagtagatgtttgcctttcttccaagagtttctttcttgaattcacactgttctttaagactcagcttgattatctaagtcattttccagggagatggtgatgatatccccaacaccattctcctctttcaagtagtgatcatgaccagtttctttgtgcaccctgttgtattttgcccatacactgtactcctattatagcacttaccaaagtgaactgctattgtcttgccctgatcttcactaggaaaatgaatataaaacaaaagatgtaggataagaaaaactctaattgtacttgattgttggctcacatttaagtagtgattacattttttaaaagattctggagaaatgactatttttttctttgattctgtgaatctaatagatcatgacactttgcaagcaggtttggcatgccagagtaagcaaaggaaggagtgagagaagaatgctaccttaatcaaaacaggttcagatggactgccctgtcctatatccaaaaaaactcaaaaaacaaacaaaaaccatgtattagttattctgatgttgtctttgataagaactaagaacattaaaaagagggaggctgctgattcaaatatcctgcaaagattttgaaggaaagcaatgatcaggggccatctcaatgagtatgttgaagctgaggggaaacagttatttctggagcaagtttagaaaatgaattgccctcagaattaggtagatattgtatcctggagtatttgattccgttgatactagaatcttaatgctttgtttcactttcctgattttgatacttaaacgtgcttcgtaaaccatctgaaaccaaagctacaggattgtctgaatttaacctaatgataccagggaaataacgcataattatttctgctctccttagcagaatttaaattctctctcttctgtcagaaagatgacaaaaaaaaatgactcatgtcaagaatcaatttgtcacatctataaccttgacactattgaaaataagtatatagtgagatgactggggactttaaggggttggaagaggcttgacagaaggaagtctgatttataacctttctcatctatgaactttccaaagactttcatctaatgttcttcctggatcccagccctgaatttagttaacctttgtggctgtgccaatttatccacacctttgagttctatctcactccagaatatgaaaccaatcttggccaaagacagaagcctataaggcatctttggcaggtggcataacagtttagcattgagttattctccttaccaacggtgtgtgttagtgagcctattcgatcccttataattgtgctctgaatgataagggatcaaataggcccactaacacagctgtcaagtaactggaagacagcatagactagtagaaagagttttcctttttttttttctcttttttcttttctttttagacggagtctcgctctgtcgcccaggctggaatgcagtggcgcgatctcggctcactgcaagctccgcctcccgggttcacgccattctcctgcctcagcctcccaagtagctgggactacaggtgcccgctaccatgcctggctaattttttttgtattttgtagtagagacggggtttcatcgtgttagccaggatggtctccatctcctgacctcgtgatccgctcgcctcggcctctcaaagtgctgggattacaggcgtaagccaccgcgccctgcctagaaagagcttttcagctgtaaattgagactaaatattcaatgtacattttggctaccgaataattttttcctagttacttaatgtttctgagctcaaatttctttgtgcagtatgcaggttggactgaatgacttataaagtcccaaccagttctacaattttaagattaataactgctactttttcctctaggtcctccacagaccctttaaaatcatgacagattatatcagtgactagatttctgtctttaaattcttatgtttagttccttgatacatgcaaactgttttcctacccatacataatgaatattctcttgatttaatgcagatttgggggacacattcctatattaatattttctcctatccttgacactttctataaactaagtacatcctagcttagtgtaattttttgagtctgtcctataacctatcactagcctctctttggtaactcttctaaactctcaatgagcaagaaaaacattaccaacttacgtacattatgcgctcaaactactattattgtactgcagtttttataatataaataatttgtatgattatttgatgaattatataatgataggttacttttggcattagcaagattatttataataaaatgcagtgtggtggtattttgggaaaaagtaacctgaacaccaaaacttttattcttgattaataaagaggataatatgaaatatcctggaagggaactgtatattatttatgacaaaataagtcaaatggaattgagcaatggatttctcttaatcaaatcaatgtatttgagcaccttccaactgaaaaagcaaggaattagttgaatatcccaacccaaaccaatctaataataatttatttcaattttctagaacccaatatttaccttaacacataaagagcatttctgaatctgtaagaaaggaaggccctaaacagtcattgtgttgcaaaaatccacatgatctgtactcttcaatgtggaatgtacttacctcttgtacttctaagccacaagaaattttaaagtactagtcaatattgtttcataacagttgggaatttggcagatagttattgagggacatttgatgacctctagccccagattagtttaaaacattgttaatctataaactacaggcatgttctgctctcacacttactccaacataacagaaaacaggaaaaacatatcactttattatgtgttttttatattaatggccactattcactctgatgttattatagattatgttgttcaacatatactgactctttcatatcactgagcagagactagatgatatttggtacaaatggaaaagtagtaaaatatttattcagaaagtatgtgagttcattttacttagagacctgtgattacacacatgtggttttagcaaaaacagaattgagatgcataggcctttatcccggcagtgaaacaatttttttttctgatttaaaaaattatactctaagcagttgagggattttcagattcccagttaaattttgggattatatcctgttcaaaaatcagtttgtgaaacttgcaatgccattcacaaaagaaaatgatatttcagatggtgatatgctttctcagcctgttcattgaacccttcttgtttaactcatgtttcatgtgaagtatttaagtcacagtaatccagaatgccacaataataattagtatttactgattcttgaccatgccaaaagtattatatccattatcacatttaatcctgaaaataaaccaaacaaatcttatggatatagataagaaaaagaagattacttatcctttccaagaccacaaatcttgtcaaaccttgcaagccaatatttacatagttcaaatgcacagtaagcagtgcttattatgtgctaggcattgttaaatagctttagatatatttaaatcatttgccatcagaagtctgtactgtaggtcttactattatcctcattttacagatgaagcacaaagatccatagtcacatattttgtaacaagagcaggatctgcagccaggcagtctgggtccatggtccatgttcttacccatggtgcaatactgactcttgaagtccagggtctactaagaatccaggtctacctgactccaaagccagtgcttattttactactcactgctgtcactctaacgacatgtagaacagcttatggaataagaaaatgcgttcaatatgccaagtcaagatgcctggaatatttaagctacccacgtgattcccatgcagaaaataaagccagagtctgcattttccccccaggctaaggaagaaaaattcagtttgctagaaacaatctcaaagacctgtactaggggtttgtatggggaaggaggccaggatttgtgcaagtataaactctggattcagttccaagttcagaatgttactctggttagttccactgactgctccctcccccatttcatatttagtatcttgattaaattgattctgatctttccttcccaaatatgactatggtcagtcttggaagatatcttccacctgttggaaacttaaccaaacacaaagagtcctgaaatcttttaaagatgtttacaatttgcaacaatggggagaaaaaaaaatggggtaaaagcagcattttgaaaagaattaacccttgtgtatgtcttatttctagaactggtgtttctggctcactccattttaacagagaatgttcaccttatataattgcctgccccaagccctcgtcacctgttttggttttttgtttgcttactgaaatggtatatttaaaatatatgtttcacaagggtgtttactcaaaggagtacattttactagatttcagagaagaactctatacttatctgttcatgtttcattaaagcaggtttatttaaaaatcattaaaataacatttagggttggatgcaaggtaggctctcttgtgatgtggggagcagttggagatgcattagaacttgggaatgattgcaagtagattgccaatggcagaggaattaaaacagaaggaagcatccaggaggctgagatgggcagatcaagaagtcaagagatcgagaccatcctggccaacatggtgaaaccctgtctctactaaaaatacaaaaattagccaggtgtggtggcaggtgcctatagtgtcccaactactcgggaggctgaggcaggagaatcgcttgaacccaggaggcagaggttgcagtgagtcaagatcgtgccactgcactccagtctggtgacagacagaaactccctctcaaaaacaacaacaacaacaacaaaagaagcatccattagcacatacaaatttattttcattgcctcttttctttctctttatcaatatatcttctgacctgaacttcttgcaaggagaagtgagaaatgggctttgggtaagagaataagaactgaaaaaatatttagcatagacaaattttgtattgctaagctaaaatcagtcatttatttatacttaaagaatctttacgtttgtgagacagtaaaatgctctggttaggagtacaggctctggaataaaaaaacctagatttaaatctggattccacaacatactcatggtagtacctcacggaccagttactcaagttttgcctcaggttttaatttgcaaagttgtggtaaaacaacagagattgctacaattattataaagattaaataaagtaaaatatataaagaacttaaaacattttccgatatataacaagcgctagtaaggattaatttttgttattgttgcttctgttgataatagttatgtctttttttctttttctttttttttttttgagacggagtctcgctctgtggcccaggctggagagcagtggcgtgatctcggctcactgcaagctccgcctcctgggctcacgccatccttctgcctcagcttcccaagtagctgggactacaggcgcccaccaccgtgcctggctaatttttttgtatttttagtagagacggagtttcaccatgttagccaggatggtctcgatctcctgacctcgtgatccacccacctcagcctcccaaagtgtagttatgtcgtttttaatatgcattgtgatccagatgctgggatgatagttttacacagaggatctatacaaagcacaactgtacatataacctcaaatattactgctaggattctctaaaagaagtaatattattttatgaagtgacataggacaaacaaaatcctcaatgacattacatcaaacctattcgctgcatgcaactagcagggtgaatggtagggcgtggacacaaatctttctgtcaatatttccatttactctggcttgtggacccatggacacagacaagatgggaaccctgaagggttcagccaccacaggtcactactttatgattcaatttcatctttagggcaggaacctctttacaaagtgtatgggtgagctttggagtcagtaagcagtgcaatcttcccccagttttatcttagaataggtatgtgaacatgagcaaattattaacctttcatgagacatagccccatcatttgtaaaatggagataaaagtatctacacattaggtaagtaacaactaaaggagatgttgtatataaaacatagcaccttacagatattgatttagcaagccagctattcttatattattatatttaatcttcaagttggaaaaccaggaacaaatttaccttttttagaacaactaatttatgtatgtatgcatttttatatgtaggcaaatacctcttctataaatgtccctaggaattgttgctaaagcaaaatcctttcttcttgagaaagcctttaaagtctgaaaggttggcaaaggaagattcttaagtcctcttgtatgaattagcagacaatttttctcggctttcaaatcacccttcccaaaacaaaccacaaatagtcccaatatttgcacagatccctcaaagagaaacaaactacagtttccctggagctcgtttgtcacttttccctttcttttagcatactccgaggcacttaatgccattaggcaaaattatgccatccatggcattgcacctggcatggctagtgttcccaggtggagaagcagatgtataatggggctattcgaaaatgctacattggaaaaacagctatacaaacaaaattagtgagacaacactgaagattgctcttccttctattccagcataatttatcttccagaaaaaagaattactgcatgaaccatggatgagcataattaagggggaaggcaaagtggaggagttttgtagccgcatcccgtgtacattgtgcagggagagagaagggaaaccaaagcattcactcatatgtccatgcatattaagccatttagctggcatatggaatgtttcaggttgttccagggatatagacaaggaactaaatattgactcagcaagagctcaaatgagaggtctaattaaattaaatggtacaaaggggaggcttgtttcatagactccagtaattgcttaaaacacaaaagagaccaaataatgctcaaagaagtatagtaacaaacaagaaaatatctgtctatctatctatctatctatctatctatctatctatctatctatcatctatctatcatctatttatcatctatctataaatatctacacactaggtaagtaacagctaaaggagatgatgtatataaaacatagcaccttacagagattgatttagcaagttagctattctaatattattatatttaatcttcaggttgaaaaaccaggcacaaatttaccttgtttagaacaactaatttatatatgtatgcatttttatatgtaggcaaatacctcttctataaatgtgtgtgtgtgtgtgtgtatatatatatatatagtgagagggagagaagacatgagcataaaagttaccaagagttcaaaggctatggttggctcaattgtgaaaaatggttggaatttgttatgacaatatataatcagtggtgcctttaagcagtctggcgatgacacatgcatcagcatgttagttttaattttacgttaatgactgcctatctgcagaaatgccttaggataatgtcctttctttggacaaacttgattgatacttcacgaattataggagcaatggttctgaactctaaaaatgctgtgctttaagtcctgcccaaggaaagagtgagggtgagggaccatgaagatgattctggtgtactagggttgtctatttcagaataatacattgagaatgttggacagcatttatagaaatagacagatttcatctctgacccaaaagcactattgctgagtgttgggcatgccagagcccatcttggataaaagggagatgcaggatggaactggggaatgaggagaaaagaggctctttttcttccttgtaccttagctctctgagccttagtctgtcatctataaaatcagaataataatgggaccttcttcattggtttgaagatttaaataacatatttaagggatgtaaaaccacttctggtcattatttagagctcaataaatgttagttgtcattgtggttaccattactcttaccgtaatactcacagaaatgaagaataagaaccctgtcctaaaagagtgtttcatctgctcaaagggaaagataggaaccctggatctgctcaattttacattttcactaaagcttccatgcccctctgctgggcaacttaacattaaatgtacatactttagaatgagggaactgggtttaagatatggctctgcctcttaatagctttgtgaccttggatagttgttagacctctttaagttgcaattttcatatctataagattgtaataataatagctattccatggaggattttttggtaagtataaaaaatgtcaatgcattttaaatatttagaacagtgcctagcattaataagcactcattttcatgtactatacaggcatatgcatatattacatatatagtttacaaatgtaaaccaaactgacatgcacacacacatattccacccttcattcttttagctttaaataaaattacaaacttttttagcatgatgaaacctagttatatcactgaatctctctgtctctgtctctgtttctctctctctcactcaatcacactctcaaatatacaagcatatgctagcaaagcgttagttattatctggatctctacttacactacttcctaatttaaacaaatcttttaaaatttattattaaaaacatcaccttgcattcttagaacatttatattttcaggtcagttacatagacattttctctctccatctaaccaaattctaattctttattatttagtgcaaattttctgtgaaattctttaggctattcaaatgaaagtactttatttcctgcaaatctttggcatctattgtccaaaacatttattaattctgtactgctcctaaacatttctgtaaatataatgggctgttgtaccctgccctacatcttaaaagtccttgctactagaagtgttaatcttgccaaaaaaatgacttctttgaatttctaggtagttaaagttctattctgtacagtaattgaatatttctgacatgtaaccttatataaacactctaatagcaaataaaaatgtctctatgtccattgttgaaatctcagggctaaatgtctccatttgtattaggaacaagtagattaaagtccaaccatccttctgaagagcttttcccttgtgctgaatacagttaatgacagcctaagtcttttgtttgttttttttttttttgtagaattcatccattactcatcagctatatctgaaacaaactctaatcttggtacagaagcagagaacattattcttcctcaaagcctatgccacgtgttgctgctaaaacaggaatggacaaaaaaacagtttcataataaatagagaaatgagcttactaaaggcacggcattttcttaccttttttctttacacataatttgaaataactcttacaacaattagatgaaatatatcagtgaataatatcactttagggtaaatttaacatttatccaatattagctaattccatgactactgccatgactactacgactattattaataataataatcacaaatatttaatgagcacctgctacatgctggacactaggctaagcaacttacgtgtagtagaatttccctcctggaaggtatttattgtccagtgagcaacctttctattcttccctttccttgtacataaatgatggaggcctcattagtgagattccagaaagtacataatccctggtccatgtgtaaaaatgtagagaaaagctccctaccaacctgtattaaacttaaacgcaagtgaaatttaaacttttgttgtgttgagtcactgagaattggtagctgtttgttaccacagcataacctagcctaaattgcctaattcagtgttattgactgaaacaaacctttcttacacgtttttcaatcatattcattccatgttatgtgaatgagagcctgaggctagcatatacataatttatctctgtgttgaagaggaatagacttgaactctacagctggttggaagtataagtgagggtcctaaaacttgcatgagacaaagtcaattttgtagtcagtgataagaaataccatgtgcgcggccaggcgcggtggcttacgcctgtaatcccagcactttgggaggccaaggtgggcggatcacgaggtcaggagatcgagatcatcctggctaacacggtgaaaccccgtctctactaaaaatatttttaaaaaattagctgggcgtggtggtgggcgcctgtagtcccagctactcgggagactgaggcaggagaatggcatgaccccgggaggcggagcttgcagtgagccgagatcatgccactgcactccagcctgggcaacagagcgagactccatctcaaaaaaaaaaaaaaaaaaagaaagaaagaaataccacgtaagcgcatgcatgcacaccccccccaacatagtaggtgctcaatgtctacacaatgtatgaatatatacatagaaagagtatagatcactttttaaaaaacactgaatgttgctagaaaactcaaccacgaattgcctgtgacccagggcttgaccaaagcttccttaagacatcaaatattgcaaagagacaacttaatgcacttattcccctatggttgtcagtgtttttttttgtgattagctagatcatcagaaagtaacatttccaggtcatattattaccacaaatccgtgctaaagagccttcactaagttgaaatttaatgtaacttcaggttttattgagggtcaatgaagaaatgtctatttgaacatttctgtcttttacagacccctaggttaggacattgttaccatttgttaccatttgttattcatgttaccatttgttattcaaataattaccatacacaataagtttctctttaaatttgaagcctgaaaaaatgttctgtcttaagaaatgtctatgctgtctatcaacaagtaatgacaactctaaactataattacttattaatttctagttaagtttactcatctagagtaactaattaatcccaaaagtctttatacttttgaaaattctttagagcttgtttctattttgagtttcaaatttttatatttttcttgatttctgaaactgttgtaatttttcagaagcaggtggaaacaaactctatttatgaaataaaacttcctgtaatttattattattttttgcttgtcttttctttctggctgcatttctagagaacaaagaccttgcttattcatctctgcggtgttgtttcagagcaggcaaaatgagaataaatatatgttagcatggaatgacacaaagagctctgaaaataaagcccaaattcacattttcgctccatcagttactaaccatgtgacatttggcaagttatgttcatttattagcctttcttttcttgtcaacaaaatatcataagtttacttgtagcactgttgggaggatagagaatatatataaatgtgtcaataagagtattcaccaaatcagcaaatactcctgtcaccttttctccacctataaagtgacagtaaaggacacaatgatgctactatttgtctcttgagtaggtacccacaaagagagcctgagagaaatttactcatgtgctttactgaaggtctgttctcagaaggggagggaagaaaaaagcatggggaggtagggcctggaactaataagaaaattattaatctaagtctgagactagctttacctgacctcagagcgggttgtgaaattgtacagcagagttggttccatcttgaagcaaggagcctgagctttatatccttctctcagtcagttattagcgattggttgtcagagcatgcaggggtggtggtgcataaccactcatacatagtgactcctgcttggctgacaacattatccagaagaaggagcagctgtgagatgttagcagccaacactcacagtagcaggaaaatgggcaaccaggtaaagggatggccactggcatcagagtgggtggagactggaaatgttgttaaacactctacaatgttcaaggaagccccccacaacaaagaattatccagcccccaaagtcaatagtgctgcagatgagaaactgtggaacagatgaaagcatgaaaaaaatcaatgtttaataattattactaggagttattgatttgctattaataacattcagacattagtaatcaaaagggaaaatatggaatttcattgattttgctagggaacacacacacacacacacacaaacaacctcacagtttttatcctgtgactttagtattctttcatattatgcaacaacaagcataaattcagcatgagtcagactgaaatgactacttttgcaaatatcatccatacagtcttgtgcctttttccacatctgctttcagttctgccttatacatgcctttatagattttgacgccagcactttactatcctagaatctacagctacttgatttttttttttgtcttctctccccttttcttctgtgtttttccctggctttcagctcaactcgtgaacatcaggatgtctgcatccagctctgtttttttccttcagctgcactttgcctaatggggaatttggcacattcctatagttgtcaaatacatcttgttcactttcatggcctctcatttcatctctggctttgaagttctatagttcaggttgtttagcacacaagagaaataattaatctcctccctcttttctaaggattgataacaaccaagctaattatttactccagaacagaaataattgtttatgctaagttttaaattcaggcaaaattccttttgaataatatggaactatttgacatatgaataagaatatagtaattattgtaaggagtacatttaacagtagagactctcacatcacatctatacttttttttatctccccccttcatttctttccttcccatatccaggtttgtgtgtgtgtgcttcatccagatttttttttctatctctgtaattgcacaaaagggatctaatttcacaaaacagatcactgccatttgtgagagagataccacagcagtctcagtaaaccatgtcaaatcaattctcaaatcataaacaatatattgtaccattttggtacacatgtacttttttctaggtttgcaattagcaggtaactcctgaaggagctgatctcattctcactgatgcagattgcttaagcaaaattggagaagcaccctcttaaaatcaatcaaaatgaaacaaaactgccttctgtagcataatataatttgtcagttggtactgagaagagtaatttggatagcaactgtgaagggaaaggtaaaacaaagaagaataagatcagagattctgatttggaaggaaccacgaggctcatttcatcccaaacttgatagatgaagaaatggacccaaagagattaatgtctagactataacaggtcttataatttggggtccagcagcttttctatagcctcatgttagcttctcattttgaggctgaagtgtctgttctgattagttcttcttaagaatccagaatcattaaatcatcactattattaatactgtgctctagtctgtgtttccccacatctttcaattaaaatcattccttagctcttgatgtatgtagcaaccatcctagcagggtatgctaataccacccactcctctcctacctcccacccctgtcatctcagcactaaagtcaccgagaggtcatagggcttcatttcagtagcaatgaagtaaagaacatgagacctagaatgaaataaagaacatgagattctaggtcaggcgcggtggcttacgcctgtaatcccagcactttgggaggccgaggtgagcggaccacgaggtcaggagatcgagaccatcctggctaacacggtgaaaccccgtctctactaaaaatacaaaaaaattagccgggcgtgatggcgggcacctgtagtcccagctacttaggaggctgagacaggagaatggcatgaacccgggaggcggagcttgcagtgagccgagatggcaccattgcactccagaccgggcgacagagcgaggctccgcctcaaaaaaaaaaaaaaaaaaaatccctcacctatttcattgtttataaaatgaatatgagatagatagctataacataaagagattatttctaaggtttcttcaagtaccattataactgaatgcattgcacaatcaaaaagaaaatccaattcattgtaatattagtttacctagatatcaaggaaatgccttagtccactttattacaatgcaatacaaaagaaaaaaaggaagaacagcacccccacatgcattttttgaagtatatcctttaaattactaaggtctgattacttccatgtacctcctgcttaagattaaaagaaacaaaaagcaacactcaatagggttgaatttactgaagcatcttctttcttctctttcctttttctttcttttattcctcctcttcttgcttctcctcctttccctttcttcatttcttttgcttctctcccttccacttcatacttcttcccgtctttctttctctataaatattccagttaattttccaatttttttttaattttccctgttttctttctgtctacaaatgattgcagtaggttcagaaagctcattaactattttccttaatgctttaacaaagcaaacacattaacctactgtcattctgtaagtacttgattgcctacattctgtaagccctcatggctcttttggtcaatagctgaattattgctgtttcctatctttcctaattgaatgaacatggccccttgatttctgttgaagctgagttgcagttgcttggcgaattttcagtctttctgatctttcccctttgactgattagttttatttatcatccagttttttaaattgtggctttggcacacctgcctcaggctaagagaacgtgattaaacacattaaaagaaatccacagaacagagtggttacataattaatcagtcttgagcagtaccaaaaaaatgctgacccaaaagcatgacatttggggaaagggtaattttaagagtttaaaaacattctaatgaattgatttttgttcctgaatttcctttttcatatatacaggctagaatataacaatagttatttctttatagcaagtctccttttacaaaatacaacagtttcccactaggcgtggtgtataggaatactaggtgaacagttgatgaagaatctgctccctgatgagaatgccttgaggtaagtcagatacattttaatcttcttagagttatattttttattctatttctaatttaggacattcatacatcaagatgactaggggaactgaactgcaacagtatgtattttccatagaaatttttatatactcacctcttttttttttagtgttttttcttttattatactttaagttctaggatacatgtgcacaatgtgcaggtttgttacatatgtatacatgtgccaagttggtgtgctgcacccattaactcatcatttacattaggtatatctcctaatgctatccctcccccctccacccaccccatgacaggccccggtgtgtgatgttccccaccctgtgtccaagtattctcattgttcaattcccacctatgagtaagaacatgcagtgtttggttttctgtccttgtgttagtttgctcagaatgatagttgcaagcttcatccatgtccctacaaaggtcacgaactcatccttttttatggctgcatagtattccatggtgtatatgtgccacattttcttaatccagtctatcattgatggacatttgggttggttccaagtctttgctattgtgaatagtgccacaataaacatatgtgtgcatgtgtctttatagcagcatgatttatactcctttgggtatatacccagtaatgggatggctgggtcaaatggtatttctagttctagatccttgaggaatcaccacactgtcttccacaatggttgaactagtttacagtcccaccaccagtgtaaaagtgttcctatttctccacatcctctccagcacctgttgtttcctgactttttaatgatcgccattctaactggtgtgagatggtatctcactgtggttttgatttgcatttctctgatcgtcagtgatgatgaatattttttcatgtgtctgttggctgcataaatgtcttcttttgagaaatgtctgttcatatccttcgcccactttttgatggggctgtttgattttttcttgtaaatttgtttaagttctttgtagattctggatattagacctttgtcagatgggtagattgcaaaaattttctcccattctgtaggttgcctgctcactctgatggtagtttcttttgctgtgcagaagctctttagtttaattagatcccattcatctattttggcttttgttgccactgcttttgttgttttagtcatgaagtccttgcccgtgcctatgtcctgaatggtattgcctaggttttcttctagagtttttacggttttaggtctaacatttaagtctttaatccatcttgacttaatttttgtataaggtgtaaggaagggatccagtttcagctttctacatataactagccagttttcccagcaccatttattaaatagggaatcatttccccatttcttgtttttgtcagaattgtcaaagatcagatggttgtagatgtgtggtagtatttctgagggctctgttctgttccattggtctatatctctgttttggtaccagtaccatgctgtttggttactgtagccttgtagcatagtttgaagtcaggtagcatgatgcctccagctttgttcttttggcttaggattttcatggcaatgtgggctcttttttgattccatatgagctttaaagtattttttttccaattctgtgaaggaagtcattggtatcttgatgcagatggcattgaatctataaattatcttgggcagtatgaccattttcacaatattgattcttcctatccatgagcatggaatgttcttccatttgtttgtgtcctcttttatttcattgagcagtggtttgtagatctccttgaagaggtccttcacatcccttgtaagttggacttctaggtattttattctctttgaagcaattgtgaatgggagttcactcatgatttggctctctgtttgtctgttattggcgtataggaatgcttgtgatttttgcacattgaatttgtatcctgagacattgctgaagttgcctatcagcttaaggagattttgggttgagacgatggggttttctaactatacaatcatgtcatctgcaaacagggacaatttgacttcctcttttcctaattgaataccctttattttcttctcctgcctgattgccctggccagaacttccaacactatgttgaataggagtggtgagagaaggcatccctgtcttgcgccagttttcaaagggaatgcttccagttgttgcccattcagtatgatattggctgagggtttgtcataaatagctcttattattttgagatatggcccatcaatacctagtttattgagagtttttagcatgaagtgctgttgaattttgtcaaaggccttttctgcatctattgagacaatcatgtagtttttgccattggttctgtttgtgtgatggattacgtttattgatttgcatatgttgaaccagcgtttcatcccagggatgaagcctacttgatcatggtggataagctttttgatgtgccgctggattcagtttgccagtattttactgaggattttggcatcaatgttcatcagggatattggtctaaaattctctttttttgttgtgtctctgccaggctttggtatcaggatgatgctggcctcataaaatgagttagggaggatttcgtctttttccattgattggaatagtttcagaaggaatggaactggctcctctttgtgcctctgggagaatttggctgtgaatccttctggtcctggactttttttggttggtatgctattaattattgcctcaatttcagagactgttattggtctattcagggattcaacttcttcctggtttagtcttgggagggtgtatgtgtccagcaatttattcatttcttctagattgtctagtttatttgtgtagaggtgtttatagtattctctgatggtagtttgtacttctgtgggataagtggtgagatcccctttatcattttttattgcatctatttgattattctctcttttcttctttattagtctttctagcggtctatcaattttgttgatcttttcaaaaaaccagctcctggattcattgaatttttgaagggttttttgtgtctctgtttccttcagttctgctctgatcttagttattcttgccttctgctagattttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcattttgttatatacccagtagtcatccaggagcaggttgctcagtatccatgtggttgagtggttttgagtgagtttcttaatcctgagtcctagtttgattgcactgtggtctgagagacagtttgctataatttctgttcttttacatttgctgaggagtgctttacttccaactatgttgtcaattttggaataagtgcgacgttgtgctgagaagaatgtatattctattgatttggggtggagagttctgtagatgtctattaggtctgcttggtgcagagctgagttcaagtcctggatatccttgttaactttctgtcccgttgatgtgtctaatgttgacagtggggtgttaaaatctcccattattattgtgtgggagtctaagtctctttgtaggtctctaaggacttgctttatgagtctgggtgcttctgtattgggtgcatatatatttaggacagttatctcttcttgttgaattgatccctttaccattatgtaatggccttctttgtgtctttttatctttgtttggtttcaagtctgttttatcagagactaggattgcaacccctgcctttttttgttttccatttgcttggcagatcttcctccatccctttattttgagcctatgtgtgtctctgcacgtgagatgggtctcctgaatacagcatgctgatgagtcttgactctttatccaatttgccagtctgtgtcttttaattggagcatttagcccatttgcatttaaggttaatattgttatgtgtgaatttgatcctgtcattatgatgttagctggttattttgcttgttagttgatgcagtttctttctagcctcgatggtctttacaatttagcatgtttttgcagtggctggtaccggttgttcctttccatgtttagtgcttccttcaggagctcttgtaaggcaggcctggtggtgacaaaatatctcagcatttgcttgtctgtaaaggattttatacctccttcacttatgaagcttagtttggctggatatcaaattctgggttgaatattcttttctttaagaatgttgaatattggccctctcttctggcttgtagagtttctgccgagagatctgctgttagtctgatgggcttccctctgtgggtaacccgacctttctctctggttgcccttaattttttccttcatttcaactttggtgaatctgacaattatgtgtcttggaactgttcttcttgaggagtatctttgtggtgttctctgtatttcctgaatttgaatgttggcctgccttgctaggttggggaagttcacctggataataccctgaagagtgttttccagcttggttctattctccccgtcactttcaggtacaccaatcagatgtagatttggtcttttcacatagtcccatatttcttggaggctttatttgtttctttttactcttttttctctaaacttctcttctcacttcatttcattcatttgatcttcaatcactgataccctttcttccacttgattgaaccagctgctgaagcttgtgcatgtgccatgtagttctcgtgccatggttttcagctccatcaggtcatttaaggtcttctctatgctgtttattctagttagccattcgtcaaattttttttcaaggtttttagcttctttgcaatgggttcaaacatcctcctttagcttggagaagtttgttattaccgatcatctgaagccttcttctctcaactcgtcaaagtcattccccgtccagctttgttccattgctggtgaggcgctgcgttcctttgtaggagaagagatgctctgatttttagaattttcagcttttctgctgtggtttctccccatctttgtggttttatctacctttggtctttgatgatggtgacgtacagatggggttttggtgtggatgtcctttctgtttgttagttttccttctaccagtcaggatgctaagctgcaggtgtgttggagtttgctggaggtccactccagacccagtttgcctggatatcaccagaggaggctgcagaacagcaaatattgcagaacggcaagtgctgctgcctgatccctcctctggaagctttgtctcagaggggcaaccaggcgtatgaggtgtcagtcagcccctactgggaggtgtctcccagttaggctactcagggttcagagacccacttgaggaggcagtctgtccgttctcagatctcaaactccatgctgggaaaaccattgctctcttgaaagctatcagacagggacgtttaagtctgcagaagtttctgctgccttttgttcagctatgccctgcccccagaggtgaagtctacagaggcaggcaggcttccttgagctgcggtgggctccacccagtttgagcttcctggctgctttgtttacctactcaagcctcagcaatggcagacgcccctcccacagccttgctgccaccttgcagttcaatctcagactgctgtgccagcagtgagtgaggctctgtgggagtgggaccctccgagccaggtgtgggatataatctcctggtgcgccatttgctaagaccattggaaaagcacagtattagggtgggagtgtcccaattttccagttaccatctgtcacatcttcccttggctaggaaagggaattccccgaccccttgtgcttcctgggtgaggcaatgcccctccctgcttcagctaacactccatgggctgtacccactgtccaacaagccccagtgagatgaacccagtacctcagttggaaatgcagaaatcacccatcttctgtatcgctcatgctgggagctgtggactggagctgtttctatttggccatcttggaacctcctcccttttttagtgttttgagacaaggtctggctctatcacccagggtggaatgcagtggcatgatctcagctcactgcaacctccacctcctgggttcaggtcatcctctcacctcagcttcccgagtagctgggactacaggcatacaccaccacacctggctaatatttgtagaaatgggatttgccatgttgcccatggttggtcttgaactcataagctcaagcaatccacctgcctcagcctccccaagtgctgggattacagccctgagccaccgtacctggcaactcccctctttatttgataaaggatagcaggtggaaggccaaactggcttcatttccatgtgaactgaagctgcatcaggttccaagatccagacaatgtcctggagcttggctctggtaaaaaatgtctatcatatgctatctctgttcatgatctcaaaaacttgctgtgaacttagcttattttctcttctaagcagtgttgagaaaagtgattgagatgtggacatccttattttgttctattgctaaaatgaaacttgaatagagtgctcatatcttaattttaacagaaaactactctttccattttaccaaacatgggatttatcagcaagaaattcttcaacctttcattcatttctataaatgtgattctatctttttttaagttagactaaatcaattttttatttatttttaagattcagggggtacggctgggtgcagcggctcacacctgtaatcccagcactttgggaggccgaggtgggtggatcacaaggtcaggaggtcgagaccacggtgaaaccccgtctctactaaaaaatacaaaaaattagccaggcgccgtggggggcacctgtagtcccacctactcggtaggctgaggcaggagaatggcatgaacccaggaggcggagcttgcagtgagccgagatcacgccactgcactccagcctgggtgacagagcgagactccgtctcaacaacaaaaaaaaagattcagggggtacatgtgcagttttgttacaagggtatatagcatgatgctgaggtctgggcttctattaatttcatctctcaaatagtgaacatagtacccaacaggaattttttcagctcttacccctctccctcttaccttttagagactccagtatctactgttcccatctttatgtccctgtgtaattaatgttcacctcccacttgtaagtgaggacatgtggtatttgattttctgttttagcattaatttgcttaggataatggtctccagctgcattcatgtggatgtgaaggacataattaaattcttttatatgactgcatagtatgccatggtgtatatgtaccacattttctttatttaataaatgtgattatatcttaattcaacttcatcctggctgagaagaagagctcttttttctttttttccaaacctaatctttctacccgttctaacatcacattctctcatttgcttgactttattccatcagttgtagtcttaatttttcacaggttcattctcttctggtcgcttttttttctttacctaaacatttctcaattactgccactttaggcagtatataaataaaaatgttaacaaacaaaaatgcttttggtgactctgtctgctctgaccctcaagtatctctttctttctttctctctcttttattcctttcaacttcaaacttttggaaaattgagtctgtgccaccatattttatctgtcattgcatactcagtactcaactgatcatgatacaatttttgccttcaccataatactgatactgcttttaaaaagatataaaaacaccttctaaatgcaaaacccaatgtgtacttttaaggctaagccaacctgcataattttgccggttgcatcctttatagtcgttggccactgcaccataaatcatgtaaaaatattcaaggactttatagtctagaggggaatatgtgcaaaaatatgactatgatatgtgtactgctgtgattttggtaatcatagagggaatatgatagaaactgttagctgccacccaatatccattctctttttcatagaaacagaactctgattacactggggaaagcaatgtgcaggattaacacacaaacaaacatacaaaatttatattttgtagcataccttgcagtgaaatataacagtatgactaagctctagcgaatagtttgtaaaaaaaaaaaattagtatttgaaagggaccttctggaaggtccctttcaaagtgtaaggaatgtttgcttcagtttctctttattcttactgcctggaatatacaagtcattgttagagccgtataagccatatttttgaccttgataataacgagagccggaagccaagaaaagtgaagctgaaagacaaaagtgcctgattccctggtgactttgtgaagctgtcgtaacagttctagaccgcccattcgcagactcactttatggagatggtaaactcccagtttgttttaactgccacagtcaagtctcagaatctataaaggtacattggaatcactttgtgaaaaaagttgtttctggatcactgtctcagctatttttaaaaaaatggcatccaacatattttcactggatggtcccatatacttctctttcatacctctttcctaagttccagaaccaaagacccaacttctcctaaacctttctccttggatgccccttggtcacttaaattcaacaagcaaaacctgaatgagtttccatactcaccgtaacatggtcttccttctatatacactgtttagttaacgatgccattgttgactaagtaaactatttaacctcaaaacctttaggaaattcttaattctttcttctttttcacccttaacacccaatggataattgcttctaaacatattttcctcagaattgttccttgtatagatacactcctttccattctcatcaatattgccctaagtaagttctcactgtttctctcttagactaattttttttttattatactttaagttctgggttacatgtgcagaacatgcagttttgttacatagatatacacgtgccctggtggtttgctgcacccatcaacccatcacctacattaggtattcctcctaatgtgatccctcccctagccccccaccccccgacaggccccagtgagtgatgttcccctccctgtgtccatgtgttctcattgttcaactcccacttacgagtgagaacatgtggtgttcggttttctgttcttgtgttagtttgctgagaatgatggtttccagcttcatccatgtcccagcaaaggacattaactcatccttttatgtggctgcatagtattccatggtgtatatgtgccacattttcttaatccagtctatcattgatggacatttgggttggttccaagtctttgctattgtgactagtgctgcaataaacatcttagactaatttttaaaagtcattcctaaataggtctcaatcctttagtcccttatctttctaatctatcactgctgtgtctaaaaaatgttaactttgaaatacatagatttactattgccatctcaaactaagaaattgttcattactctcaattgcctacagggtaaaattaaattataaatgatcctttcaaaacattcccagtttcctttacaagcttttgctctacttgcccacccacccttattccacaaaacacacaccaaaagtaccaaggaaagttgatttcagtcaaatcagactgcccaccatgtccataacattccatgtcttccctatctctgttttatttcagttgtcccctctatctcaaatcctttccctctcctcctcctacaagtacacatttgttttctacttattaaccaaggcccaaaacaggtttgcgccacttatgaagctttctcttgcctgctctgcacatcaaataaattatttcctcacttgctatacatgtacatttttacatgccaatgttgtatggtttattacagtgttctggaatcttttttgtatattcaggtacattttatgtttcttaattttttatgcatttcaatatcttaaggaaattatcatataatcatctttacatccctcagatgtactactatgccttgcacagtgaggggctcaattcatagtaatggatttgaatgaactacatatattttgtctctatacaggtaaaacatgcaacttcaagatgagtgcttgcaatatagatgtaagaatgattgtggaataattttaattaaatggtgtattataagaatatctctcaggttattttattttattaattcatcttctttatcctaaaccttcacacctcagacccagaacagaacatactgcccattcactttagaaatgcattccgttcacacctacttatttttaacccactatatttggtaaggcaatgtttcatgaacctaatcttgggatgccagctttatttagtaaactttgaatagtctgtagttttgaataccaaatttctgtaatttttagtgtctctctgctttggaatcatgcttgccatttttcaagagatcttatagaaaaatgatagattagatcttctgaatttaaagaataggaacaagacaagaactcagggtcactgagagattaaagtaagtgtgctttggcacacgtaaatgtaatgtatttagaaagctttctaggatctacctgcaaacagatggcagtaagatatgcaaaagggggcatgctctcctttttcagatttattttttttctaatggggaatagtgagtgagatgatgacagatagttttggatttgcaatgctcttcctcattttatataatgactcagcttttaaattgtaaatcatggattctaaatagctcctgcctaatttatctgtaatatatgtaaagttcatgaatttgaatcattataccaaacaggaatgaatttctatatatagaaaggaaattgtattttggaaggataattaacaccaatatattttaacagctatgcagaggctgaacttctaccacagattttttgaaagcttagcgtcatacaacatgaaactgtatatttgaaaaataaaatttatatgaaatttagaccttacaaagcacgattagtgtgtgaaaatgacaaaagtaaatggaagagtttatcctccaaataaacatacttttttacatatttaaggcagtataatgttaaatgagaaaatgaagactggatgtttaataagccaaaaggaatatacagtagttaaaaatatgtatacatattaatacatatgcatctatacacacatacatgctgtgtgtatctatataaatgtatatatacatacatgtatgcatatgtgtctatacacacgcatgttcctatttgcatggcttgtgactaaacaaaatgcatttttctctgaaaagtgacagggcactagtaatgcactcactgtgtttatgtgggatttttgataaaatttgaatatcaaagacactatttttccccctctaacaaccactggaataaaaagctagaatgcaataccatcttataatttccaaattattcactttcgacttgtgtttttcactttcatcacaaattcagtgttgtctctctgaacagaggaatcatagacctttgaaggtaaactcaactctgacatttactagtatgacattgggaaagctatataagaaaacagaacaaataaataagtgatccatctggcatgttattgtgaagattaacataaaatataggcaagacatagacagtcactatttgtttcctcccctctactttttttttttttttttttttttttttttgagatggagtcttgcattgtcgcccaggctggagtgcagtggcacgatctcggctaactgaaacttccacctcctgggttcaagtaattcttgtgcctcagactactgagtagctgagattacaggcatgcgccaccacacccagctaatttttgtatttttagtagagacagggtttcaccatgttggccaggttggtcttgaactcctgacctcaagtgatctggacaccaaagcgctgggattataggtctgaaacaccgcaactggctcctgcccactacttttgatggtgatcctttgtttgtgtttttgtaattacatcctctttcagaacattaactcattgagggactgtcgaatgccaggatagagaggccctatatgttacagacatataaatatactagtgtaattaaaaaaaattttctcagaaatataaattcccagaatatttatattgtttcatttaaacttaaatttataatcttagtccatgtccttctcaaagtcactgataactgaatccaatatagatatcaaatattattttattaccatttcttctccagagaaatgatctactgctattaaaagatgagtagaaaaggtatacattagttctaccatggtaatttatagcagcttaaaactcagggccaccaaagaatttatgaaaattcctctaaatctattaagttttatcatactccatttctgaaaatatatatggaaatgaaaaatctcaagacatgaacatctatgttataaaaagaaatagggggaaaatgaatatcaattaatagcagcgaagcaatcattttattaatttgcaattccacatgcatttattttagaaaaattataggattcattccggagttccatctgtacacattctgaagtcatgctctaaattaacatgcatttcttatccaattggcttataaaacttgatttactctttaatctctgaagtaaataaaaacaacatttttaacctttctttaagaaatctgctagtttaagatttcttgctagtttaaatacatgtacttttaataaaaactccaatttagtttttctaaactaattttacctaaaagatttggtcatgtaaacaagggtgtagttactctgtttcaagcatcttccacctgtgatcatgtaagtgctaggcagtactcacagctgacatgatgagctctcctcccaggttctggatctcagctttaacttgactgcagattttcagttggtgggagtagaacttaatctgttccaggtaggccaacaagtcctgtttacaagatggatctgggcactaaatatgaatcaaagataaaaatagatacagcagaataaataatagttagatcaaggtgagtaaatacagtattcacatggcaggtaccttataaagcagcaattttattttcatacaggaccaagtagcttctgatatgcttctaccatttacaatagttcattcattttgcaaccttagttacttcagcttagccaaaaggaacgttaaaataattatttttttgagatggagtctcgctctgttgcccaggctggagtgcagtggcaagatcttggctcactgcaacctctgcctcccgggttcaagtgattctcctgtctcagcctcccgggtagctgtgactacaggcatgcgccaccacacctggctaattttttgtatttttagtagagacagggtttcaccgtgttatctaggatggtcttgatctcctgacctcatgatctgcctgccttggcatcccacagtgctgggattacaggcgtgagccaccacacctggccaagaaacgttaaaataatttttagacataaaaaggtatataaaatagctgcctttaatttatgacaaaggttagaagccttcagattatatttttggtaaatctatagaaatatttaaaatgtaattatttctttcacctagaattactattagaaggctcctagaattactattagaatgctgcttgagactcatggtctctacactgtctgtcctgtgctactcaaatgggcataaacaacatggagcaacataatatgttctactactttcagcattcaatgtacttagctgttacagacaaaggaaattatttctaccttagataacagctgtgaatacaactgaagccaagaaacagacaggacacatgttttagaatattaaatttccttatgaaaaccagcctcctacatcattttatcttttcgaaggaacttcctggaggacagctttgagctttatcataccatggtaaatagctttggttaagatttaatctttgtgttctttctcctatgcaattataataaatttataaaaattccttctaatttaattccacttttagtaaatttttataagaacaaggaaatgtggacagtgatttatatgcaaagatcttcattgtagcattatgtataataacaaaatttggaaataacctaaatgtcccaaaataatggaaagactaaataagaatgaatatcaatataatgtagcattactcagtatcaagaaaatagagtttcaaaggatgtggaaaaatgtttttggaagttaaaaaaatcaatatgtaaatattgcaatcaaattctattaaaaattgtgtgtatttaaaacatgctgaatgccagacgcagtggctcatgcctataatcccagcaatttgggaagctgaaacaggaaaatcctttgagcctaggaatttgagaccagcctggggaacatagggagacactatctctacaaaaaataaaaataaattagccaggtgtggtcccagctattcaggaggctgaggtgggaggattgcctgagcccgagaagttaatgctgcagtgagccatgattgcaacactgcactccagcctggtcaacagagtgggaccttgtgtcaaaaaataaataaataaaaataaaaaataaaataataaaacctgctgagacagcctgagctgtccatccttcctaggcatagatcatggtgcatcaggactctctttgctccatacccaggcagatctccaggcactcagagtaccagcttgcctaaatcatcaggctgagcttccctaccctttctgtgcatagattgtggtgtagcaggccctctccactccacgcttgggcagatttccaggtattcaaagtacatgtttgctcagattgacagcctgagccaccccacactttctctgcagggatccaggtatgtagaggagcctctctgcttcatgcctaggcagatcacccagcatctggagtacccagtcccctggattaggagtttaggccaccccaaatctgtgtgtagagaatttgaggacaagaaagcttcccagctccatatctaggcacacctcttggtgtttggtacccactcactggattatgcttcagcaccggtgctcatgcctgcccttagggaattataggcaaacctgccagtctggacctgcccatcttgctcccaacacctctagggctgaggagggagctcagagcattttgcactacaagaataagcccattgcctgaggcaagaaagagcttctgctagtaaacaaggatgaagtatacacccatcggtattggtcatacacaccatctacaggcttgtaggtggaactgaaccgcccaatatgaaacctgctgacagaaaggtgtaggagtacacaagttaagccaaaagaccttacccagcattctctaaagtcacactccctagggaaaaatagatgggaaagggaaagggaaagaaaaaaaaatcaatagtattatagggaaagaaaagaaaaattatatctgcacaaatataattacaaaaatttgaagtatcaatgcttcaagatgagaaagaaccagtgtaagaattctagcaccatgaaaattcaaaatgtagtgataccatcaacataccatactagttctccagctatggtccccagcaaagtggaaacttggaaatgacagataaagaatttgaagtgtggattgcaaggaagctcaataagatccaagatgaggttgaaaattaacacaaagaaactttttaaagcaatccagagaatgaaggaagagataaacatctttaaaatatcaatcagagattctggaattaaaaaactaatttaatttcaaaacacaactggaagcttcaccaataaactggactaagtagaggaaagaatttcagatcttgaagaccagtcttttgaattgacccagtcggaaaaaaataaagaaaaagtaatttttataaaataaacaaagtctttgagagatatgggattatgtaaagtggccaaacctaaaaattagtgacattcctgagactgagaaaaagataacaacctagaaaaaatacttgaagtgataaatcaagaaaatgtttcaaattttgctagagaggtagacatctagatataagaaatccagagaacacttgagagatactatacaaaaaggaacgtcaccaaggcatataatcaccagactatccaaggtcaatactaaagaaaaaatctcaaaggcagctagagaaaaaggtcagaagacacacaaaggaaatcccaaaaggttaaaagcagacttctctacataaaccttatttataagccgagacagattggaggcctattttcagaattcttgaagcaaagaaatttcaacaaaaagttcatatcccaccaggctaagctttatcactgaaagagaaataaaaatattttccagacaaacaagcactaaaaaaattaattaccattaggccagttgtgtcagagacctttaagagaattctaaacatggggaaaatatagagctgatacctgctaccacaaaaacacaagtacagagcccacagatctatagcgcaatcaaaccatagaaaatataaagcaaccagcttacaacttcatgataggatcaaaatcttgcatattaatattatccttgaatgtgaatagcctaaaccccccacttaaaaggcacagagtggcaagttggatagaataacaacatccattcatctgctgttttcaagatacccatctcacacataatggcatcaataagctcaaagtaaagggttgaagaaatatctatcttgcagattaaactacaacaaaaaagaggagcggctattatattagataaaatatatgtactttaaaatatatttaaaatataatatatataacatattaggtaaaatatatgtattttaaaatatattaaaatataatatataatagataaaaaagactttaaaccaacaacagtaataaaggacaaagaagggtattacatgatgataaagggttgaattcaacaaaaagtcttaactatcctaaatatgtatgtacccaacactgaagcatctgaattcataaaacaagtacttctagatctacaaaaaggcttagatagccacacgataatgttgaggaacttcaacaactcactaaaagtgttagacatgtgaaatgttagtcaattaaacctctctttttttttttttaataaattagctagtctcagtatcttcatagcaatgtgaaaatggactaataaatttacttttgggtaaacaatgaaattaaggcagtaaccaaaaaattctttgaaataaataaaaataatagacacaacatataaaaatctctaggatgtagcaaaagtgctgttaagaggaaagtttatagcagtaaactcctacctcaaaaagttagaaagatctcaaattaatgatttcacatcatgcctagaggagcaagaaaaacaagaataaaccaacccaaaagttagcagaggaaaagaaaaaattaaaattagatggaactgaaagaatttgagacctaaaaattcataggaagaatcaatgaagaccaaagttgtgttttttttttttttgaaaaaataaacaggatcggtagactgctagctagattaacaaagaaaaaaagagagaggattcaaataagcacagtcagaagttataaaagtgacattgcaaccaatatcatagaaatacaaaagagcctcagaaactattgggaacacatctgtgcatacaaactagaaaatctagaggaaaagataaatttctgaaacacacaatcctccaagaatgaattagaaagaaactgaaaccctgaacagaccaaaatcgagttcctaaattgaatcagtaataaaacacccaccaccaacaacaacaaaaagagccccagccaaattctaccaaacatacatagaagagctgataccaatcctactgaaactattccaaaaaatggagaaggagagactcctctttagctcattcaacaaaaccagcatcatcctgataggaaaacctggtaaagatacaatgaaaaaaatctctgataccaatatctctgataaacatagatgcaaaaatcctcaacaaaatattggcaaactgaatttagtggcacatcaaaaagttaattcactatgatcaagtagacttaattcttggaatgtaaggttggtttaatatagacaaatcaataaatatgactcaccatataaacagaattaataacaaaaatcatatgattatttcaacagatgtgggaaaagcttttgataaaatacaacatcccttcatgataaaaaccttcaagaaactatgcatcaaaggaacatatctgaaaataataagagccatctaagagaaaccacagccaacattatacttgaatggacaaaagctgaaaccaatctctacttgaatgggctaaagctgaaaccaatctccttgaaaactgttacaaggatgcccactctcacctctcttattcaacatagtactgaaagtcccagccacagcaatcaggcaaaataaataagtaaaaggtatccatctagacaaataaaaagtcaacctatatttctttgctgttgatatgattttatacccagaaaacataaaatactttactaaaaggctcctggaactgagacacgacttcagtaattttttaggatacaaaatcattgtataaaaatcaatagcatttctatacaccaataacattcaagttgagaaccaaatcaagaactcaactccatttacaatagctgcaaataaataaataaataaaacacctaggcatgcatctaaccaaggaagtgaaagatctctacaaggagaactatacaacactgctgaaagaaatcatagatgacacaaacaaatggaaaaatcatttcaatttcatcaactggaagaatgaatatcgttaaaatggccatgctgctcaaagcaatctacagattcaatgctattcctatcaagcaaccaacgtcatttttcacagaactagaaaaagaactattctaaaattcatatgaaaccaagaaatatcttgaatagacaagcaatcctaagggggaaaaaaaaaaaaaaaaaagaagccagaggcatcatattacttgacttcaaactacactataaggctacagtaacacacacagcatgatactggcacaaaaacagatacacaggctgatgggacagaatagagaacacagaaataaagctgcacaactaaaaccatctgatctttgacaaagttgacaaaaataagcagtgactccctattcagtatctggtgctgtgacagctggctagccaaaggcagaagaattaaactggacccctatttttcatcatctagaaaaattaactcaacatgaattaaagatttaaatataagacctccacaataagaatccttgaagaaaaacctaggcaacatcattctggacatcagtcttgggaaagacattataactaaattctcaaaagcaattgcaacagaaacaaaaattgacaagtggaatctctaattaaagagcttctgcatagcaacaaactatcaacagagtacatagacaacccacacaatggaagaaaatatttgcaaactatgaatctaacatagttttactatccaggatctataaggaacttaaacaactgagcaagcaaaaagcaatcccattaaaaatgggtaaatggtacgagttaggtcattcttgaattgctacaaaaaaatacttcagactgggtaatttataaagaaaagaagtttaattggctcgtggttctgcaggatatacaagcattgcgttggcatccacttggctttggggtgggggctcagggaatatttactcacagtaggagatgaagtgggaacaggtgcacgacgtggggagaacaggagcaagagggaagtgggaggtgccacacacttttaaatgaccagatcttctgataatgcactatcctgaggacagctcatcatgaggaatctgcccctattacccaaacacctcccaccaggccccacctccaacattggggattgcatttcaacatgagatttgggaaggacaaatgccaaaaccacatcaaaacatgaatggacacttctcaaaagaagacatacaagtggccaaccaatgtgaaaaaatgctcaacatcatgaataatcatagaaatgcaaatcaaaccaaaataagatactatctcacaccagtcagaatggctattattaaaaagtcaaatacaacagatgctggtgaggctgtggagaaaagggaacactttataaactattggtggggatgtaaattagttcagccactgtagaaggcagtttggagatttctcaaagaacttaaaacataactaacatttgactcactcatcccgttactatgtacatattcaaaagaaaataaattgttctacccaaaaagacacttgcattcatatgttcattgcagcactattcacaaagcaaggacacggaatcaacctaggtatccaccaatggtggattgaataaataaaatggggtacatatacaccatggaataacagccataaaaaggaatgaatgaaattatgtctcttgcagcaatgtggatgcagctggaggccattatcccaagtgaattaatgcaggaacaaaaactcaaataccatatgttcttacatacaagtaggaggtaaagaatgggtaatgatggacataaagatggccacaatagaaactgaggattactagacaggggagggaggaagggagtaaaggcttgagaaactaattattgggtactatgctcactacctgggtgattgcatcaattgtacttcaaacctcagtatcatgcaatatacccactgaatctaaataaaagttgaaattattttttagatgcattaaagataaatacattctggactctgggttaaaaaaaattaaaagatgctgggaaagaaatatatgacaatcatcaataaatgtgatataatcaatacttttattttattcaaattttgtatatcttaaatatatatttcttctataactataaaatgttattttttaaagcttttattctaatgacctaaactgcaaattaaaaagtaggatgaacaaccagaaaacctttcatgcatttctgcttttattcagtaattaataacttaagctggagtgtttttggaaaatttgtgaggtacttatcgtcttatattttttaaataggctgtgtagctccagagtgtgtgcacaagatgagaacacattaccctgagtcaaagtcgataataatcaacaaaggtagcaaagaattcaactcttctgcagaaatactatcaatctgcaagataggcatggacatatgcatgaatagatacaggatagccagacagagacacaatcagacaagaatatagaaattaagggtgtttctcaagttttcagtaagcaaatgagggttatccctcaaatctcctcaaaaggattatattgtagctaattaagaagaagattggaaaggagaaagatatggagaaagaaaagaaaaagaaagagggaaaggaagaagaggagaaggcagagacagaggaggaagaacaatagttaattttcatttagctcttactatgtgccacatgctatggaaactaatttaggcatatcttctcactcaatcattaaaactgtaagacgcaaatattttccccaatttacagatgtgaaattacctaaaacgatgaaaaacaagtcatctctttgttttctcttgacaggcagctgatctttattaggtacttcgtctgtgccaggtactatgccaaggcctttacatgcataactttagtactcaaagcaccattttaattagatctattattttcattttgtagatttgcaaagtaagtttcagagagagtaaatgatttgaatttagttttctctgtttcattcacatgcatacacaataatctcttctatagggcattctttcaaatcattttttgttattattgctttcactgagtaactttcttatctattcttcattcttaagtatggacacaatgataatacctgacatgtaaagtgttttatctgtcatctataattctagatgttttgtctctactaattgttttaataatcacacaacacccacagtttcatgaggtaagtggaatcattatcctcatttagtgaaggagaatattgacaaacagagaggttaactcacttgccaataaatggtattagtggtagagctcgtgttcaaacataatctggctacacctccttacctccatgttctaggaacagtatcagtcttcttgccaattttatcttttttgtaaatattaaattgtcattctgatttgtaagttggtttcttattgataatcttatttgtcaattataaactcgattaatgtggatttgttccttgaagaccagcaccactatacaactctgataaaatcaaactgtcaaactagtaatcagattcttgaccaataaccaattgcaatcactcaagtttaagcaaaacatgctgtctctatcaagagactcttccaaggccacagtagaaaagcctataattccattaaggaaagaatgagtcaaatgagtagaaagtgtgaaaatgatcttttgaaattcaaagttgcttgacctaaatttacctttcattttcagaactgatgggaatatcttggttataacagaagcagtcagttttataaccaaagtaaaacaaaatactatgtggtaaattcttatacttataaaagttattaaagccttctttcccattgacatgcagaaagcctttctgagtcagttttgctcacttagaagcagaatcaggagaatgcctcattcctactttaagaatattctactatttttcaaatctcctttgggccacttttatgtattcaggtcttttcccattttttaatcaggttacttggattttttttctattgagttctgcatgtttcttatacactctagatattaattccttatcagatctatggtttgcaaatattttctttcaaaccataggttgtcttttaattttgttgattattacattgtatatcttaagtccttaaatatgtacaatttttacaaaaaaaattaaatttaaaaacatcgaacaatgcttttcccaccttttaaatttttacgtgaaagtgacagaaaaacttcggtctctaggttggtagaacattcttgccctttactgttgtttctcaagtaacatttgctttaaaataacttttaaaagaatactattagggacttttccagaacatctacttagttccttaatgcatgatttttttttaaatctaagttttataatcacagggactcacaacatgtaagcagatggcatttcagcctatgtggttttctcactttaagccagttttcacgtttctaccaagacgcttggagccaatatggaatacatcatttagtaatgaggaaaaatgtaaaaaaaattcattacgttttagtttaaatttcaggggtgaattagcaaaacgaacacttttcaagacttttattccataatcttagtatttttttgctcatattggagcctaaactttaagaaatttaaaatgacttttgcagccaggtgcggtggctcacgcctataatcccagcattttgggaggctgaggcaggcagatgacctgaggtcaggagttcgagaccagcctggtcaacatggtgaaacctcatctctactcaaaatatgaaatattagccgggcatggtgactcgtacctatagtcccagctacttgggtggctgagacacgagaatcgcttgaacctgggaggcggaggtgcagtgagctgacatcgtgccactacactccagcctgggtgacagagagactccgtctcaaaaattaaaaaaataataaataaataaataaataaataaaacgaattttgcaattacagacaatagcctacattttgctaagctggaaaagtttgttaatgaaaagtactaggtgtcactgtgaatttcaaaaataggaatttaaagcgatcagtggtagcaaaagcacttggtgttcatgacttttcccatcccacagggctcatttcttcacctgtaatgccttgtttcatcttgctcaggatcacagatcatcaatgatctcatcttttcctctacttttaatgcctttttttttctgattcctgactctatcaagtccctcaaagcaaaaccctgacttctataatcccatgtctccttttttgtttatgaatatgcctactaaaatgtttcaatgcagattcctcctttccttatcattctaagaactgttttcaactcctccagtccgcagaattttatcttactgagatcactaatggacttataattgccgcattcattatatatgttgcagttcctcccttatatcacctctctggagcttttagatctttattgattttcataaatattaattctcatgaatgtttcctcttagattttctcctagttttacaccagccttcccagactgtattgtaagcatttttttttttccttgcacgtgttgttgttctcagcttttgttcctgagcaatttttttttttttaactttcattctcttcttggacaacagtagacagtgctctggcttcatctgtcacttacacaacacaaactacaaaattctaacatccagctctgtcatcaggcgatccatgtaactactgtgttagtccatgccatttcagcatctcatcaacatttcacacttaacacatttatctctcagctatttcactatcttgcctactcacctattcaactattttttctctttgtattaactatctcaatgaagaatgccttgttcctcttttccatctcttaaatctggtcagccattagtttgtgcttattctacacctagaaacctcaatatattttaagtatttttttctttgctatgcctatgacagctgctgtttagcaaattcaggtttctgaaacacagaacagagaaggtacctatagaagtatgattaaaaatacactggaactctgttataatgtcagtggtagaggataacattgtctcatatggtatgttcaagactggacatgttgatttatgagagttataattgggaaagtatggtgcatggcatatctcaatgaataaaggttgtttttaccagaagttatatatgctgttaaaatcctgtcatattttgtccatatttaggctgaaattgtcttgagtttaagaattgtttcaaattcctttttattttcaacttggtttgcacatacagctattgagaaagtgacatgtactttgaacacaatacaaattaaagacaagatgttttccttattcaacaaagctcctttactttagtagatgtaaagttatgactcaagctacttttcagctttatgttacttccatgagagattctcagaagaaatgagtgtcctatgtaatagaccataactcaaaagtgtcaccctctccctcatgcctgaaatttgtcattcaaagaattacttcgactgaaacaaactcatacaagtgcattatcctgtacataaaataaggatgtggaaaagatggtggaaaggtaactcagacaaattctggttatttggaatttttgattaaagatagccagccaactacaagaagaaactttgctcatccttcctcttctccacttatacaagatagctccttccacctagaccctaaaacactttattttttggttacatagttttgtaactatacatgaagtgaacctgaatagataatcaccctaggagcatttaaaacactgtttcagtgaaaaaatgtcagacattacataaaggggaaaagagtaaagcagcatctcttagaacaggagattcactattacttgaaagacgcaaatagatcaaatatttcagtatacatttagtcctatttaaatcttgagaactttctgtgcatttatttttataaagtaggagttcattaatctggagaactaatctaggcatcaacatttctgccagagaagaaaataaataacaaagatctgagcagaataaaatgaaattgaaaccaaccaacacacaaaatacaaaaaataaatgaaatataaagctggttctttgaaaaaataaataaaatcgatagatcattagtgagattaacgaagaaaagaagacagaaggtccagataaattaaattagaacgaaatgggagatattactactgataccacagaaatacaaaagattattcaaggctactatgaacacctttacatacataaactagaaaacctagaggagatgaataaattcctggaaatatataaccctcttagattaaaccaggaagacatagaaactctgaacaggtcaataatatgcagcgagattgaaacggtaatttaaaaattgccaacaacaacaacaaaaaagtccaggaccagacaaattcacagctgaattctatcagatattcaaagaggaattgataccaatccgattgacattattccacaggatagagaaagaggaaatcctccttaaatcattttatgaagccagtataactctagtaacaaaaccagggaaggacataacaaaaaaaaaaaagaaaagaaaactatagacaaatatccctaatgaaaatagatgcaaaaatccccaacaaaattctagctaactaaattcaacagcatatgtaaaaaaaaataaactgccataatcacgtggggttcataccagggatgaagggattattcaacatctgcaagtcaataaatgtgacacaccacataaaaaaattttaaaaatattacatgatcatctcaatagacacagaaaaagcatttgacaaaatccagcatccctttatgattaaagccctcagcaaaatcagcatagaaatgacataccttaaggtaataaaagccatctatgacaaacccacagccaatattatactgaacggggaaaagttgaaagcatttcacctgataactgggacaagacaaggatgaccactttcaccgtttgtattcaacaggactctggaagtcctagccattgcaatcagacaagagaaagaaatcaagggcatccaaatcggtaaagaggaagtcaaactgttgctgtttgctgatgatatgatcatatatccagaaaaccctaaagactcatccaagaatctcctagaactggtaaattaattcagcaaagtttcaggataaaacattaatgcattcaaatcagtggctctgctatataccaacagtgaccaagctgagaattaaatcaagaactcaaccgtttttttacaaaatctgcaaaaagaaaaataaaatacttaggaatatacctaaccaaggaggtgaaagacttctacaaggaaaaccacaaaacactgctgaaagaaataacaggcgacagaaacaaatggaaacactcccatgttcatggatgagtagaatcaatattgtaaaaatgaccagacttccaaaagcattccacgaattcaatgcaattcccatcaaaatgccaccatcattgtttacagagttagaaaaaacaatcctaagattcatatagaaccaaaaaagagcccgtatagccaaatcaatactaagcaaaaagaagaaatctggaggcatcacattacttgacttcaaactatattataaggccatagtcaccaaaacagcatagtactggtataaaaataggcacacagaccaatggaacagaatagagaacccagaaataaagccaaatgcttacagtgaaatgatctttgcaaagtaaacaaaaacattaagtgaagaaaggacaccctatatgacaaatggtgctgggataattggctagccagatgtagaagaatgaaactgggttctcatctctcaccctataaaaaaatcaactcaaggtgaatgaaagaattaaatctaagacctaaaaccataaaaattctagaagataatatctgaaaaacccttctagacactggtttcggcaaagactctgtgaccaagaacccaacagcaaatgcaacaaaaacaaggataaatagatggtacttaattaaaatggaaagcttctgcacagaaaaagaaataatcagcagagttaatagaaaacccaccgaatgggagaaagatcatcacaatctacacatctgacaaaagactcatattcagaatctccaaataactcaaacaaatcagcaagaaaaaaaatcccatcaaaaagtgggctaaggacatgaatagacgattctcaaaaaaaaaaagatatacaaatggccaacaagcatatgaaaaaaatgttcaactcactaattatcggggaaatgcaaatcaaaaccacaacgagataccaccttactcttgtaagaatggccatgatcagaaaaaacaaaacaacaaaaaaaggtgttggcatggatacagtgaaaagggaacacctttacactgttattgggaatgtaaactagtacaaccagtatggaaaatagtgtggagattccttaaagaactgaaagtagaactatcatctgatctagtaaccccactactagatatctacccagaggaaaaaaaggcattatacgaaaaagatacttgcacacacgtttatagcagcacaatttgcaattgcataaatatggaatcagcccaaatgcccatcaatcaatgaatgataaagaaaatgttatatatacatatatatatataaatgtggtatatatgtgtgtgtgtatgtatatatatatgtgtgtgtgtgtgtgtatatatatatattcatgtaaccaaacaccatctgctccccaaaaacctcttgaaaaaaaaaattaaaaaatttctgctggaaataaatttcagataggtaatacctttaaaatacgcatattgtcacaaggtgtatctaggaattatatccttaggagttgtgtaatcatgatataatgaaggctccagaagcttctcagtagtatagtttcattgaaataatttttttgcctcttataatatcaacatgaaacaattcaaatgaggccagcctccaagaatattttgtaaaatattaatacaaattatacttgtaggttgttttgttcataatggagtgcattttgtgtgatttggtttatatttctttactttggtttttaaacatcatcttttcttgaattagaattagctgccaatgtatttaacactaaaagttcgttttaattttgttcagttacaattaggtgggaatgtccagttattagccttaatatctttgctttggcaaaattacaaggaggaagtaattaggctgcttaaagatcaccgagggatcagaaagtctaacactgttctctcctggtgcaaaacacttttagcagatgctaattttattttggctcctattgtctccttcctatctaggttatactgcttctataactatttgaaatctttttgtgcattatccttaccttatgagatgttactttatctaatttagaatatctgctaatatgattaattacaatgtagagtacagaaatagaaaaaaatatgtactgaaagcctgaaatcttggattcatattttacttctccaacttattctgtttaattcacaagcaaaatttttaagaattgttataggtaagaatagctataacaatcttgttttatacaaggatactgtctaaaggagacaaaatttgtgctaaaattctacaagacttaaatatatctttgatggcatacttaagccttttttgagaccgccattttgagacaattctgaagtctaaaaaatgttgaatgactgggaaaattaaacagaaggttttagttcttctctttctaactagctaatgccaatgccagagtagtgaattgtgtgtggcatacacacaataaatattctctcaaggaagcaatgaaggaaggaaaagtgaaaaataaaaatgaaaaggccaagcaagcagaatgagaagcatcaactaatctaattgtttcattctttctacatgtgaactttaactctgaaactttacagaatgtaactaaattggtctaataatatatgtaatagatgatatatatataaacatgcatttaaataatttaaatatatatataatttcaaatctaatgttagttggaatggatattactgtttgaccttctgacacaccagcaaaaactaaagctagaatgtattatttttgaaatattaaattgatcaaaagagaaagcaaccaatgttccagcagatttttttcataatatacatagacactgaaaatcacattgcttacattactcaatttattccataatcaatttcagatattattttctgcctaaaatgtcttaatctatccaataataatgtcagaagcacattcaaagacaacctccctagatggtcactgtaataactgagtcagtttcttcattctcagttttgattacttagaactatatttcttcagaacaaaagtaattcatctgaaactattttatgtatgaaatggaaaaggccaaaaagagtcatctataattctttattagtcagtgactacttctctaagcttctcttaaaatgtcaaagctatacagaagtaagatgatacttttgctttctcccataccatttgaataatgctaaaaacaatgacataatttgataaagccatgttatagaagtacctacttcaaggcaacctgatccaattaaagaagattatcaatataagaaaaaaaaccttcaatgtgacacaattatgtcaactttgaaaactgggtgtttcaaaataaacagaaaaaaatgggaggaagcattcagtatttaaaaagttattaatacatgtaaatatgtgtcatgtactatgtttcacttatttcactaagatttagtgtctctcataaaagtgaatgcaataagattctaaaataaagaaaactgtgggcatatataggcttcagtcacataatcaaactcagaaattttgacttatttaggatatagtttgttttagctgtaaatactaaatactaaaaaaaaggattaataaaattttataataattaaagtaacacggaaaagacatatgttctttattattaggaatgttattaaacagtttattataattagtctttatttgtttcttattccttatatccacaaatacaatatttaataggagagagttcttcattttccaagagagtataaacatagtgaacaatagtaatcattataaaaagaagcccaaaaacctttccctaatactatttaagcaagaaataatatgaaacagttgcaaaaatcctcatttttttccaaaaggaaataaatatgtactatgaagttgaacataatataaaagccatgaaataatattatacctcagtctgaaatattaattgaatatctcaacacattaatgaaagcaacagatttttcagttaaagtgtaaagtatttctaaggatgcagcagctgcttagaaatactgaaataaacatgagaaatctaaaaaaaggaaactaaaatgtttatgaacaccagtctctatattaattatgtattttatgcattttatatctttagtattatctttagtattctactaaatactacttttctttgaattttaaatattatattagaatatattgttgacacagaaaacctaacattataacattttaaaatgtattaatttttgaagagcaaaaataaggaaacaattgacagactttcctgtaagatctgaaacaagacaaggctgcctactgtcaccatttttattcaacatagaactgaatggcctagccagaaccattagctaagagaaagaaatatagagtatccaaattggaaaggaggaagtctaattgtcctagtttatagataacatggtcttatattaagaaaaacctttctttgtgttacaaacaatccagttataacttttagttatttttaaacatataataaattacttttggctatagttgccctgttttgctatcaaatactagatcttatttattctatctaactatatttctgtactcattaaatatattcttatcccatttgtctttactgattgattcatgaaaatgtcaaaagtgtaataaaacattgctattactaattaaactactaagtgaaaattaaaatttctttttgtttattttgtctctggatagttgactctgagtgtgaatcctgtaccttatttaccctgttgtgattattacacattgtatgcctgtatcaaaatatttcctgtaccccatacatatatagactaccatgtgctcacaaaaatgaaaaataaaaatatatatacaaaaaaaagaaaaacctaaaggctctaccaaaaaaaaaaaactcttagatttgataaaaaaattcaataaagttgaaggatatcaaatcaacctgcaaaaatcaacagcatttttacacacaaatagtgaacaatctaaaaaagaaatcaggcaagcaatcctatttctcatagctacaaaaaacaaaacacctagaaatcaatataactaaagaggtgaaaaatccctactattaaactataaaatattgataaaagaaattgaagaggagacaaaaaaagatatcctctgttcatgtatggaaagaattaatattgttaaaatgtccatactgcccagagcaatatacagattcagtgtaacccatagaaaaataccaatgacattttttacatagatagaaaaaaaaaatcctaaaatttacatagaaccacaaaagaccctgaatagccaaagcaatcctgagaaaaacagcaaagctggaaacatcacacgacctggcttcaaaatatgttacaaagatatagtaactaaaactgcatggtactggcattaaaaaaaaaaaccacatagaccactggaacagaatggagaacccaaaaataaattcacatatttatagccaactgattttgaacaagtgtcaagaacacacattgagaaaaggatagtcaataaacagtagtgggaaaattggatatctattgcagaaaaatgaaactaggcccctacctttcaccatatggaaaaatccaatcaaaataaaggcctagcataaaatccaaaactataaaactagtagaagaaaacacggggcttcaggacattgattttggcaaagatttgatggctaacacctcaaaagcacaggcaacaaaagcaaaaataaacacatgggattatatcaaactaaaaaggttttgcacagcaaagaaaacaattaacagagtgacaagacaacctacagaatgatagaagatattttcatactatttgacaagggattaaaatacagaatacataagacatatcaacagaagaataaaacaaatttaaaaatgggcaaatgatctgaatagtcatctctcaaaagaagacatacaaatggccaacaggtatatgaaaaaatgttccacatcattaattgacaggaaaatgcaaatcaaaagcacaataagatatcatcttaccccaattaaaattgctataattgaaagaacaaaaaataaattctgtcaagaatgtagagaaaaggggactcataccctgttggtaggaatgtaaattagtacagccattatggaaaataggagttttctttaaaaactactactaataaactaataatagaactaccatatgatccagcaatccattactgggtatttatttaaagaaaaggaagtcagtatgtcaaagagatagctgcactcctatgcttactgcagcactgttcacaacctgtcaatcagttagttagaatcaatctaactgtccaccaatgaatggatggataaacaaaatgtggtatacaagcacaatggaatattcaggcacaaagaaaaatgaaatcctgtcatttgtggcaacatgaccaagactggaggacattatgttaagtgaaataagtcaggtacagaaagacaagtaccacatattctcatatgtgagagttttaaaagttgatgacacagaattaatgaatagaataatggttatcaggggcagggaagagtagcggagaggggaagataaaaataagttggttaaaggtacaaaaatacagttatataggaggaataaattgtagtcttctgtaacataggctgactatagttaataatttattgtgtatttaaaaatagctatatgagaagattttgaatgtgttcaaaacaaagaaatgatagatgtttgaggaatagtatatgctcattacctaatttgatcaatacacagtgtatacatgtatagaaatatatgtactctacaaaggcaattattatatgtcaattaaaaataaaacataatgaaaataaatgttaaaaatacacaaccaaaaaagaaagaaagaaatataatgtatcaacaacaacaaaactcggttttgtaattacaattgattaaaattaattgagtatatttgatgctgaagagctgatactagaaataatttgagtatgttttaagctaaaaatatctgccctaagaaataattaagcttccttataatcgtccattacctagtgtattaatagagctattagaaattcaattataatttagaaaaaatggttgaagagagtaaaaatttaactttgcctaaatcaatgttctaatggcaaagagcaattagcatgaacttttatgatgtccacttgtaagtaactcacctgattagcaatctgccgagcaaggacatccatccttgatcctgattctgatatcattttcgctgcatagatcacatcagttgtatgctttagtggtcctttgcccctggaaaaaaatttatatatgttagctgtggtgttcatgagaaaatatatgttagctacgatggttcatgaaaaaatgtattaatctatgcgtccatccatccgcatatgtaaaatattcgcatcccaaagaacggctattgtttttgtgattgtttgttttgagactgagtctcactctgtcgccaagcttgagtgcagtggtgcagtctcggctcactgcaacctccgcttctcgggttcaagcgattctccagtcttagccccccgaagagctgggactgcaggcgcgcgccaccatgcccggctaatttttgtatttttagtagagatggggtttcaccatgttggccaggatggtcacgatttattgacctcgtgatccacccgcctcggcctcccaaagtgctgggattacaggcgtgagccgccgtgccctgccagctgttggttttaatattttgattttgaaaagagcacaatcagactccagtattattattattattttttaatgccagcctattgtgttaagtcaagaaatactgcagagaagatgaagacctttttgatcttcattcccaggtgtttattatagtaaaactcagcctagagatacccttcatagacctagatacctcaaggcaaaggtattttcctgattttagagagaatcataatattttggatattatatgtatctaacgatttattttttatcagcaggcctacttttagtatttcacattttttctgttgctatattttagttactttaaaaaaatttattgatggtaaaattcattttttatggggtacatgtattattttgctatttgtacatacatagaatgtgtaatgattaagtaatgttatttagggtatctgtcacgtcagtcaagtattatttctatttgttgaaaatatttgaagtcttctcttctagctattttgaaatattcaatacattgtttttaactatagtcatcctactcaactattgaatatttgaattgttctttctaactgtatgtttgctcccattaaccaacctctcttatccccccaatccccaacaaacaccatgccaagcctcagataactatgattctactttccacctccatgagagcaaagtttttagctctcacatatggaggagaaagtgatatttgtctaacttatttcacttagcataacatcctccaggctcatccaagttgctgtaaatgttaggatttaattcttttttaatggctgtgtttcattttgtgtgtagtgtgtgtgtgtgtgtgtgtatacacacacacacaccacattttatttatccatttatccaacacttaggttgatttcacatctttgctattgtgaataatactacaataaaaataggggtgcaggtatccttttgatatgctgatttccttttctttggataaatacttaggagtgagattgctagatcatacgttagtactacttttaattttttgagaaatatccatattgttttccataatggctgtactagtttacattctcatcaacagtgtataagagttcccttttcaacatacctttgccagcatctgtttttttttttttccttttaataatagtcattctaactggggtaaaatgatatattattgtagttttggtttgagttttcaagctaattagtgatgttgagcatgttttcatatacctattggtcatttgtcttcttttgagaaatgtctgttcatgtcctttgcccgctttttgatgggattattattattttctcctgttgagttgttttagttccatgtattctctgaactttaggcccttattagagaaacagtttgcaaatatttttaaatattaaatatttaaataatttaaatattaaatattttctactatttaacaggctctttactctgttgattatttcttttgatgtgcagaagctttttagtttaatatagtcccatttgcctatttttatcttgcctgtgcttttgaagtcttagccataaaatcttcgtctagaccaatgacctgaagcatttccccaatgttttcttcaagcagttttataattttggatcttacatttaggttttagctgatcttgatttgatttttgtatatggtgagagataggtggctagtttcattcttctgagtatgattatcctgttttcccagcaccatttattgaagagccatcctttccccagtgcctgttcttcccacctttgtcgaaaaccagttggttataaatgtgtggatttatttctgggttctttattggttcatgtgtctatttttacgctcatacaatgcttttttggttactacagccttataatatgtcttgaagccaggtagtatgatgtgttgtgtcctttttcctgttcttttcctcagtattgctttggctatttggggacttttgtggttctattaatatgtaacatttaggattgtttcttctgtttctgtgaagaatgtcactgatattttgatataattccactgaaaatgtagatttcttttggtagtatggatattttgacaatattaattcttctgatctatgggcatgaaatatattttttattttttgtgtcttgttcaatttcttccaccagtgttttatagttttgtttgtagaggttggttcttgtttggttaaaattattcctaggctttttttttgtagctattttaaatgggattgcctcttgatttcttttgcacatttttcagactggtgtataaaatgctattgatttttgtatgttgatttagtactctgcaactttccttaatttttcaaatctaagagtgttttggtggagtctttaggtttttcttaatataagataatttcattgcaaagaaggacaatttggcctcccattttccaatttggatgacttttctttctttttcctgattgctctggctgataaccttcagtactagaatcctgaaggggagttataaaagtgggcatcctcatcttgttccggatcttgatagaaaggctttcagctttgttccaatcagtatgatgttagctgtgagtttgtaatatgtggcctttattatgttggggtatattccttctaaatctactttcttgagagttttcatcatgaaaagatcttgaattttatcagatgcttttactgagcctattgagatgatcacattttttaatctttcattcttttgatatgatgtatcacgtttattgatttgtgtatgttgaatcatccttgcatcccaaggataaatcccacttgattaacatgtgttatctttttggtgtgctgtttgattaattttgctagtattttgttgagggtttttgtgtctcattcatcatggatattgacctgtagttttctttctttcttgtgttcttgtctggttttggtatgagggtaatactgcctcataaaataaaatagggagaattccctcctcttcagttttgtggaatgccttgaggaaaatcaatgttagttattctttgtaagtttggtagaattcagcaataaaggaaccaattctgggcttctctttttcgggagtctttttgttactgattcaatctactgtgcattattgttctgttcagattttctattttttccacacttgatcttcgtaggttttgtgattccaggaatttattcatttcccctatgtcttccagtttgtaaatgttaactgttaataatagtgtctgatgaccttttgtatttctgtgatgtcaattgtaatgcctccttttacatttataattttgtttatttgggtattctctcttttcttggttagtcttgctagcaggttatttaattttttatcttttcacaaaaccaatttgttgctttgttgatctttcgtatttttttagtctctgtatcatttagttctgttcttatctttattacttattttcttctactaattctggatttagcttgttcttgcttttctaattccttgatgtgcatcattagattgtttatttgaaaactttctagttttttatagtaggaatttattgctatgaacttccctcttagcactgcttttgctctatcctataggttttggtatattgtgtttttattttctttctttttcagaaacttgtttgatttcctacttaatttcttcattgacttgatgcttgtctaggagattgttgtttaatttctacgtatttgtacagcttccaaaattcctctttttactcatttctagttttatttgattgtggcataggaggacacttggtatgctattaacttttaaaaaatttgttaagatttgttttgttgcctgacatatggtcaatcctacaggatgtctatgtggttatgggaaaaatgtatattctacaactgttcaataaaatgttctgtagattggcctcttaggccaatgtggtctaaagtgcagtttaaatacaatgtttctttttaaattttctgtctagatgatctttctaatgctaagagttgagtgttgaagtctccaactattattgcattggagtacatctctcccttttgatgtaataatatttgcttcatatatctggatgatttcatattgggtacatatgtatttataatttttatattctcttgctggatttgtccttttatctttaatataatgaccttcattgtctcttttttactgtttttgacttaaaaatgtttttatcagatataagtagagatacttatgctcacttttggtttctgtttgcaccaaatatctttttcaatcctttactttcattctatatgtctttacaagtgaagtgagtttcttagaggcagcagatagttgggtcatgtggtccttgcttttggttttggtttttgttttcaaatccattcagccagtctttctctctatatatattttttagatggagtcttgctctgttgcctgggctgcagtacagtggcacaatctcagctcactgcaacctccacctcctgggttcagcctattctcctgcctcagcctcctgagtagctgggattacaggcatgtgccaccatgcctggttcattttcgtatttttagcagagacagggtttcaccatgttggccagactggtcttgaactcctgacctcgcgatctgcccacctcagcctcccaaagtgctgagattaaaggtctgagtcaccaagctatatcttttaagagcaaaatttaatccatttaccttcaaagttattatttatgtgtgaggatttatttctgtcattttgtaaattgttttctggatgttttgtgtatacttcgttcctttctttcttattgtttatcattatggtttggtgtttttctgtagttgtaccatttgagtagtttctacatttgtatgtttaccagtaagttttatactttcctgtgttttcatgataatagatatcatctttgcactttcagatataagaaccctttaaaggagtcacgaaaacaaaggaaagtaataaatttcctcagtttttgcttatctgggaaagagtttatttcttttttatagctgaaggatcaattttgctgggtatagtgttctggattgacattttttttttttggtttttctcctcccagctctctgaatgtatcatctcattctctcctgatctgtaatttttctgctgaaaaatctgctgttagttttaataaggtttcctttatatttgacttaacatcattctcttcctgtctttagaaatcctttctttgtatttgactttcaacaatttgactataacttgcctttaacaagaactttttgagttgaatctatttggggctctttaagctttctgaatctggatgttcatatctctcctaagacttttaagtttccaggcatcattttactaaatagattttctatggctttggaattctcttcaacttctggactatccagaatttgaaactttggttactttatggagccccatttgttacacaggatttgtacaatctttttttattatttattctattttgcctgaccaagttatttaaaaaatcctttattcctgctataaaattatttcttgtgcataataaaatctgttgttgaagctctcacatgaattttgtatttcattcattgaattcttagttccagaatttttgtttcttttttatgatgcttatcacattggtaaatttctcattatgttcttaattgtcttttctgatttttttttgtattctttatctgtgttctattgtatctcactgagcttctttaatattattactctgaactcttttttcatcatttcattaatttcttttttattgtaatatcttgctggacaattattatgtttctttagatgtggcatatttccttgacatttaatgtttcttttttcctttcattgatatctttgcatatggtgtaagtcacttctttatttttttggattgtcttttgtaggggaaggtcctaaagatctatctgtagtgttggtttcacaggacactttagtttgattctgggtgcatgcagtaatgtagcctccatgtgatttatttgtctataaatagcctcagtggtatctgtgatttcctctgtcaattaggctgtggctgttagtgcaggctgtggtaaggctttgtaggggatgagaactgcaggtgggttggtcctcaggcctcggtggtgggccaagcatgcctgtctttgggcccacaggcagcgtgcatgggcacgaatgtaattaggtctaagaaggctaattcttggacctccaggtggctttcttgggttctggcagtggcagtattgggccatgtggttcattaagttcctgggtagcatgcatggcatgagcaatggccatatctgtgacaggacaaccccatgggctcacagataaaacatgtttctgttagtggtggctgtgatgagctgggtgggcctgcgcttaagcacctgaaatacttgcactgataccagtggtagtgggtggggcaagatgatccccaggtccctagacaatgtgcccaggcatgggtgatgttgccaggccagacaagcctgtcattaggcctcctccattgtgcacacaggtacaggctgtgatcggcaggccagggtgaaacctaggctcccctggtaaagtgctgggtggtggcagcaatgacagcaatgagcagggagaatccatcctcaaggcacgtgcaagtacactgtgggcctgtttctgggaattggggttattttcagtgacagcagccacagccagttggctctcaggctcttggaagtatacgcttcagtgtccagaattggtggaagcagcagccatggggagagccagtcttcagagcatgtgcaagttgaggattgctgaggaggcagagttgctatcagtgggagcagccccaggcaggcaagtttcaagttctggggagcacatgctttggctccctttgtcccaggggcaccttgctttgcctgctacaccacccataacctggggtgcaagttgctgtgtgttctatagtgctgaggaccctgctgttctgctgagtctaatcactctcatgccactgcagtcctgtaagggatgtagggagatgtcagtggggttctagggatgtaggaatgcaggggctgctgagccccagggagaaatgcagtctggtttgggccacattctcataatgacactgtgctacaactgcttaggactcagggtgtttgtgggacccagcataagctacctatctggagcgacgccattacacactatccaggctgcttcctgtggtagccttatggtctgcaggggtcaaggaactctccagtgactaggattgcaggagcccatcatgggaatgtggactgctggggcatataccattttcccacactggggtgactctccaagctcccaggtgatcctgaccaagctggcagctttacttccctgttttttttcttgcttcaggtgtttcatgacactcctctgttgaattccagtgttctgtcttagatgctgtattcaaagaatgattatgtacttgctattttagtttttctttgtggaggaggcaattgctgaatgcctctagtcagccatcttggagtcctgttccaatctttattttttaaatctgtttttacagtctttccattaattgtgttttttttaatcccattatctattctccacagttgattcaaacatggaaagtccaagcctaagaaatgtgtaatctaaggccttcaacatgaaaacatgaattaaatttatcttctcgtttgtctcatagtggttctcccactttcaaagaggagttaccccaagacttacctaagtaaatccattaattctagcattcacttaaaaggaaaatgttgagagtattgctgagatgagtgaaaaagaaatccagaaaaaaatgaattaggcctgaggacaattaataagaagtactgaaatgacgtgatatctgttgatctaaaataatccagccaaattttggtgaaatataaaatctggtgctgcacactggtcaatcggtataccatcttgggttagccaacagaatactacagttggaggtggagagcggtggcctgggtccctttacatgatcttacccctcccaccctttgatctgatcttgtttgcccattactaagttatgtcacttaaacatcatgatttaagcatgagagaaagaaagaaattgtcctataggaaaaggatggaaagtctaaactcagagagtaccggaaagtcaatgaggcctataagaacaccattcatgtattcttccttacatggtttatttttgtccctctcagttctccctcaatctgtttacttgctgttaagtaaaagaaaaacgtccgggagcagtggcttctgcctgtaatcccagcactttgggaggccgagatgggtggatcacctgaggtcgggagttcaagactagcctgagcaacatggagaaaccccatctgtactaaaaataccaaattagctgggcatgtggtacatgctggtaatcccagctacctgggaggctgaggcaggagaatcgctcgaactcaggaggcagaggttgcggcgagccaagatcatgccattgcactcctgcctgggcaacaaggtgaaactctgtctcaaaaaaaacaaaaaagaactatatcataatagttgagtataatataaagctggagtcatgttatcttggttcctaatgccacagaataaaagttgcattgatttcaggattctacaaggtaggaaaaaagcaagaagtgtgcttttaatttttggagaagttttccatttgtttccggagtgagtgaccattttgatacaagaacagcatttctgtgagaaaaatgcatactgtttttgacacattactgtgaaagggagccaaacacctatataattggatcctttcaccaagagctcctttctttaaagatgtacaactggactgaaatatgataaggggacatttttctatcttcccttttttgaaaaaaaataaacgaatgattatctgaatgaatgtagctgttccatccatttacaaccacttctgtccatatttcctaactctctactgagtcttaccacactgaatttctcggttttaattattagatttctgttccttgtccctagcagagaatagcgccctgaagaaacagctcactaaagcaattgttttgatgcttcaagggaaagagggatagtgaggaggggaaaaaggaataaactagttagagtgagaaaagaaaaattctgagaggccaaaatacagttgcttaagaaaagacagggagtgaaaacaatcttggtgcatgtcttatttatgccttgaactgaccttgagaatagacaccctaatattaaatccaataagatgtgttattagaagaaagtctttgttcactaagaagaatagcactatgtagtgataaaagacagaggggattcatgcaaagctaaatgatcaaagaactctatacctgaaaacctgaacctaaaatacttgtgccctgtaagccaagaaaggccctttcattgccctttttcccatggtgcttctcaaaatcattattagcaagtttccctgtaaaaatgaaacagcatgtctaacaacaatgaaaacctggtctcatagatggttatcatcacacattttctctgaatctgctgacaaagattgctttgtaataaaaaaatcaacattaatcattataatatttgagttgctcttatcaaatttacacatcaggcaggactagatgttacgtacatggttatgttcaagtaaggcattgcatttcattatttcaatgcatctctagagaaagttcaacttaaataaagctgtctaagctcctgaaaggcaatgcatcaatttttcaagtcttaaacaatggacaaagattgtttctaaggagagcagctaaggctctcatcttttaaatgatagacagtgttatatctaaggagcagctaaagtacccttcccctcaaaatactatgtttcccagtttaaaaaccctgggctgatgaaagggaaattacctctagttttaaatgcataccttgttaggagaccactatcttaagcacatgtagaacctaaaagtaatgataatacactatgccaaaccacaattattctcttcctcatgtttttaattaaatgtattgcctggcaagcttcctactgaatgccaaacaaaatacacattttacaaatgagtctatatcatgccaaacttcaagaggattctacaattactgaaactatgataaatttttaaaattctcagcctgaaatgtactatgtaatgaaggctttttaaattgggaaatatattcaaacgttgtttgctgccttcatttccataatgggttcttgggatctcctgtcagcaaatagcatcttaaattattgcattggatcctacagaaaaagacctagagaagaaagggttagagattgaaaatattttaaagaaaccagaggccagaagtctttaataaacagtggttacaataataatcaaaaaaaaaaaaaagcagatcagactctgaagtagagggcctgccactagctgaggtagtgcataagttaattagccattccatttttatacatacttcaaaacattatctcgtacacaataaatatatacattttgtcaattaaagaaagtaaaatgtaataaagataattttaaaacattatgggttagaaagtataatgaaaaaggctataataacccagtgatggtaataccatggacattttattcagataagtgaaaggaatatctttgaaaatttattggcttggcacaaacctgccagtcatttctgacactgcctcatccttgactctctttcctatccctgacctcatctcatttctggcattcattctccttcctcctttctcttttgattaaaacgagaaagaagaagatggtacaggtgatcagaaacaggtcaattaactagggctatggcttaaaaacaaaaaataccaaatgttttcatagagtcattttgtctttttaaggacagtgaatatctatgaaatgatttggtagtttctgctattgtgtgaaaacaaaacagaaagtttaattatattatttatatttttattccctaaatcgttgaaaacataatagtattaaagatcaaaaacttcctccttaatcctttttttctttgatgtttatatagaataagtcccataacatagcggttgattttatagatgaaaacaataatagcatatattttcttctgtaattaagagttagcacattcagcattttctgtttgccagacactatactatacacacactaattttatcagtataataatcattaagtttatagcactcttgtgcttgttttgcagatgagcaaactgacgaacagacaagttaaacgtagcttgaccaagtttcacaggtagtaaatattggagatgggatttgaactcagggaatgtggctacagagtccacttttaacaactatgctatgttgcctcccataaaacatatcgagttaaaaattaaaatattagaagatcaccttagccattgatgggcattaccatgaatgcaacagattgaagaccagggttaaatataggtgatgggtagttgggaggcccaccaacagtgacttcatcacacatagcagcctcaaggaatacagcctaaatctctgtcccagtaaaataaaaaatatatatatatactacattgcatagatttcgggggtcatgacaagtgattgaaatggccccagtagcctacagtcctggggtttctttcttgagatattattacttctttctgtctcttattcccattacccttcctccctctctccttctccctggcttctgaacgctacactgaaactcagccattccatgtgccatgctacatgggagattgcactttgatgttttcttttttataatatagcaaatggaacttttatctgagagtcttagctttagatataatcattttatttctaacattcaaatttagtgctgtgataaagtagattgaaatgaatacagacttgaaaaataagttttgtctgcatcccaggactgccactgattagccatgtagtcttcactagttgactttgctgatctgagcttattttctcttaattaaaataaaactgtggcatttgtcacatggtaaggaatagaaaatcaaatgttttacacaacatttgacacatagcagatgttcatcaaatgtcattttttctttccttctccttttacaaataattatattttataaaaatctaccttttcattttatttacttattttttactgttcttaaggtgcatcagcaccttttcacttttttaaattccaaaattacaatacttgccagataacatcaactgaatggattatattgagttccttcttacacctgctgacagtagtactttgcaagtcttgtccatatattcttttagtgagaaaaaaggaatataaaatatatacacacataaactctctctgtgtgtagttgttatcgtttaaagttgttatttaactcctaatacagaatttatttactcttagtgacagatatttgtggtagtataacttcctaggattatataaattagctctacaagaatagagctgaattacaagagtaggggaattctactaccagaattcccttacttataattctgtattagataaaaaagaaaaaaagtagttatcatggaagcaaccaaaaatgataagttgaaaagagatatagactcaagcaaggacacactgttcttctactattcaaacatgaaactttaatttggcaaatttctccctctgggtgttactttctcttgtaaagtgtcattccaaagttttgaggaccctataaaagtccttggaaaatcagctaatgaatactcagctagcaatcatcttgagtaattagtatcctgaagaacttttgggattcaagtctgaaaaaggaattgctccatgaaagagggaaaatgtttgtctggcattgtatatattagtctcctttctatttctcttgttccatattattcagagtagcctaactgctattataatatcaaaatgtcttagtagcttaacacaataaatttcattccactctcacatgatagtccaggcgaattgtgggtggtgggctatgtaccacatagttgttcaaggacctaggtaccctcgatctacaagatatcctgtcccctaaggctccagaaccctctgcacaagtcattgcatccagatatccaacaacagaaaggaatgagaatagatctcataggagacttctggggtcaggacagaaattgacacacttcactcccacccatattccagaaatgagatacaaaggctcatgtaactgcaaagaaagctgggaaatgtattctattccgttcgggaaagaaaagaaaacaaggttttgtgaactcacagcattgcctttgcacatgatcccaggggtgctaaaatcctatattttattttattttcatttcagcaacaaaaggctgtgttccttgtgaaaggaaattttgtatgtcatcaagtagatgggaaaaattgagaaagaactgaggcacttcactaatacagctgtaattacatgacatatactctgcctgggcacaagaccaattttatttcctattttgaaattgtcaccatctagaggatctattattaaaaacaaaaattacatgaattctactttgtgcacaataatagtgtttcatattcaatgttgcatttgcttatgaaacaaggatagagtgtattttcaagatattttaggagatcaacctgggagaatactttattactattgccattgctgctggtggcggtggtggtggtggtggtggtgtgtgtgtgtgtgtgtggagagagagagaagaaattcccttcctcaaattcactactacttttctaaagaaatcctaggcacaattttattttctgttcttcggtcctcaaatacctcaatttaccctttacctgttagtgttgtaacaaatcctagacagattatagaattcatagaagaatttcatggagggggaaaaatcccaagaaaaaacacaaaacccataggtgaaatcaaaggtagaattagaatgaagaatttctttggcaaagtttgttttttgttatattgtgggcaaaatagagatcagtaaaccaaataattttgatttttgtctttagtaaaacagactattttctccaggactttataagtctgaagatttaatatttttttgtgtgattttgtactgaaaacataacataataacaaacattattgtgttattatgtgcttacaacgttccaggcactgctgcaattgcttacttttcttactcacttctcatacccagcactgctgcatagaactgcacaccttttgcactacacacatttaagggcagccattcacagcatggacatgcccataattgcgcacatcacatcatatgctgcttcgcatgcccactctgttcctaaaatctattatctttgtcctataaacaagaaaacagaattttagacgctcaacactccttaacttttctccaacatataagaatacaggtcagtttcaaatgaatagcaaggagtttaaatccatgttttcagagctaattaaaaataaatcttgcagtgaaagcatcatcataggttttatgtcagtatgcatcttaaagcactgaaattcgacgggtacctcagaatcagtggaatgttttatatattgcaaagaaatatacagaaacaagatattcccagccgttgttctaagtgggtctgattaaaacattattctctgtctacctgaaccaatcccaaggattataaaataaatagccccttctttggttgaatttctttcatcagaaatctggcatgtatctttttcttttcctttttttcccatctacttgggtctgaaaagagatagatctaagggggggaattactatggttttctcccccagttggacttttggttcatagagacatgtaacctagttgtgggggtccatgatcgaccatccgatgttccctagaaccaacaaaagtagccattaatgttagctgagaaactttaccctagtgaaaattgtggtttctaggtagaagttcttctaaggacttcagcctattttgtgactaagtttgttttctataacatctaaagagcacagctgtctaagaaacactgccactcttctctgctctttcttccaatggcaatgaaattcttgcatcaccctaaggagaaaactagagttggtagttgaatgcattttaattcttacagttccctctgtaactcatgactggcatcactcctgtattacttgttccactaatttttcttcatgcaattcttgcattagtttcttatcgctgctgtaacaaatattaaccaatttgttgacaatacacatttattattttatatttctggaactgggaagtccaaagtaagtttcactaggctaaagggaaggtgtcagcagggctggttccttctggaggctctgagaggagaatccattctctcaccattttcagcttctagaagctgcctgtattccttggcttgtggatttttctttcatctccaaaggatatcactaaaaggtatgcttctgttatcacacttatgtccttctcctttctgttctcctgtgctcttgaaaagactcctataatatcattggaccaacacagatgatttacaataatctctcctcacaggttttgggaatttgaaggtggacatcgtggagagccattatttagcctacacagccctcaggagtcactaccaagtagtcagaatcagctcctatgatgaagctattgattttcctgcatttaaatcaaagcagtcagttgggataaattgacggtgttatggtgattatttctctagattgccagttattttttaacatgacctatattattccaacttccagtgaaagggtcaggttcttggttcttaattatttgctagctgtatgctcctttacttacaattcatatcgaaggtgggtggcctggaaaaatttggagacctgagagaaccagaattacctgggaagacactttatgtgtctggtgctactctccttccccgatacactacatattaagtttaacctgccttttccctctcctggtgttacacattatataaatactccttgaaagcacataaggctctggcgtggggcaaaaggaagaaggaaacctcttctagggtagatgagaacatttttttttcaggtgattattatatatactaatttcctctttgacacccatggaccttgaaaaccctagtacatgttttcataagacattcaaatactatataaatactgcatacttaaaggcatcacttagggatgacattatagttaaaactacttagtaatcccctttattgaaactgtgagatgtggtataaacttctcagtggtgcctttccagactcatatgagtagtaagaatgcacaaggaaagcctttttttttttttttttttccgagagggagtcttgctctgttgcccaggctggagagcagtggcacgatctcggctcagtgcaagctctgcctcctgggttcacaccattctcctgcctcagcctcccaagtagctgggactacaggcacccaccaccgtgcccggctaatttttttgtatttttagtagagacggggcttcacagtgttagccaggatagtctcgatctcctgacctcgtgatccgcccgcctcggcctcccaaagtgctgggattacaggtgtgagccactgcaccatgctgcaaagccatttttatcttcccttgtacatgggaaagttacccctgcaatgtcctcctcaccaacacccccccacacccaacaaaccaaaagactaaaagtcattattcgttgacaccctctctggacacaatgggaaatctgtactcagcaccaacatttgaaaacaggtcttttcttgccttccacacattacttctctgagtgtgcacattaatcaaagccaatgtactgtaaataccatcacactctctgactgtgagagtccctctttttcctgttggcagtggcctcagcattaatcatgcacatgattcttacagagcctgggcattttttccagcttcgctttaaaccaccgtgatatactggctgcccctgctcctttcatatcagaccaacttttataagctcagaaaataatcgcattcaatttaggaaaataatataatttagccattattagttagcatctgaccttcttaaagcctactgactcacttcttattctggtcatggcataatattattctaaggtccagatgaagaaacacacaaaggtgaaagagccactaacttagtcaagaccaatcacagctaatagattcagtacagagttagttcaagggtctgccttgccaccagtctcaggccttgttgttgtttctgagatgacaagacctttggcagctgatctttggcatgccccccgcacccccaccattctagtctagtacagctataggtcattaaattttaggacaccgtaaagcttactattttcaatcagcttattcagactgagtatgacttgagacatactgagttatgcagctagttttcatgttaatgtgtcatttttgctgctctcaattgatttacatgctttattgaattacgatattgtgcagtgacccaaagtcaatttttaaagggtacaatttaaaaatttgaaataatcagccttagttcagacgtatacattatttaaaattttttttctctccatcagattatttgatcacacaggtattaagcctagtacccattagttatttttcctgatcctcttcctcctcccaccatccacccttcatgaggcctaacatcccattatttatctattgcaaaatgatacaacataatgcctcttcaattaacaaatgttaaagcaaaatcaccataatacggtagttattcggcatcatgtgcagctgtgagtgatcctccttctcatgtggatgtgtccttgccttaaaaaaatttgtgcctcaggaaaaaatagactaacaccatacttaaatatttggacctggctttatattaggtagctccatctggagggtctcatattggtgtcattctgaaaggagtataagccaggcttttagatcctccctccctccctccctccctttcttcctccctaccttcctttccccctccctccctccctctcttccttcctttcctcccttcctcccttccttcctccctcgctccctccctttcttccttcctttcctcctccctccctcccttccttcctacttcccctccttccttcctggaaggtgtgcgtgctgtgctgctgccccagcagtgtgccttaagtcacagtgccaggatgtattaggccacagcctttttctacaacagatctatttcatttaaggtctgccagttgtctttctgaaaataggcctcaacgttttccccaaatactcttgaaaaccatctgatgacatttgagcatattgaaccgggctgagaaggctgcctttctctactgcctagaactgctccccaaactctagtgtttcttttttgaagacaatcactgaaacatgagatactgggtctcaattaagtggggttatttaggaagaaaagaatagaaaatgagaaaccaacagccacgtgacagggaggttactctgaatataattcaaatcctttgcagctttcaggaggaaactcatagaatatattttggtggcttacacactggtgctgaataacttctttgccacttaattggaaaaaaatatgacattttcccagaagactgaaatcattaagactgtgcctgttccatgggatcagttccaagaagtctaatatgtttacgccaggagctggcatccgaaaggcgtccctcttcacattgagcttttggtgtcttaaatggcaaaacattgatagcttcagccaaataggttgctttggggcttctattttattctctgtccagaatagagcctttacatgctttatcttcattctctatacgtctatgtttctttatgttatacctgcattatcatgctactaagttatgtataagatgtatacagaaatatacattttaaagagatcaagtaaagataaaagaaactattttaaatatcttgctaatgataatgtcattaaaaacaatctcaagatgcaatattccctcaggagaaatttgtgaatgagtattagaggatgcaaatctgtacttcaggccgggtgcggtggctcacacctgtaatcccagcactttgtcaggctgaggtgggtggatcatgaggtcaggagttcaagaccagcctgaccaacatggtgaaaccccatctccactaaaaatacaaaaattatccgtatgtagtggcacgcacctgtaatcccagctactcaggaggctgaggcaggagaatcacttgaaccctggaggcggaggttgctgtgagccgagatggtgccactgcactccagcctgggtgacagagtgagactcaatctcagaaaaaaaaaaaattctgtacttcacgtagtcttcttgataactaattttactggcctagttcttttcagttttgactggataatcactgattttattttgcaatgttgctgaccatcatctctactaagattaagagaagtgccaattctgacatcttgttctgtttgggcttcccttttaattatccttaatccatagtttattttataaaaaaattaaaacaatgggtcgcacttaaggagggttataaatccaggtatctttgattgtgataatgttgaaagctacagaacaagtgacagcaccacagacaaccctttaataaagctctcttgtctgggatatacactaaaggagagtgtcaatgccaatcatacattaaatcctgggaaggctacaatgtttacgttttagataacaaatttaaagaaactttctaatattttcttttcactctcgaaaagaacatcttatagccattttgaagactaatatttaaagccataactccaatgttattttttccagattatatttcctgttgcccaaagcagggtagaaacctttgatttctctcaacatatctctcatcttacccatacctcttttgagattgtcacccctttctacctcatggttatgtatatagatatcttagttcttgaacaagattgtaagcatgttgaaggcatggtccatggctgactcatgctcggttttcccagagaatctggagacacaacagtagagagactagccatggtcttacatatcacagttcttccaaaaatatacgtgtcgagagatgaattaatcaattcctttatctgagttgcaaataagcttcatggttttgagttttattttgtatgcttggttctattaggtatttccaaacaaaagattatgagaaagcatgtagagaaaagatggaaggaagaaaaaggtattcatttttttgaaggttcaaaataaaggtgacattcataatggataatcatttttgaaaccaaaataggcagtgaatgattatccgaaaacattgttcattctaaaattgttagcatgcatctactttcaacatgttactatcatctacgatgtagcctcctttcccttggctaaatcagttccaaatagaaactgtcaatgaccataaggacatatttttattgctcctcatttcagatgctggatattagagaaggaagtagtatgtaagttaaagaataactaaaaagtagtttattcctgtgagcacagatgctatagtaaagacaaaaagaattatttttaggggctttttagaccaacaaaaaacaaaaggagaaagaggaattcaaattgaaaactggaaaacattgttacaaataatgataataataaaagatctaaagaacaaaagagcagcttattttcaaacatagctattattttagaaacatggaaaataatagctgaagggctgggaattgtaggttctactctgtcttctaagagctgagtttgggcatcttttatagcaaccaattttccatacactcagatggctcccaaggatcactgaattgagatgtatgatttaattttcctttcaaagattatgttcagattattatgccacgcacatgataactaattgtagggaaagtgtgtcaggccaggcttggtgaaaactgcagaggtttcagctgtgacacactgtacaaaatgtaagcattcagtcaagtcatatgcattgcaaggccaccactaccagaaggtggtcttctactagagtttgggtcttgaaaactagaatgcatgtcaaccaactaagaagagattcttagtaggcataagcctatgttcttgctgcggtttctactttagcaatgaataggttaatgtcaccctgtctctggcatttgtagtcacccatttccatgggatgacacctcattctggctaatcttgtgttgatttgaaacacagaatcctacctcatccctcacttgacctagtctattgctttgaaatgaatgaagtcttaatttagagatttcagcctatctgtggtcaccatagatgccactcgcaattcccctccaatgcaattatttctcttttgtgggttctactcccttttctcttcctccctcttggccacattctcctcctgtgacctcatcttgtatattttatcttctctttctctttcttttctcactcttgtttcttttttattctttgtctcttctctttctcttctcccttactcccttctattctcctgctagttaaaaccagagacacttgttactcttacatgtgaattggagaggtttctgctcctgggtttcacagaagttttaatgctacccatactggtaagttttaattgtatggcattttacaacctaaacaaatttcccacatatattgcattttttatatacatagcaagtctggagtataggaatggcagagattattagccccaattacaaaaaaaaattgatgtgcatgcaagattgtgccttgaccaagttcatactgtcagaaatgtgtagagtaggggtcaatcaagcctggcacttctaattcttgtcccatatttatactattccagtttgccagtttcatttattctcttaagggccaaaaatcgacacacagcaactctctttctcttgttttaattgtaaaagagtctagtttaccaagacactttagaaaaagtgatatcacttccatgaagggttttaattcacccatacaattaacagttgttaatttgttatgcgtgtggcactttgctatgctgtatgatggataaaaacaagaataaggctggggccctgctgtctgcaacatagaatgactggatgaaaatgacaccccagtggaaagaccattttgggaacagactcttttccctattagatcttaagcttcatggatgcaaaataaaatgtggcttattcacccacgtatttgtttattaatttattcattaaatttatttatagtgcacttttaccatagaccaggagttttcctaggcatttgtatccataaggcttgaaatcaaatagggaaaagagtaaagttaaaaaaacaaatgaacatgtaaacaaataaatagtaataaggtagtttcagatgctaatagatgtaaggtgaaaataaaactgggtcatatgataaaatacttgttggtgtggggagaatattagttgaaggaaagaataatgtctgaatcaagcttggaattgaaagaagaagttatgtactaacagtaagtgaacatgaatgacaaaaaagacaactgttacatttaaagtccagttggggttttaaaaatctgacccacagagatttcccaaaggagctaatttctctcttcaataagtaccataaaccatacataattatattaaaagataaaactaagtaaaatgagacaactgcataaaaaatacataatcatagataatcagagtgggcatgaatcatgatatttcacaatcacaaatgcctttgacctataccattatagaaactaatagttgaatggaaacttgatggtcaattagtctggggtctctcaactgtggaaataatttctacaaactccatgactaatagctgtctaatttcgcactgcatatttccacattaggggcccataactccatgggatagttttctttttgctagattgacagctttaactatcagctatttctttaaattcaacaaaaatctgctgaattcctcaaattggtcctagatctattctctggaacaacacagaatccactggctacagtgcatcatatatcagctcttgtcacccaggctggagtgcaatgggaccatcttggctcactgcaacctgtgcctccctggttcaagcgattctccttcctcagcctccctagtagctgggattacaggcatgtgccatgacacctggctaatttttgtatttttagtggagacagtgttttgccatgttggccaggctggtcttgaactcctgaccttgggtgatccacctgccttgggttcccaaagtgctaggattataggtgtgagccaccgtgcctggcctcaatgtttctttttatatactgtgcatgtatattattttcatgaaatacaatcctaaaggaaagagagtatattaatttaaatagtttagcatattatatcaaccattgtattgagtggaccagaactgaaaatatgccttttgtcaaaaactataagtctatataagttacatatgagtatcaaataaaattatatgtatggacctgaactatggcaaatttttaaatagtggatcttagagcatgtgcatgatctagacctgcactgttccacgcaggagcccctagtaataacatgtgtatattttgtacacacatacacacatcacacactagtattttgctaacgcgcttttaactgataatttcaaatgtttctgcaagaggctttgatgtcaatgaaaaccttttagtcatttgaagtaaaaatatttttctattgatataaattatttcagcattgaattttattaaaacaagtatgataaaggttgtaaagtttaatttaggcaccacattgtcaaaaaatacgaccaagttttttagattttgtgttagctgtgttcctagaacatctgttatgctattatgacaggtgtttattaatatggatgtctaatcaaatctcttggttgctaatagcttggcaattcaacatctaaatattgtcaaaatccttgattatatgttgaaaactgtggataattgattcaaagctgtttgccttgactagattaaaaaattaaaacctgtcaagtgtattaatactttcctttaaaacctcaacattctcctgaaatttctaaaatgtttcagtaataacaacttgtgaaggaataaaagtcttctacaggccaacatctgtcctgatccaagtttccttagacctttcattatacgcataattttttttttttatttttatcatgggctaggaatgaatgcacagaaggggagtaacaaaatgaaagtcctacgctacatacaaagaatgccctacagaaacgtgttttgggtgcatttaagctcagatttttaaaattaaacttttttgaaagtatttaataatttctgaatagtagaagcctgcaagaagcaatttggtggccttcagcaatgtggttgagtagcttcaatgggtgccatttgcagctcagttactgagctggaatttccttttgaatgtacaaaggcattacataaatctctaggaaggttctgtggtaatagcattcaatggaaatctttaaaattcttaaataacgattatagatttgaaaagttcccaatttatttccctctgacagagtagttctctcacttctatgagatagtctgccttttagtaaatgctttaatgactataaatgtgtttttggtctagtataagtactgtccaataacacttttgacaataatggacatgttttccatgtttccactgtgataaccgctaggccaatgtagctactgagtacttgaaatactttttacaactaagaaaaaaaagtttacattgtatttaactttaattaatttgtacttaaaaagccacatttggctaggggctactgcatggaacaatgcagttctagatcacgctatataactttttgatttgccaggtgcggtggctcaatgcctgtaatcccagcactgtgggaggctgaggcgggtggatcacgaggtcaagagagcgagaccatcctggccaacatggtgaaaccccgtctctactaaaaatacaaaaattagctgggcatggtggcgcacgcctgtagtcccagctactcaggaggctgaagcaggagaattgcttgaacctgggaggcagaggttgcagtgagccgagatcacaccactgcacttcagcatggtgacagagcgagactctgtctcaaaaaataataataataataataaaataaaataaaataaactttttgatttaataaaatttactttattggagttcaaaatgatgctaaatgatttttaaaaatacatacttgagctagaattccttgattctatcaggagaatattaaccatatcaacacctaatagactagtctttctaggcattgtttgctgtggtagaaatgaaaccactatagcaacagatagttcattaaaatagggatatattcagaatattgtccacatgacctaggagtgacaaactgtaacttccaagctaagttaggacaccacttgcttttgtgaataaaactttattggaacacagccacattccccacactccttcatttatgtattgtcaataagtgcttctgtgttacaatagcagaattaagtaactgtgactgagattgctgggttgcaaagcctaaattatatactggtctttccatagaaaaagtttgccaactttttcgttacctacataaatagcagaattaagtaactgtgactgagattgctgggttgcaaagcctaaattatacactggcctttccatagaaaaagtttgccaactttttcattacctacataaatgcttatgtgtaaatattaggataaagtcccttttatggagaagcacattcttctcagttcattcaccatacttaacacatataacacacattgctaattcctgtatcttttcatatatatgtaccatataacatgtaatatgttagatatgaaattatatgtacatatatatgaaaatatgcagcaatttagcaagtatgatactaaatatatatgttaaatatttagcaaataaacctctatgtgctttcactcagatcacgggaatttaatgcacaaacaatgatttatagcatctgttttctaatttaagttaaaggtgtgagctaacatgtctctccctagatcttgataatcagatagtatcagagctagagtggaacatgaaagtgcattccaaactcattttagagacaatagttgggagatgcctaaggacacaaagagataataaccagttaatcaactatttaatagctcatttattgagacacacctatttatgtaaccagccagaaggcctagtagttgttttgtaccattcagaaagacagtgccttaagagcccaggctgcagactgggagcaaaaccctttgtgttgtcacagtggctgtgctatgaatgacatatgcccttacttcaatccaacagggaagaaagacgattcttccctggaacacttatggtctatcatttagtgaaagaagcagttggcaaaactcaccaataatctatctatcccagagaagagtctctatctgctccattaagcacctgtattttaggctttattatttatttttacagtaattttgaattgttttgaagactgtctccaaaatagaaataaccccacttggattactgtctaaagagtgagtctaattccattgggattctttttaaaaattctattcattgataggaaaaaaaatctttaacttaaaagctactttctgacctcagtagaactagtccctatttttccttctttatacaggcaacatatcataaaagagatgtgcttctattctcatctaaaatattaagttttaaggtaaaatatgacagtattattttcataagatattttcattaaaatcatcatagatttctgggtgtcaaaaatagaaattacaattgaaattaaagtataatgacagaaatgtaaatttcaaattctgcattagtataacctctaacctttaccagaataatctcacttatcagatacttaaataaaaactaatatctcaacttagtatatttttctctcccttttttcaatctaacaatatggaacttgagtttataatacaataaagttcaccatataatctgaactacataaatgcctggactatattgccttttcttcagcaacatgtgtcgatttagacctttgattggattgtggaatgcagtaacagaacaaactaatcattacaattacattatatcatacaaccaagaataatttataatatgcttcttgtactttttggaatcattgttctcataccagtgtggtgccttattaatcctatgaagtcagtcatatggtgataaaacagatacaaaagacttgccttaatatgttattattattgacttagctctgaccacaccacctgatggacaggttccaagtaaagacctagatagtcaaagtgagtactattagtagacttgaaacatttaatttctgttggaagagatgactaaagctctccatgaattctttatttatatcacaatctgaaatattattaatattattgaatgaattttatttgaactggaagaaaaaggtaaaaataaagtcactatagtgctatagctgtgaaaatttggctgacttacaaaatggcagtgagttggtgaattaggacaagtggcttccagagactaaagaacctctaaacttttatcatcaacaggcacatttaggatggatcatcctaaatatcacttaatcatgtggccaaacagaactattgttaaccgacaaaatgctatgcattgaatttctggtttaacaaatgagaaaatgggttttgtttacagtggcagttcagaattacatacttataaatattgaggttagggtctattaatgggctgtttggttctaatcatctgaagaataattcattttctcacagagatacacatgatttgctttcatatcctatacggcctcctttatgtttattcaattttgttatcatagtgaggtatatgaaagcccatgagctcggaaggtactatctttgcatcatcttaatcctttggccataaaagaaaatgattggtcctatagaggtctcctcaacttcgtccagaaacaagtgtgacatgatcgaatctctgtcatattatatacaacttacaaaagatatacatacccatagccatgaggcgcaagtgcatatctagttctatatgaggatacagctcaaatacacacacacacacacacacacacacacacactattttattggctgacaaagaataagtgcagaagtatcgagtatataaaatcactaattatgaatcaggagaactgtttgtattcactgctttttagtttagttttattcagtaaagcattgtactacttaacttgtttttgaagtttgcatacaaacttcgtgacatacaaacaatgtgaaagcattgtaaattttttcttaatatacatgcagtattattttgagaaaaataatgtcaccctcagataaacatccagatggttttacaagcacaattatgacatctattttaccagtcattctttataagcactcacaattcaggtagagcaattatattgcaatattacttacttattacataatcaacacttctgtttgtatgaaatgtcacattacatctaaagccctgaaatgcaatgacctacagagaataatcaattgtttctcaaaccgttcactctataaaatatattaaattttgaaaagaggaattatcttttctatctgtaaaatgagagggtggagcaagaaaaacttgcaagactttttagttgttagatatcataatttgaagcctttttctttttcaataaatgattcctcagaattacatagactacatctttgaaggaaaaaaaataggaagtgatagatgatcaatcacattcacgtttatggtgggatatatttattttctattttagttataaagaaaacttgtttccattttcagctatctgaaaccagttagagagacagttacacagatgatcaaccatatggcattaataaatgtataaccaagacagatatgaagcattttatattttaaccaaatggctaaactaactcatgaaaatgtcatatgttatctatttagctgagagctttattgcagagaaattgtgtcataattaacaattaccacaggaccagccatttcattttataattacttctcaaacaaattaaggaagatgaggttttacccacattcagttacagctacattcaatttcataggtaggaatatgtaaatgtctatgttttataaaaacaactcagccagctctatcagtagtatttacatagaagattcaatgggaaataaaatcactgtaattaagtatacataatttttaaatagatcagtgttgtcaacctatctttcgcttgccttcatgttgaaggatatagaatagaaatgggaatcagatcccccccaaaagtgggggatcccacttctcctactgtagcattcccaagttcgtcttcttttgcctatatttgtataatggggttatgcctaaagttttgatttttaaaatgattccaatgcttctgacataaaaaaatctgttgctgaaatacttgaatactataatatattaaatgatctaagtaaacataggactacagaaaaaagaatatgagaaaaggatcaaaaggaagtaactgataaaagtcaaggagaaatcaaaatttaaataaaagaaatgggcaaaaaaaatagttaaaaaattgcttagtgtagtttgatgttcctgcagcttcaaagtctataaaatgaattacagtgaagtaggaatgttaactttttttgttttctgtctacttagaaatggaaatatttagcataattagtccattagtgtttcctctattttatcgctgcagtattataattaacacaatattacattcagtatagatatgagaccaacttatttacctcagaggaattacaatggaaatagattgagttctccaatgctacctgatttttaagcatttaaaacttaataaaatacatgtatttcaaaacttattctttccttcatcacaaaatactcatcatcaaaaaccatagttgaatgtaattttctgtatttcaattgtgtcaataaaaatggcaaataacagcaaaacaaattccattatcattttaaagcttataagatcaattttaatttgggataaaggcatcccttgcatgcatctatcccaggaagctaagtgcaaaagtgcaggagggtagacttgagctgaagaaagtggaaggtttggccaaatagacaggagggagtggctggcacatatgagttcctgggaagagactgcttttgcactctgggaaaagactgctgattttatcagaacagagaccagaggggtgatggacaaaaagttggagagtagagacctggaaagcctgcaaggctgacatgtttagggcacctgtattctcaacactcttcaaccaacactgaacattcctgcagaggaaggcaactggaaaatatttaagcaggattaatttatcttacattctggctggtaaactttctgatgctcagggagccctagttagcctcagagataatttgccaattgattggaatatttcacatgcttgaagcctaaacacttgctgatgatctgaatttttttttttttttttgagatggagtctcactctgtcgtccaggctggagtgcaatggcacgatctctgctcactcactgcaagctctgcctcccaggttcacgccattctcccacctcagcctcccgagtagctgggactacaggcacctgccaccatacccagctaattttttttgtatttttagtagagatggggtttcaccgtgttagccaggatggtctcgatctcctgacctcatgatccgccctccttggcctcccaaattgctgggattacacacgtgagccactgcatccggccgatgatctgaattttattcatggttgatcactgactctttcttgatcactgactctttcttgatcttttgcttaaccacccacagctcataagtatctctgttctctgcccacttagagtaatcgtcacttttgtaaacgtctgtgatctctatttgtcacggacatgacttaaagacagaacgtctggtctacatattgtttgcacaccccgaaacatcgaatataagaattgtaggtgctaaaatgctgttaatacttagactgactatatcaaacctactaaattaggaacttaagaggctgaatttatccaatctttttttaaatggcagaagaatcagtgatactgaagagcaatccacatcctcatgtcttataggaggattgccaaactggaggaaattgtaactactatcaggggatttgtgtttgtcgttattctttgttatttaaaatgtgaattattgctgtcggtacttataataatactttgcaaagaatttacattaaaaataacgaggtatttgtaaatagcaatatgttgaaaacaagcagtgaactttggcagcattcttactgcttcattcatatttgcattatttataagatgctaattgggctctactctaaaggagaactctaaatatggtactccacaagagttctaatttagttaagcccaaacaacaaatattcatagagctctcagattctgaatattccatgttgggcaaaccacagtattagtgtccaaactgagacagaaaaacaaaacaatactaaacttagaatatttttagcttgattgaatgaatacttcaagtaacatatcttttttccccagaataatctggaaattccatatacaggatcttggcttttttttttttttttagatagatagggtctcgccctgtcacccaggctggagtacaattgtacgaccgcagctcattgtagccttgacttcccaggctcaagagatgctctgccctcagatcccaaggagctgggactacaggtatgtgccaccacccctggcctattattttatttttatttgtgtagaggtggggtcttgctatgctgccaaggctgttctcaaacttttgggctcaaacaatcttcctgtctcagcctccaaaagtgctgagattacaggcttgagccaccatgcccagcctcgaagatgtctttcataaacgtaaggatttgatttttgactttgaatttccttggactagttgatgacatgttcaaccttcatatgctgagttctcctcactttcaaattacttctcaaataaatagcaaaatctccagtagctttaaacaaaagttatatttcaaaaatgaatgatgtatagttatcttcaacctatgcgcaaagtacaaggttgagaaggacttcatttttgctttgatgaaaggcaattccattcatgattctctttaaattcttcagtattaacatctaccaagaaaagaattcactgttccatgacctgagatgcattaaaaattacatgtcaaatctactttacaggcaaaggggaaagaggaactgcatgtgtcctatatacacttgctttaccagtagcatgacacccaggatatgcacatgacacacacacacacacacacacacacacacacacatacacacacacaccaaaagcaaccaagcttccttagcaagagatacacaattgcttaccatctgggttccagatatctaagcatatcctcccatactaaacacttcttaccacacaaacctttgatgctactatttggacaactttactcctatatccccttgtggtctcatctttattatttagctgtttccatttccttagcctataatcgttatccttgcttctccacctagttaattccaatttatcctatgccattcattgtttaatttccacctcttctctaaaaaatgtgaggacttccctaaaataatcagttgctccctcattgttttcccatatcacttggagtagaacactgatatcaacccatatccagttattttattgttgttttaaatagtgtgtttgcttccttgctagaattcgaacacctcacggaccaagtcaaagtttttaaaccaaccatctctagtacttagaacaaaacatatcatgaactttgtacataataaatgtttttagaaagcctttcactacctattttccatgtttgcttaaaatactaacccagtcaaagaattataaaataaatattaaaaatggttttaagtagttcgtggaattgcaatgtttacttatgttgcaacagaggaatcagtcacaactttgcatttagtaaacatttttggaaaatgtagaaagttttgaacttgttacttatctgttaacatacatacctcatgagttttaagtggcaaacagagagagggagagagagagacagagagatacagtattgaagcagaatgttgactcatatttacatcagcaaattttaacttagcacctggtctctctatttccagtaatgaaaaatatggaggtgaaatacattgctctcttactaaagaaatatagatattagataaattaaagtatgcctatgaatgttacaacaaattatactttaaaagtaccagcacaaatgtgttcagtgatgaaatgttgcttgaataaagggatttgagttctccctagacgtattgtgaaattgcttcttgaagtcttgctgagtctcacttcctcacccataaaatgagaagatggtctacagaaacttttaggccttttaaatatttgaaacataactcttgataaataaagtaatttacacaaaagctgaattgctagtgcactgtcgcagttccccaagtctccttttagaaaaaaaattacaagcttttatataacggagaaaaatttctacacccatatgaaactcgttctacgatattttaaccaatacaaagtttatggtgactattcagaaacatttcttctcacaaataaactagagtcagatagcttcttgttagaacaatttggtttagtgtgagtcaaaagtatgtagctcctctagttatcacagaaacttataccatacacattttttttttttttttttttttgagacggagtctcgctctgtcgcccaggctggagtgcagcggcacaatctgggctcaccgcaagctccgcctcccgggttcatgccattctcctacgccagcctctcaagtagctgggactacaggcgaccgccaccacgcccagctaactttttgtatttttagtagagacggggtttcaccgtgttagtcaggatggtctcgatctcctgacctcgtgatccgcccacctcggcttcccaaagtgctgggattacaggcgtgagccaccacgcccgaccccatgcaaaacttttaaaaaatcaaaatttacccaaagtcgttgatacagtttcatagattgataatggtttgaaaatgtccatactttgttgtatgaccgtttaacaaaatgtaaccattctctgtaaagatgtgtactgatctttacacatacagttcagaaaaatcaacatattgacatacactttcatgaccagtcaaattaagaaacaatcactgaactctttttcctaggtaacatatgaggtcaagactaaactgtttgataatgtaaacaatggctggattaagaaatggaacataggctttcagagatgagtggcagacctggggaactaattaaacagagtcaaatgatgaaactaatctatgacaagcctgaaataggctaaaacaagttgcacgagtaaataaaagtattgcaagtcaagagacttaagaatcagtgatacagagagcagaaagctagatcctctgcagtcagcacccagcttgataatgcatcacagctggaagaaaggggctgctgattatttacagatcatgatttctaagccatagtacatgaaaacattcccaacatgaatagcaatatcttttatgtttttaaatactaaatctagcagtgacagctttgcatctatttgaatgctttggttaacagtaattagttaagaggcaatattggcttctgcaagaatgcttattttaaaataaaaattctgccaatggccattatgttacatactctatttgcatttgtccaccattgcagacatctcacatactccagagtgaactggagaagctctctcagttggttagagcattgggttaatgaggacaaggtcacagatttaatcccatacagcccagttaacttggcagagaaaaactttgctgcacaagctctagctgctatttcagcaaaacccaattgtaaattcatattgtggatcacaggggaagcttgggaaacagtggaggtgatgaaaacaacccacccatcctgtttcctggaaaacaatgtcaaacacccatgggtcaagtcagcaattgctcattttatttaaataataccacttttttcctgaatattgcctagccctgaatactgttggaagatataaattcagataaatgtgttttacatcattgaatgtgtttttgctcatcatctactatcttcctcacatctatgctttgttcacctgtatcaaaggagtaattcatacaccctaagcagcaagttcaacttgcatcaggcagaaatggtgatttccaagggtataattatgtaaaatggagtacattttctgagcctcagatttagaggaaatttttcagcaatgagatatatcaagccctactaaaaacagacattttgctccctaagcattacaaataagagacatcctatttcataaaagactcataatttaaaaatgtgtctatgtgatagattagtgaattagctgcaacaaaatatcctacatgaccaggccaaatattagaagcagcacatatgctgtacagtatgaacatacacacacactcacatgtgcacacacgcacactcaagctaaaaatcaaaatgtgagtgccattgtctaatattagtttgttttacatctcccccttcagtcacctgttttgaatttttgagagcgtatcattaaagatcctaaagaaccagaggaacaaaataaagttgctttaatgaagttagatgaactagctccttctgatttctagctctgtcactgaatgtctgtgtcatcctgctttatatgtgctttagatgaaagactgtggcatctgcttcgtataggagaaaatagagttaaagggttggctcaagatgccagtcattataataattcccatatttaatcctctatgttcctaaaaggctttttatattaatgtttactttgattaaggtatttaatcaatgttttcattgaactgagttccatcactcctaaagtttttatccctttcttccggtttagtctcgattgttctctaaagcacagaaaagggaagatatatttaaaacttctatcaaaacaaagtgaaagagtagaatcattagattttttcaggaacatctgcagaacaacaagggccaaaaatgacttcaaatgacacataaaaatgtctcagtctaaaatattggcattctgctaggccctatttgactgataagtattatgcattttcctctgtctctttcacctacaaggctgagcaacaaactgtgtctagagtttcttcattttaatattcttgttgttccatctgggtcatttattaacaaatcccacaaaagtgtatttgagtcatcttattggtcatcttattggtgttattgacacaagattttgaagtcgcacaataaatgagaagataaatcagtttaaaaaatcacccatggttgagctctaatataatcagatttaaatactactgtatgaaaatggtgcttctaagtaatattgtaaagtttaaacaacagtagtaaataaatattagcatttctaggggttattttttctcttaagttcagatttgttttttattataaacactgaaataagtcaaataagttaaatagataaaataaaacaaatggatataaagtctagggatttaaaaaatcatcttattaattttttagctgtggttttatttcataaggtattataaagaaaataattgcaatgtgaaaaatcagttctgagtttgctatggctctagtttttgtggttgtgtgacattaggcaaattacttatgttcttgcagtttcaatttccaaacttgcaaattggaagataaaaattatactaaatattataattaacacataagatagtcacacatactaggggctcaaaagtttagtgatcattttattaaggtgaatatattaataattgtgttttatgcatatttaacaattagtcttattgttgttagtaacactaggtccaaaatgaagtaatcatcatcaacaacaactaaaagcttaaatgtctgtctctccctgtgctcaccctatgtgctcccatgaaataaggtcattgaataggctatgccagaaatgtgctctctactggtaatttttcatcttgtgaatgcttccttattaattagatctcctcataattgtccctttcttagggaaatattcttgacctccctaagtcatcttgttttatttttaaaacaaaaataagagcacttaccactttgtaatcttgtatttacttatggttcacagtaaaggaagactcaatttaggattacagacacaggctccagactcagcaacactagtcatagcaaaaatgaggctaatatttggtttataaatagtcaacgccaccccactccaatttccctcctttatcttggctcaaaaaatactgacagccaaaatttatctctcaagccaaaaggcagaaatttcttctttgaagaaatatggaaagcatattctaagaattctctaactgcttacacaaatgttgacaatgacagattaaagcatttagagtcctccagtttaaaggacagattcatcctactcattctttgtcaagtgagacagacaaaacctgcataagtatataggcccccaagtctgcctttcttttacttatacttaaatatgaacagcgatccaagcattaccatacatttgaagacagccttcaacatggaaaaatcagttttttaaaaaagggaaaatggactgtaaactagtgcaaccatcgtggaagtcagtgtgggaattcctcagggatctagaactagaaataccatttgacccagccatccccattactgggtatatacccaaaggattataaatcatgctgctataaagacacatgcacacatatgtttattgtagcactattcacaatagcagacttggaaccaacccaaatgtccaacaatgatagactggattaagaaaatgtggcacatatgcaccatggaatactatgcagccataaaaaatgatgagttcatgtcctttgtaaggacatagatgaagctggaaaccatcattctcagcaaactatcgcaaggacaaaaaaccaaacaccgcatgttctcactcataggtgggaattgaacaatgaggacacatggacacaggaaggggaacatcacacaccagggcctgttgtggggtgggggaaggggggagggatagcattaggagatatacctaatgtaaatgatgagttgatgggtgcagcaaaccaacatggcacatgtatacatatgtaactaacctgcacattgtgcatgtgtactctaaaacttaaagtataatttaaaaaaaagggaaaatgactattggggaagcagagattactcaaagaaaaggaatagaagttaaactaaacccaaataaaattctccataccaatattgctaagatgatttatttatgaagacagtgtatccataatacaggtatagggtgcagtggggaaaaaaacaaacagtgaaagaacaacaaaaaatgaaactaaaaggtactttcagtggaagaattggaagataaaatgaagaataggaggtgaaacttttgagaaaaaaagctaagagacatatagaatcaatacaaaagatccaacatataactcaagaaagatagaacatttaaaaagagatagaaatttcaaggaaataaaagacatggaattcccagtgttgaaggacacatcacaattttcctgcattcttacatagcttctaattggcctttttacttggatatttgcttcttacatttatttatcaatataggagtaaccctttaaaaaatgtaatacagagcagtaaacatctttgctcaacccccgaaatgctcccctgaaatagaggaaaagtgagagtcctcactggatctgtccccaccccaatccccagccccaatcacatctctgacctcatcttttaacactttcacctttgcttactccagtctcaaagatcaggtacacttcccaggtaggatttcctcctctaattctgccttctgcttcaaactctatttctctagatatctgtgtactgaacttccttatgtacctcaaatattgtttaaatgaagtctaactgatcacactacttaaaattataacctacaaccagcaagaatggtcttcctcaccctgctttatgttttcatttccccatagctttcttaaatgtgatgtaatttatttacttactgtgcccaatccttattatttgtctctgttcaatgggatataagcttcaggaggtcaggaacatttgtagttttcactcattattttattccatgagcttggaacagtgcctgatacatagaaggtgccctgtaactatttattgaatgagtagataaacatacaaataaatgaagaagttcttcatgagtggcacacaactttgaagtactggaattataaaaaagaaaatgtaatctttgcacaccactcattgtaatgagcaatgttcatagtccaaataataattatggtattacagacttttcaaattatagaatcaggcaattgaacaaagcatgaatgacataattacagctatacaaggaggtgaaagatctctacaagaactataaaatactgttgaaagaaaccacagatgacacaaacaaatggaaaaacattccatgctcatgggtagggagaatcaatatcataaaatggccatactgcccaaagcaatctacagattcaacattattcctattgaaccactaatgtcatttttcacagaattacaaaaaaactgttctaaaatttgtatggaatcaaaagagagcctgaatagccaaagcaatcctaagcaaaaagaacaaagcagaaaacatcacattactaaactttatactacaaggctacagtaaccaaagcagcatgctactggtacaaaaacagacacaattgaaacaatagagaagccagaaataaaggtgagcatctacaaccatttgaacatcaaaaaaattgacaaaaataagcaatggggaaaggattccctattcaataaatggtgctgggataactgtctatccgtatacagaagaatgaaactggattcctagccatcaccatatacaaaaattaactcaagatggattaacaacttaaatgtaagacctaaacctatgaaaatcctagaagaaacctaggaaatacctttctgaatgttagccttggcaaataatttatgactaagtcctcaaaagcacttgcaacaaaaataaaaatggtcaagtggaatctaattaaatgaaagaggttctgcacagcaaaataaattaccaacagataacctacagaatggagtaaaatattcaaaaattatgcatccaacaaaggtctaatatctagaatttctaaggaacttgaacaattgaacaagtggagaacaaccccattaaaatgcgggcaaaggacatgaagagaaacttctcaaaagaagatagtcaagcaaaaacatacatatgaaaaaaatgctcaacatcactaatcgtcagagaaatgcaaattaaaaccacaataaaataccatctcacataactttattatgtgtctcacatgactttattaaaaagtcgaaaactgatagatggtggtgaggatgtagagaaaagggaacacttgaatactgttgaagaggatgtaaattagtacagccaatatggaaactcgattggagattcctcagagaactaaaaatagaactataatttgacccagcaatcctattattgggtacatgcccaaaggaaaataaatcctaccaaaaagacatgtgcactcatatgttcatcgcagcactattcacaatagcaaagacattgaattaacctaaatgccaataaacaatggattggatgaagaacatatggttcatatatacatcatggaatattatgtagccataaaaaagaatgaaatcatatcttttgcagcaacgtagatgcagctggaggctattatcctaagctaattaacacagtaacagaaaaccaataccacatgctttcacttataagtgggagccaggcacactggggacacatggacataaagatggggaaaatagacactggagcctccaaagttggggagggagggagagagggagtaaagggttgaaaaactatctactgggtaccatactaactacctgggtgatgggatcagtcatactctgaacttcagcatcacctagtatatgcatgtaacatatctgcacatgtcctgaacctaaaagttgaaattttaaaacatgtataattatgattataaaataaccttgcagagtaaaaatcaaggtacacttgtaagatttggaaggtagaaagtggtcagaaaaggattaaaaatggcaagacagctaccaggtcctaccacacaaattaggagtccagatgaatcctgttctcatagaaagctgatggttaacaaaatggttactaaagtattatttttaaagttatagaagtagctggtaaaggaactgaaaaacattggtataaatttatggggagtcaaaaggcaatgactgcagatgaaaaattatgaaatagaaagatatttagttaaatctaggtaactaagagaacagctaaacataaaagtagctaaagtagtcatatcttggaatttagacagggacagggaaggtgtgagtgggagaggacatttttaaaaaatatatccttacatattattagatttttctttagtgcacaatatttctttgatttttttaaaaaaattatttgaaaagtaaatggcttagagaatgcttaataattactaacctaactaacaaacattgtttttcttttgcatgtgaaaaaaccctttgattaaattattttatgaattatgtagaggtatttttaggtgaattataataaattataactatgaaattaaaacacaaaaataatgttaaatttagaatgcttgctactagtcatttatcctgagatgaaagcaagcatgacagatttaaataatactgcagatttttttttccacagtccagtggttgaagctacggtctccttaaggcagggcaatgacagacatggaaaaactgtagcttgacatttattcatttttataattcatttattaatttattcaccaaatgtatgttgtatgccagatattttccaggcactgtgcaacattttatgagagaactcacacaaccatgttctcatttctaagtaatttatcacatctaaagccataggtcaggaatttaaaaagaaatagctactgcatataatcatttgtttcatgaaatataaacatgaagatactattaataatacattaatttatataccgttttatagttgataaggcatattcatgtatattatttttcttcacaatggcctggtgtagttggtggtattcaatttctaatttacaggagaggaaatggactcagagaagtcaagggacttgcccaaggtcaccatgtttggtagaagcaaaacaaatagccacattcattgtactttccacaacacttcagctacttttgtttcattctgatgcttgggctcgacatgttcatctcatcctggttattctgtaggcctagttcaagtgctcctccctggaagttacactgattcagctcaggctgtaataatttttttttctttttttcttttttttttttttgagacgagtctcgctctgtcacccaggctggagtgcagtggcgctatctcggctcactgcaacctccacatgctgggttcacgccattctcctgcctcagcctcccaagtagctgggactacaggcgcccaccaccacgcccggctaattttgttttttgtatttttagtagagacagggtttcaccatgttagccgggatgatctcgatctcctgacctcgtggtctgcccgcctcagcctcccgaagtgctgggattacaggcgtgagccactgtgcccggcataattgtttgtttaatctggattctaaaccttttttttaaaatgcatataagtcttctaaatcttgtgtgcatgtatgcatacatgtatgcacatgtgctcatgtgtatgtgtgtgtgtgtatacaatagcactcattcagtttcagtgtgcttatgcactttcctggactgaaagccccccgagatcagggactggaaagactcaatcagtgatgctctttagcttgtatgttcccttatgaagctatgtttattatataggcttggaatggaagaactctggcttctaattctgactgattgaaaccttaaggctggattttctataacttcagacccaaccagatgacatttttttctatacctctacacgtcatagagagatatgtattaggaatcacagacttatataatgtcttcgctcctacttccttccctgcaatatgttggcaaagcctaggggcagttctggagcccggctgctcgcattcaaattccatctctggcatttaccacttgtgaggccttcagttatgaagatattttctccatgcctcaatgcctgcatctgtaaaatattaacagtatatacctcataggatttacttaaatgagttaagaaaagaatttagaacaggctttgaaatgatatgacaataaataaattataactatttttatcttcctcacaggtgatctagatatttgaattagatagtgtgagtgaacgtgaattgaaagtactcatactatttatattaattatattatattatattatataacaacaattgaaatttaaagttagaaagtgctaaatgacttcatgggaagcattacctgaaaatatttaaatgttatgcagtagagactgactgatactgtgaagttctcggcatacttctctattcaattttcatccatatctgattcattctactagagaattctgagaatgaaaacaaggaaaaatttgctgttgaatttctggagcttctgaacatttctcattatacagtctccagttcaattcttcaccattttcacctaacttcaacagcagcagcagcagcagccctgtgctcagtgacaggaaaatagcatgtttatttagatgattcaaaagctagcttctattccttacctttatttgtataatttctaacttcacactattttgaccattaactagttttagatcatttataaaactctaatttatgcactgtgagtattccagagaactcctttaatagccacttacattcaatttcctgtggcctagacattagctacctgaatgagaagggatcagttttagccaattaaagctcatgaagggaaaacagacaccacccgtaagcaaaacaagaactgtggattaaaaatagaaaatgaatggtgtacctgcaaatcagtaagtgttgtgctttccataaacatttaattatatgtttaaaaagtacattttactaaataagttactaattttaaattttaaaatagttaataactgtaactattttatatcactctcttttgttaaacagcttagagttaaatttatactccacatttgaccagcgtgcagtgtttggggcattcatttttatgtttgaatctcagtgctatttaataaccaaatatttttccttcctttgcctggcagtcctcacctatttcaaatttaaagaaaatctgtttaccagcatatctttgtagtccaaattatatatttcaaaataagcagggagggtaattagatggataaatagaaggtgagtgcatttctgaggagtttgtgaagccgaaaagggtacaggtagggaatgaaatgagcattccagggaatagtagtatacagacatggggggtctaagaaagcacttttcctctcacctccatcctcctttgggtggtattttggcagcctaagaatttagaataaccaaataactaaacaaaagttaacagtattatggtagaagcaaataatttaaataaacaaatacatatatacctacataaaagattgggaagaaataggtcaatattccacaaaagaggaagagggaatagtaggaatagagggaatgagggtattttttttttttgccgctggctttataataaatgtattatattctcagtagatactttgatacttaaatctttttaggtgaagtatttggggatgagtttaccttacacaaatttctttatctgtttatagataaaggattttcttttactttgggggggtttcttggcaacatttgagggtagtgaccatgtgtcacttatattcccatagcctagcataaggcctggcttatagtgagaagtctagaaagaattttgtgtaaaaggctaaagatggagtagaaatgaaagatgggcttattgtgaatgttaatttttaaggattacttaaaaactatcaacagaagttttctaaggagaaatataaatttatgaggtatcaaaaagaatacaacagatcctatacttttctttatcttttactttatatatacccatttactcttatcccacatacccactcaccccacaccatatttgtaacttagaagctcagtgaaaactaacttcaaatggtagaaggaatacatttagagtcaaaaataaatatctctttcacctctgcctgacccccagttctctagagaaaaacacctaaagatgttttatacatctaccagcatatggatttgtaacattactatcttctccagttaatagtgaataatattaatcatgcagtttaacctagtattttctcaaacagctcacggcagaatcaactggaaggcataaaatattctcaaatgctatactttgacattcaacctcagtaagtctctagacggcgaaaaccatgcatgtttaaaaggaccaccaggttttttttgtttttgtttttgttttctttttgagatggagtttcactcttgttgcccaggctggagtctcatggtgcaatctcggctcactgcagcctctgtctcctgggttcaagtgattcttgttgcttcagcttcccgagtagctgggattacaggcatgtaccaccacgccctgctaattttttgtatttttagtagagatggggttttgccgtattggccaggctggactcaaactcctggcctcaggtgatccacccacctcagcctcccaatgtgttaggattacaggggtgagccaccacgtccagcttgccaggcattcctgattacagtttgagaacaaccgtttttactaactccttggtttacttttattaaaactatccacatatacaaagttgaatttacttagcagttgttaaaagagaattatttggcctggactatattacagagacttatcatagaaatgcataaaatttatatagtagttccaattttttttttttttttttttttttttttgagactgagtctcgccctgtcgcccaggctggagtgcagtggcgcgatctcagctcactgcaagctccgcttcgtgggttcacgccattctcctgcctcagcctcccgagtagctgggactacaggcacccgccaccatgcccggctaattttttgtgtatttagtagagatggggtttcaccatgttagccaggatggtcttgatctcctgacctcgtgatccgcccatctcggcctcccaaagtgctgggattacaggcatgagccaccgtgcctggccagtagttccaaatttaaaatgacacagatatgaatgatataagaaaaattctagatttttatagaaaattactgctttagagcattttgcccttcagggtcagaatagttcaggactaaatttggttaaaagaataaacactagttaatataagcaacattcagattaattctgatctcttacattgaatccaagattttaagctgccaaatataatttgacaagtctctttaattagtttatgaagttaagctgttgccaagcttctcataggaatcataattcagcccattctctctcatttttctactgaaaaaataaataagcaattcatggaattaagcctcaccttaaccataaaatttaaatctaaacacagctttcataataatgaggatgaatgagaattaaacttatttaaagactttgccagtgcactacctggaaatacagagtaaaccatgatatgatacattctcatagcaaagtggattccagtacggtcaagaaaagttaatccatggtgaagtatcctgccttgcccttgtgttcatccctcatttgaaatgaaaataaatgccgttcaggaaaggcccttgttatcatcaacctctcccgtgttgttactgctgctagaaaagctatttctctagttttcagctggactaggaaaacatagagtttttttttcttttataccaaccatttgtaattgctatttttattgtgtatcaatttattagaaatgacacaacacaggaacagcccaaatggaaaggatgcataaagcgaaggggagggacagaccacaaagctcccatgcagctctacgtgttcaccagcccagaagctctacgcattgctttaaaaataacatcattgtctgtaatacaactccacaggaatacaagacaaatgtgcaacaaatataaagagatcaatagactgattctagaagtcactagtacagtttcatgtctatatgtaacccatgtataaaacatggtatggaaaacattatatgtatatgaaatatttgcttattaaggtgaattctgagcccatggatatctttcttacttgaagtgtgttccttctgatggtgatggcaactttctctgtaggagtaactgaacaacatgcattccagtggcaaggagtctcaggcagaggatgctttctatgaggatcagcctctctaacctcttttatgtttggaagacagtagcttcgtggctgcattgctgatacctacagtagaccccagcagactgactgccagaccaggagcctatgctgtctcattgtgaaaaaaaaatttgagcatttaaataacctatggtcagtaggatatacatttgagcaatggctttttcagtactgttacttgaaaattatggaaaataggacctgctgagtcaatttcagaggattttcataagaattaaattaagtaatgaatgtgtgagagctttcaaaattatagcacactttaaaaaaatgcaaattatcattattgttggaagaccacttgatggaggcatgaaaggatgagaagtttccctggatacctcaaaataataagagccatcatggcaaacccacagccaacatcataatgaatggacaaaagctagaagcattcccccttgaaaactagcacaagaaaagaatgttctctgtcatcactcctattcaacatagaattgaaaatcttagtcagagctatcaggcaagagaaagaaataaagggcatccgaatagaaagagaggaagtcaaactatccctgtttgcagaccacatgattctatatctagaaaatcccatagtctcaaccccaaagctcattaagctgataaacaactttgggaaagtttcagcatataaaatcaatgtacaaaaatcactagcattcttacacaccaacaacatccaagctgagagccaaatcaggaatgcaatctcattcacaattgccacagaatgaataaaagacctaggaatacaggcagccagggaggtgaaagatatctacaaggagaactacgaaatgctgctcaaagaaatcacagatgacacaaacaaatagaaaaacattcctactaggaagaatcaatattgttaaagtagccatactggccgaagcaatttatagattcaatgctattcctatcaaactaccaaggatattcttcacagatgagaaaaaactattttgaaattcatatgaaaccaaagaatagcccaggaaatcctaagcaaaaagagcaaagctggaggcatagactacccaacttcaaactatactatggggctacagaaaccaaaacagcatggtaatggtacaaaacagatatttagaccaacttaatagaatagagagtccagaaataagactgcccacacacctacaaccatctgatcttggacaaagctgacaaaaacaggcagtgcagaaaggactccttattcaaaaaatggtgctgggataactggctagccatgtgcagaagattgaaactggacaccttccttacaccatacacaaaaattaactcaagatggatcaaagacttaaagaaaaaaccccagactataaaaaccctggaagaaaacctaggcaataccattttggacatatgaacgggcaaagatttcatgataaagacatcaaaagcaattgcgacaaaagcaaatgggatctaactaaactaaacagcatctgcatagcaaaacaaactaagaacagaataaacagataacctacagaaggggagaaaatttttccaaactctgcatctgactaagctctaatatccaccatctacaaggaacttaagcaaatctacaagaaaaaataaaacaaacaaccccatataaaaataggcaaaggacatgaacagacacttttccaaacaagacatacatgtagccaacacacttatttaaaaaagcttaacatcactgattattagagaaatgaaaatcaaaaccccaacgagatactgtcttgcaccagtcagaatagctattattaaaaactcaaaaaataacaggtgctgctgaggttgaggagaaaaagaaatgcttatacactattgggtgggagtgtaaattagtgcaagtattatggaaagcagtgtgacaattcctcaaagaagtaagaggagaactgtcattcaactcagcaattccattactgggtaaatactcaaaggaatataaattgttctattgtaaagatagatgcacgtgtatgttcattgcaacactattcacaatagcaaagacatggaatcaacctaaatgcccatcaatggtatactagataaagtaactatggtacatatacaccatggaatactatgcagccataaaaagaatgagataatttcctttgcaagaacatggatggggctagaggccattatccttagcaaactcattcagaaacagaaagccaaatccagcatgttctcacttacaagtggaagttaaatgaggagaacacatggacttatagaggggcacaacagacactggcgcctactggagggtggaggttgggaggagggtgaggaccaggaaaaatagttaatgggtactaggcttagtacctgggtgacaaggaatctgtacaacaaatctccatgacacaagtttatctataataacaaatctgtacatgtatccctgaacttaaaagtttaaaaaaatctaccaatggatgtccaaattagtatgcgaaagtttgaggagaaacaaaataatttcatagtctcaaaatatctccttcaagatatttactaattataaaaggaaaaagtgtaactttacaggggagaaagccagcagacaccaccttaaccaaatgatcaaggttaattatcaccagtaataagacatactgacatgatgtactccctgatatataggctgagaaggttatatcactgtagcatgcctgccaaaaatgcataacttcaatccaataatgagaaaacatcaatccaaccccaactggcagttattctgcaatataactgactagtattctttaaaagtggcaaggtcatgaaagacaagaaaagactgagggaatgtcatagattggaggagccaaaggagatatggcagctaaatataaggtgagatccaattagtaaaagaactggtgaagttccaattaggcctgtttaatagtaattaatagcagtaataataacattaatagcacaaatgttaatttcatggttttgatcactgtactatggttatgtaagatgttaccttaacattcagggaagccaagcaatgtgtagatgagtgctctctgcatgttttttctaactcttctgtaagtcaaaatttgtatcaaaataaaaagtcaaaaactaacaaaacaaacaaataaaatgaaggatgagcaggttctttgctgtgttctctctcttcgatgttgacaataccttgcatctcatcactaaatatagattcctggaatcagcctctctctcactccccacatcaactagcatttgcatttgttcctttttttttctaaataattcttgaatctgtactttctggtctttctctattgtcatcctgatccagattctcataaaatagcttacaactgggatacctaactccattcttatatccctgaaatctgtcctgtctaaatagctgaaagaatatataataaaaatgaataattgtggccatttccttcttcaatgcatttcagtttcctgctcatgtcacgcttctcagcataacaaataacatcctctacagtgtgacccttccctgttctcaagctcctttgtcacattctctgtcttccacttatgctctggcaatacctaactacttcttcatctctaccatgacatgctattttgtatctctgagtctttttgtcacgctgtctcactgacctagagagcactttccatcacctcctccgtcaattcttagaggtagtaaacatcatccaggtagtttttcttgatgacatccgctctcaacccatttcacattctccagggcttctataaaactgcaggtttatttatattcatgaactttctatatttttaaaaatttattaatttatgtgtctatctcttctagatggggaagttcttgaaagcaaggtctatgtcatagtatgttcctatatgccagacacatagaaaaactcaataaatacttataaagcatgagaaagaaagtggtgggaaaagggatatgataaaccttatataaatgtaaagaaaaagaaatgactgagagatggaagaagcaagtaatttgtaaaatgaggttaaaatgaagggaaaggataattgatgagatttagataaagagggtcatatctaaaagataaatgttgaatggagaaatagaagtagtattaaaaaaaaatgagaatacagccaggcgcagcagctcatgcctctaatcccagcactttgggaggccgaggcgggtggatcacttgacgtcaggagttcgagaccagcctgcccaatatggtgaaatcttgtctctagtagaaataaaaaaattagccaggtgtggtggtgcatgcctgtaatcacagttacatggcaggctgaggcaagagaattgcttgaacccaggaggcggaggttgcagtgagccgagatcgctctattgtactccagcctgggtgactgagcgagactctgtctcaaaaaaaaaaaaaaaaaaaaaaaaaaaaaagaaaataaaaataatgagaataagtggattggagaacaggactattagagaataagataagaggagtagactatggaaataaaaggatgaaattgaccatctaattacattgaggccagagaagtagaagaaaataaaacagaaggtgtgttgacaagtaatctccatggaaagcagtaaacataaggtagctatccgggtaatgaaaaaaaaaaaaaaaaaaaagagagagagagaagagaaatctcagagtagttacaaaaagataaatgatttaatggcaatgctaagaaaaggacatgtgggggaaaaacacgaaaaagaaagtacaaaaatgtgacttggaagtatattggaagattgtcttaaatattgaacgctttgaaataatggatgcacattgaaccccaaattagcaattccactggcaatgtagtcattaagagagcactgtggagttactcatgtctttttttaggttaattttattatactttgtagctatattaaatgagttttgcccttatccagagcaattgcaattcagtatctgtcttttgctataacaaatgagccagatttgaaatatatactgtccttttctgtcaatgcactttaaaagactaccagtccccactgacctcttacagtgtatgattatacgaagagaaaaaatggaagaaaagcaccatgggcaaatgtcctgaatgctgtcagagcaggtgacacttatgtgatatgactcaacttgacatctctcagtattccattacaaatctgagagattatgttttcacctgtggaccgcagttgcctcaggtgcccagatactatccctgttcttcagcagaggtcagccaatactcactgttaaacaccagtcaaacacatggcagccagctggcaaactgacgctcctgaaatcttgaatctgccttttctaatattattttgtaggaggcatacctcaagggacatcaagatgttagttaattagggtgtgcctaaaaatgtaataggactatgctgtgtgtgtgtgtgtgtgtgtgtgtgtgtgtgtgtgtgtttgtgtgtgtctgtgtttgagatggagtctcactatgtcacccaagctagagtgcagtggtgcgatattggctcactgcaacctcccctcccaggttcaagcgattctactgactcagcctcccaagtagttgggactataggtgcatgccaccatgcccggctaattgcatctttagtacagacggagtttcgccatgtttgccaggctggcctcaaacttgtgaccttaggtgatctaccgccttggcctcccaaggtgctgggattacaggcatgagccactgtgcccggccttccattttttatccagaaaaatcaaaagcaaaccaaacaaatgtttatatttatccagaaaaatcaaaagcaaatcaaacaaatgcttatatttatttaaaacaacaccctttaatgtttgtttatcttgatttttttttttttagaaatttcttctcatttctggcaatgcagaatataatctcctcctctccgtacatgacccacatcactgaaactgcactttgccttttggctctcttctaatattatcccgccatgaattagctatctatgatgactattctatgctgtttttttggccaaaatgtttttatcctttttctgtcatcagctgttgactataaactttttcatcgtccagctatggcattatgtgggtttgccccatattctaagttttgtgggattctgtaaagaattttaaattccacaccagctctgcgctatggtttttctcctgtctgtttacattctgttttagagaatttgaagtaatttgaaaataacaatcaccatttattgtgtcgtcactctgtaccatacattttatatgcattattatataatcatcacagcaaacctatcatggatcttctttcctcattttaataatgacaaaattggaattgagaaagagtaattgatttgtccataccacagttagcctctaatgacaatctcaggattcaatagtggtgtgtgttggattccaaagccaacactcaatgagaaacactagaaaaacaaacagtagcactctggcattttccactatgcatggtacttttatatatgccagggaagattcaatgacagagataatctgatgggaggagaaacaacaacaactacaaatattacacacttagagttgctggggacattgttcatcacaattagagcagattttagagagcatcctatttactctgaacctaaagaaacaactcaaaaaccaaactactctatactgggaggaaatgacatttgcttccaatagacactcctgccacagtgctaggttttatctacctaaaccttaaaatattgtgtctcttttgctttctgttcaaataacataccctgaaaacttattgtgagactacatcctctgccccttaattgtccttaaaatgtagaacataggtgaaaacagactaaacaaaaatgttactgattgttataacattaaaatattctatgtagaaatatatttatttactttgattttggtatctctagtggcatcctaatggaaacttctttttaataatagaaggtgctctaactcctgcttaaaagtggaataaaaaaagaaagtgttcattgctttaaccctgttgctactatgtatttccaccctagagcagataagaatattgtggtagaaattcaaagctaaatttcctttttggttatattgaagaactactgaaaatatgagtattcctttttttcttctaggctactaagctctaatctggaaacaaaaccaaccaaccaaacaaataaaactgaggaaactacagctgtattcttcatagataagggatttcatggaacacctatacaatattctcattgccaggcctataatgatgatgttttatcttttattaagtttatctaagaggtatgtgtaatgtacaagaaagttttaaagagggagtggccaagatggccgactagatgcagctggtgtgcatggctgtcagggagaagaatgaaaggggtgagtaatacaatgccctcaactgaaacatccagttactcactggatgattacaactaatcaaggaaacaacttgacccacagagaacaaagaagggcaagacaggacaactgcccacctgggaacaacacagagcaaggagaacctcccccacccagagaagtggtgagtgaatgagctgccccaggaaaccatgcttctgcacagatctttgtaaccttcaggtcaggagatctccttgtgaacccattgtaccagggccttcagtctgacagacagagacacttggagtcttggaagagcagctgctcagccatatgtggagaccctggagccttagatacttgggctttccagcaaaagtagctgcaggtccagcaaagtgggaggttagacccccatacatacaatataccagaatctctgagacacagctaaggaagtgttaagagggaaattcatagcactaaatggccacatcaaaatttagaaaaatcttaaattaacaacctaatctcacaactgaaaaaattagagaagcaaaaacagataaaccccaaagctagcagaagataagaaataactaatatcagaagttaaatgaaggaaatcaagacacgcaaaaaattcaaaagatcaatgaatacaggaattggttttttgaaaaaaataataagatagataggctattatacctagacaaataaggaagaaaagagagaatatccaaataaacacaactataagtgataaggtaatgttattattggccccacagaaataaaaagaaccaaaaagaaccatcagaaactactacaaacatctctaggcacacaaactagaaaatctagaagagatgggtaaattcttggacacatacaccctcccaagactgacccagaaagaaattgattacctgaacaggtcaacaaggagctacaaaattaactcggtaataaatagcctaccaaccaaaaaaagcccaggacctgatggaaacacagccgaattctactagatgtacaaagaagagctggtaccattcctactgaaactattctataaaatggaggaggagggactcttccctaactccttctataaggccagcatcatcttgacaccaaatcctggcagagacccacacacaaaagaaaacttcaggccaatgtccttgatgaacattgatgaaaaaatcctcaacaaaatacttgcaaactcagttcagcagcatgtcgaaagactaatccactatgattaagtaggcttcatccctgggatgcaaggttggttcaacacacacaaatcaataaatgtgattcatcacataaacggaactaaaaacaaaaaccacatgaatatctcaatagatgaagaaaaggcttttgataaaattcaacaccctttcatgttaaaaactctccataaaccagatattgaaggaacctacctcaaaataataagagccatctatgacaaatccatagccaacattttactaaatgggcaaaagctggaagcattccccttgaaaaccagcacaagacaaatatgccctctctcatctcttctattcaaaatagtattgaaagtcatacccagagctatctggcaagagagacaaataaagggcacccaaataggaagagaggaagtcaaactatttctatttgtagactacatgattctatatctagaaaaccccaaagtgtcagcccaaaatctcctccagctgataccttcggcaaagttgcagtatataaaatcaatgtacaaaaatcgctagcattcctatacacccacaatagccaaaccgagacccaaatcagcaaggcaatctcattcacaattgccacaaaaagaataaaatacctaggaatacagctaaccagggaggtgaaagatctctacaaggagaattacaaaagctgcttaaagaaatcagagaagacacaacaaatggaaaaacatcccatgcttgtggacagaaagaatcaacattattaaaatggttataccatccaaggcaatttacagattcaatgctgttcctattaaactaccaagcacattcttcacagaactagaaaaaaaactattttaaaatttatatggaaccaaaaagagtctgaatagccaaggcaatcctaagcaaaaagagcaaagctggaggcatgatgttacctgacttcaaactatactacaaggctacattaatcaaaaatgcatggtactggtacagaaaccgacaaatagaccaatggaccagaatagagagcccagaaataaagctgcacatctacaaccatctgatctttgacaaagctgacaaaaataagcaatgggggaatgactccctattcaatgaatggtgctgtgataacaggctagccaggttcagaagattgaagccggacctcttccttataccacatacaaaaatcaactcaaggctcagcgcggtggctcacgcctataatcccagcactttgggaggctgagacgggcggatcacgaggtcaggagatcaagaccatcctggctaacacggcgaaaccccatctctactaaaaatacaaaaaaattagccaggcgtgctggtgggtgcctgtagtcccagctactcgggaggctgaagcaggagaatggcatgaacctgggaggcagagcttgcagtgagccaagatcgtgccactgcactccagtctgggcggcagagcgagactccatctcaaaaaaaacagaaaacaaaaatcaactcaagatggattaaagacttaaatgtaaaacccaaaaattataaaaaccctggaagaaaacctaggcaataccattctggacatacaaacaggcaaagatttcatgatgaagacaccaaaagcaattgcaacaaaagcaaaaattgacaagtgggaactaattaaaattaagatattctacacagcaaaaaaaaactcttaacagggtaaacaaacaacctaaagaatggcagaaaacttttgcaaactatacatctgacaaaggtccaatatccagcatctataaggaacttaaacaaatttacaagagaaaaacaacctcattaaaaagtgggcaaaagatatgaacagacacttctcaaaagaagacacatatctggccaataagcatatgaaaacaagtacaacatcactgatcattagagaaatgcaaattgaaaccacaatgagatacaatctcataccagttagaatagctattattaaaaagtcaaaaaataacagatgcttgcaaggttgcagaaaaaagggaacacttatacacagttagtgggagtgtaaattagttcaaccattgtggaaagcagtatggcaattcctccaagagctaaaagcaaaactaccattcggctcagcaatcctattactgggtaaatacccagaggaatagaaatcattctatcataaagacacatgcacacaaatgttcattgcagcactatttacagtcgcaaagacatggcatggaatcaacctaaatgcccatcagtgacagactggatagagaaaatgtggtacatacataatacgtcatactatgaagcaataaaaaagaatgagagcatgtcttttatgggaacatggatggagctggaggttattatccttagcaaactgatgcagaaacagaaaaccaaataccacatgttcttacttataagtgggagttaaatggtaagaacttttgagcacaaagaagaaaacaaaatacattagcatctacttgagggggaagggtgggaggaggagaggagcagaaaagataactattgggtactgggcttaatacctgggtgatgaaataatacgtacaacaaacccgtgtaaatgtatttgcctatgtaacaaaccttcacttttacacccaaacttaaaataaaagatttttaaggccaaaaaagtgtataggaaccacacacacaaaaaagagagaaatgtttaacaatttatgaatggccaaattagtatttggtattacaatatattatatttcaaaataaagactaatatctaacctgtagattcattttcttctcttttcacatagcctaccctgagaagctctttggctctcaaagctttaataattatgcctctgagaataattcccaaatttggatgtataatgaatattctcctgaaccctagctgctcttttcaacaggaagtcagatattttcacatgctcatttttttctgaaatccaaaatatctgattttgaactctctatcatcctcagaattatctttttcctttaattcacatttcagtaaaaaaaaaaatagcaccaatatttttctcgattatccatgcacaacacattagagtcattttaaaatacttgacatcctcatgcattttttttttttcctttagcaagagagggagtcttgctctgctgcccaggctggagtgcagtggtagatcatagcttactttagcctcaagctcctgggcttgatcaagtgatcatcctgcctcagcctcttcactagctgggacgacaggctagggccactatgtccggctccttagatttttataatattaagttttgattccaatcctttcatgatgtgttcccaattcacaccatgttatctcctgcttcttttcttctaactgtgccctacattccatattccttctctggggaatgctgcttccactttcccacctaggaagctactcatcctatcagattgagctcaaatagttcttcctttatgaattcttcattaatccacaggacataggctgctcacttcttttctgggttcccatttcttactttttttttttaagagatggggtcttgttctttcgcccagatgggagtacagtggtggaattagagctcactgcagcctggaacttctgggctcaagtgatcctctcgcctaagcctcctgagtagctaggactacaggtgtgggctaccatgcccagctaatatttcctttttatttttgtggtgggagggaaaagtgagggtgtggggtctctctttgttgcccagactggtcttgagcccttggcctcaagcatcctcccatcttagcctcccaaagtgctgagaatagaggcctgagccactgcacccaacctggattcttatttattacatttattattcctctaatttctgtaagtcctcaaggacagaaattgagtccaaattcagattttgttttttacgtgaagaccataatcctgtgtataatacatgatcatgaaatattttttaaatgcatgcatgaatgaatgagcacatgaatgaacaaataagtgaatgaatctttgacttctttattcagtttcctggacttcgttccactgccttttgtttttccttcaacctacttacttgcaaaataattccccaggtaattttagtatctgcttaaactgaaaagccaaggctttcatgaaatatcttgtatgaaataattcagcttatttttctagttcacaatatgttggcaaacttcaaaaacatttagtgatttccaaacagttacattaagctatctgaagatagttttgaatgaattctctacaagtgaggataaattgtaataaacaaaaatacttttaatgttcaaaggacaaaatattatatttagtgttctcattcctacaaatcacttgtttccacttttattcctatttttcttgcagactatcaattctatcagttcagaaacatgatagaaccctttcctaacatcttaggtctcccttgtgggatataagaaatattctcctgcagataataattagattgataggtttcagggtgttttcctaagggaaactcagaagttatttcttctaaaacatttaacagcccaaaatatctaattcaaaattcttaatgttttggccccacaataatgaaattgtgagtctttctttttttgttattatagatagaaaaaaatttgaagccagtaaaaattccataaattggcacatgatatgaatgctatattgatgggaaagtctagataagtaaatataatgatttgaaagcacagagtaagctcccatggagaaagtatactaaagggccattttgccattatatgaacaaacagaaggcattcttacattttaagtgccatgataattacaatgagaatgataactaatatttgtatagttgcacccaattgaccagtgaaatcatgcagaaaggacctggctaatgagcctgtaacagccaaggtataggcactgagataaattcttatccataattaggaaatgtggtcacaaaatacaaatatcaaagattgcctttgaggtgagtacttacttgaaatgaaggatggggaaggcagaggaaaatatctgtactcaaggtaaagcattcgaggtcaaagacttagagaaagtaaaagaaatgtttactagagagggtcaagttctctctcagtgtgtgcatgttgtacgttgtttaaattaaaagtgtcttaagcaattacatttcagagtagcaaaaatttactgtctctgtttctctgaggatccctccctctataacatttcctagtacaaatacctgagcactagcgaaaaatgggtgagttccacaatctgaagaccaaacaaaggacaaaaaaagtctgtggtaggattgaggcagggttgagattttgtgtcatatggacatgagagacggagagatcaaaattttcatgagagagtagttaaaatatgggcaaagcattctttctgaataagaaaataaataaagaattaagtatctaaataagtttggagagaatgacaaaatctaaaatgagacatgacgaggttgaggataaggtattacaattttttttggagagagacagaagttgaaatttaaaatttcatttctgaaaaaaattctatgcatagaatatattcattaaagtactgtagaagaccaaataaatccaaactactctaactaagagttcttgaaacagacagcgagaataaggctgacaaaaatagttatattcacaaaggtgcatccattgaactatcttactgtgtttttttaaaccaggtacttttaaactcattggactattggtttagaatacacattatcagagatcacctttttctataaaaataactattttatttttgtttttaaatatcagattaattcaatattgtttttataactacctaccaatcaccatctcaaagaaatgatattcagttaaatttcttttcttaggatgtttttcacacatttttacatttttaattttattttttaaactttgttttgtttatttttaaattttgtgggtacatagtagatgtgtatatttatggcatacatgacatattttcatatgggcatgcgatgtgaaataaacgcatcatggagcatggggtatccatcctttgagttacaaacaatccaattatactcttcattttaaaatgtacaattaagttattattgactatagtcaccctattgtgctatcaaatagtaggtcttattcattctttctatttttgtacccattaaccatctccaactcccttaatttttaattattatgaatacataatagttgtacacattatgaggtacatgtgatattttgatacaagcatataacatataatgattaaataagggtggctgtggtatctaatatttatcttttttgtgttaggaatattttaattctactcctttagttattttgaaatgtacaataaattattgtttactatagtttccctattgtgctaccaaatgccagatcttattccttttacccaactatatgtttgtacccattaaccacatctcatttttctcttaactttcatggtttattattattattgttatcgttgttgccacctattaatgagaacatgtgatatttgtctttctgtgcctggcttatttcacttaacgtaatatcttacatttctatccatgttgttgcaaatgacaggatttcattctttttattgttgaataatattccattgtgtatatgtaccacaatttctttatccatttatcctttgatggatacataattttattccatttcttggctattgtgaataatgctgcaataaaagtgggagtgcaaatatctccttgatatgctgatttccttccctttggatgtatatccagcagtgggattgatggatcacatggaagttctaattttagattttgagtaacctctatactgttctccacagtggctgcactaatttgtattcacgccaatagtgtacaagagtttccctttttccacattctcatcagcatttgttactgcttgtcttttggataaaagccattttaactggggtgaggtgacctcaaggtagttttaatttgcatttctctgataattagtgatatggagcatcttttcatataccagtttgccatttgtatgtatccttttgagaaatgtctatgcagatcttttgtacatttttgattggattgttcttttcctattgagttgttcaagctgcttataaattctggctattaatctcttgtcagatgggtcattggcaaatatttttttccatcccgtgggttggcttttcactttgttgatgatttcctttgctgtgcagaagaagctttttactttgatgtgatcccatttgtccatttattttctttggttgcctgtgcttttgaggtcttactcaagaaatctttactcagaccaatgtcctgaagtttttccccaatgttttcttctagtagtttcacagtttgcagtcttagctttaagtctttaattcatttaggtttttgtatatagtgagagatagaggtctagtttcattcttctgcaaatggatatccagctttcccagcaccatttattgaagatactctccttttcccaatgtattttcttggcatttttatccaaaatgagttgactataaatgagtgggtttatttctgggttctctattcttttccattggtctgtgtgtctgtttttatgccagtatcatgctgtttggggtactatagctttgtagtataaatttaagtcaggtaatgtgacgtctccagcttcagtctttttctcaggattgctttggctattatgggtcttttgtggttccatatacattttaggattactttttctgtttctgtgaagaatgtcattggtattttgacacagattgcatggaatttgtagactgctttgggtagtatgaacattttaacaatattgattcttctcatccatgaacatgaaatatatggccatttttgtgtccccttcaatttctttcatcaatgttttacagttttattgtacagatatttcacttctttggttaattcctgggtattttattttatttgtggctattgtaatgggattactttcttggtttctttttttcagactgcttgctgttgttatatagaaatgctactggtttttatacattaattttgtagcctgaaactttactgaatttatcagatccagtaacttttgggatagtctttagtttttttaagataaaaaatcggccgggcgtgatggcttacgcctgtaataccagcacttcgggaggccgaggcaggcagatcatgaggtcaggagtttgagaccagcctgactaacatggtgaaaccccatctctactaaaaatacagaaattagctgggtatggtggtatgcacctgtaatcccagttactcaggaggctgaagcaggagaatcgcttgaacctgggagacagaggttgtagtgagccaaggtcacaccactgcactccagcctgggcgacagagcgagactccatctcaaaaaaaaaaaaaaaaaaaaaagatataaaatcatatcatctgcaagcaaggataatttgactcatttcttttcaatttgaatgacttttatttctttctcttgtctaattgctctggctaggacttctagtattatgttcaataaaagtggtgaaagtgggaatccttgtcttatttcagctgttaaaggagaggctttcaggttttccccattcagtgtgatgctagctgtgggtttgttatatatagcgtttatcttattgagatatttttcattttgaggacaaatacatacttgttgagggtttttaccatgaagggatgttgaatgttatcagattttttttaagaatcttttgaaataattgtatggtttgcatccttcattctgttggtatgatgtatcacacttattgatttgcatatgttgaaccactgttgcatttctggaatgaatccctctcaatgatgatgaatgtactttttaatgtgttgtgaattctgtttgctagtattttgttgagtattttttttatcatgttcatcagaggtattggcctgtcattttcctcttctgctgtcttttcatctggttttggtattaggataatactagcctcatagaatgagttaggaagtactccctcctcctcacattttagaaataatttcagtaggattgacattatttatttttaaattgtttggtagaacccaacagtgaagccatcagcttttagccatttcttttatgggagacttctgttaatatctcaatacttgttatttgtctattcaggttttggatttcttcagcattcaatcttggtacttgcatatggttaggaactcctccatttcttctaggttttccactttgttggcagagagattaaatgtataaatgaacaatggccagaatttatatgacagtagagctttgaccataacctctgcagcaaccagtcctggaaattaaaccacagcttatgtagcaatagacccagaatggacatgatttggtcaatgacagccaacttacctatatttgccaaagctttcaattcagtaagaatcagagaaagccaaatatacccctcaaacccatctcataaaatgtcctgctcctatttagtctacctgaaacttctctacctcaacagtatcccatcagaaaatactagaaatctcctttttaaagctttccttttccctgcctgtttttgagactctgcccaaagcaagtgatggtagctgattcctctgtaaggtctgaatagtaaagtctggatgagcagtccctgtatgttctcattctgtttattcccacatttttgtattaatataatttaactataacacctaaaatctctgaagattcacacgatacagaaccggtctgccacttaggaactaaaatagccatttcactaaattttctgacaaatttactacagagtttagaaattgaaattgagatttcaggtaaaagcatttatgccttcccagttaattttaataaacaattactaagatcttatttaagctgaatgtttgctcattacttatcatgattagcaatcatcctgtacatttttatcatgtaaaagtaactgacagataaaatcagtctcctttatattaaagcatttctcatcagcattactaaatagtttctagtgattcaagactacataaagtaaaataaatggattatttacagggagaatatttatgggaaaggcaatgattattgcttataattactctaacacactatccaataggaaaaaaagtaagccatcattctggagcacagcaaaaaataatttttccttccagatataattatttcaaacatataatgaatgttttcttaaaagtataagctgaaaagccaggcatgtttttcaaaattgtaaataatcctcttatcccatattttatatttcaattatttgttagatatttgtgtatatttaccacacatatgagaaagagaattcagtagtcttatcaagtaatgtaaaaaatggacttctctgcctttacagtttaaatcataagacatagactgtttctaaatggggaaaacataaaacttaccaatatttctaattccctttgctgtgtgtgctacaatatttaaattgctattgtcattaacacattatattagaatataaatgtttcacctcagaaagcaaaacgagtcatgtgcaaagagatttcttatttaatgaacaaaaagatatgagccatagaacatacagatttcacatactccaactatgctttcagaaagatttaattctgaaaccctagcagaagtgaggccaggtgagtttcctccctccctcgcttcattttctattccatctctcagggttgtatcttagaaaagacagcgggggcagaaatgctttgtaaatgcaagcttgtttccagtgggaagtatgcacagggtacaaaataagttcaaccccacctcccaacctagttcttcatccaccatccctctgaagctgtgcatcccaaggattctttttgatgatgaatgcaacattatttctacatggctatttttgagtgttgctttggtttcccttctgtttgacagattttaaaacatctcccccattgtccagtcagatcttaggctctcctggacatgaggaaagctgagagctcagtgcttccaaacaaaccctatttgatccacatattcctccatgtttttggttaattcttgagtgcaacaggccatgcttaaaatggacagagtaagaaaacacctggctcacttgcagacaagttggcttagttagctggctcatcaaaattctgagaccatgtttagggatattatagaaacataataccagaaggattactggctgtgatattaagtaacaggatgaggtcaggccagcctttttagaaaatgcagcatacatgctttctcttgggtaactaatcaaaactttttagaaagttgtcttcttcccatgtttattatacatatggttagacttgtgttataattgacctttcaagttgtgatgtttcaggggcacctgaataaccttgtgattgaccacatttgtccccagaaggttggcccattaccagacaaatgatgtctattaacaaagaggttttcagctgtataaattatcataccataatttattttttcttactggtaaatattgatcttcatattttcagaggggggagtatcaggaaggaattagccccattttggtaaggaaaattggcatctcatttggctgacaaataacccgttttctgtagctatttctgtccaaagttctcttcagaacatcattctcataaatacagaattgtgtcattgaataaaattaaaatgaagacagctggataatgaaggtcctttccgttcttttattgtctgttcaacaaactaatagacttcattcaacacctgccagagtctcagatgcctgagtataagtagactcaggtataaaaaccttgaaaatctttactttccctatttatatctcagctcctagcaacattctgcattcctttcagagatgaatttctgcaccagctcgtctgctcctaactgttatctttcctttatatctttttctttccctgtctgctttgctgcccatctccttgttctcctcaattcttcttccatgctatcttatgttgctctggctctaaattctccactgtgttcactgtatgtccttaataccaaggacaaggacagtacctaatattcagcagattctcagtgaatgagccaatggaaattctagaaaaatctgtataaatttagtaaaattagtacatatttttcaagtaaaaacacatcacattgtatcttgaaatatacaatttcatgaggatagggatgtcactttggcatatctttgaataaatagttttaagcatgttggtgcttagagcagctttactttcttttaggtattttcaattttattactttaataatattcacactaaaggtggtacactcttaacagtcattatttttgcaaagataatatactggtttgtattatttattcaaggaagagttatgttttgccttttaccccataatttttctgcaacttttaaggaaatgcatcctaggtgatcatagaagatataattaaatatctggaagttatacctagagcctgtcttctgctcacatcagggaaggaatgaaatgggtctcaagtgttatgaaagtcacaaaatgtgggaactgtttaagttcacagtcaagattccgcgtggacagaatttacctaagagggagagcaaaaaacggggccataatttatgaaaaaaataatatctaatctaatatctaactctcataaagagaaaactttcacaaccttaataaaaactaatgggcttccaggttaagatggcaaactgacacatgtatctaattttgctccttttcaagtctcactaaaactatatatgagttatttttgtttatttctaaagacttaaacacactagcacggagagaatggaatggaagataaaataacagcaagaaatattaacaaactcaaaagcagatgacaagtactaaatgacatagccaatcggagaaagtcagagttcaaaccagcaacagggaaaattaagaatcaagtgattttatgcagaaagacttaggtatgattaaacttggggatgaagagagggactgaaaaaggcagtttgatcccatctcctatttcacaccactgaatatctacccccacctcagcccagcataattccagatattattctctgaagaggataaaatggtctttgcattgtgggtctttagacttattttaggggtggggtacattttatgaacaacagggtgattaaatgaatgtgtgaatactcaatgctaagtgtcaaggtcccagtcaccccatcctctaccactctgctcctagttccttaccttctaggaagaaatttgaaagatgtttttctgggaaagaaagtgattagtacaagaagaaatacttgctttcctctagaaagttttaaatcctttactctgattctagaaaataccagaagatgtataaaaggaatgctgggttgttagaagatgccaccttctcaatgttaacaatgtaacacagtttatgtgactgtaggaatggcccttcaccaaggagaaatcatgttttcaaatcataaagcctgacttctctgcccttgaataaggctatcacaaggggaacagagatgccttgctgcatttgtaactgtgcacaaatgactagagtagaacttgctccacatcttcagtttaggctggaaggtcaaggttcatgtgccaatactcagaaatggctacatcaagttttatgtaagtaattttttcacactgctgatacagtactttctatgagtttattgtgtttgaattagtctataccagactttctccaaagcgcatctaattatgagtctccaactgtggccggatccatatgggtggtctctgctacagtgccacgcataaatgcctgtccctcttctcacttatcatttccattatgcccctaccatgatcataatccttcagttgttacgtatctcctacttcataaaaagaaaaactgtcaattttctaaggccttttataacctatcactttcttcatgcccatcttaatttccttctttttcatattttttttcttagagcccctaaatggacgtgactcattcctacctgctggcctccattctcatgaactttctcacatacatcatcaccttccatgactcaaccccacacctcattcaaaatcgaatacaaatttcatttgttcatactttttcttctgtgcttattctccacaaactctctctcttccaaaatcctaacagattgaacatttaacagtttaacaacacataacataattattgttatctctgatgtgtcaatttgtttcttccttgaggaaagaactgattgggtcttatcctgtgtttagcacagggtaaagtcttgttgtacaatgggtaggtgcccaaattctgaagtcggaccaacctccattcaaaattaactttgcttgtgtgtccttgggcaatttatctgacctctatttctttattaataaaatggagggtataataatcaatcaaactgtctagaggataaacaagaaaacatgtttttctcaagatacagtacacagtaagcactcatcaaagtttagctatcattatgtcttttattaataaaataatatttgaataaaatgagaaaacagcattttgtggcacttcagaagatataaagcatgagctattttttcttttattatttttaaactatagagctatttaaaatctatatggaggacttcaagtgtactactactaccaccaaatgggggactactagctgataaatactgcactgccagctgtgaccctcactctcacaggtcccactacaaacaagcgaaaaacctgcaatgaaagaaatgtgacaaaggtggaaccaaggaatagcctatatataaaactgctaagtttaaccctcagaaaaacattacggtgtctgagaagaaactcttgaaacagaattgggaataaaatagaagtaaagaacagatttcattcattttaaaacaattggagatttatcacagtttatatgaactgaaatttaggtgactctggattcagttcaagcacaagagattatcagagtctaaaattcaattttactacccttcctttattgcagttcaaacacacaatattcctgttctgtggatgcctttgctagtgatggctatagactgagagaatgttgggctgcttagcttttgtaaaacatgaaatgtgtctattttcaaatgatttgtcactctatggagttatgaatccccttctaacaccccagctacagattaggataccctcaaagccactgatttgtcagaatccttttacaacttgattcagagtatgccaacagtaagatattaattcctttaggagggagacatgtacagagcaggaaaaaatactacaaggaggtctgtaacctcaccatctgtcaagtgacatgctgttatttttccactttggctctactccccaatatcagttcctttctttcccagtgtagacccagtcatttcaatatatccttcttagtagtttcagttctgctcctttccagccaatgactggatacatgtatatatatatatatatatagatatagatatagatagatagatagatagatagatagatctatatatagatttatatatccagttggatatgtatgtataaatctctctctctatatatatatataatatatatatatattcctagtcgattaccttttatatatcaagatctgcttctctatcaaagttgtcactccatgtttgtcttctgaaggcttctcatattccacagatggcattaccccacaaatagaagctgttaggtatttacttctgaaatttctttcactttttttacacattcctttactcttttagagagagatttcttcctctttcccatggttcctagatcaaaagattcctatacgccactatgttaaatgacagatttttaaataattttatttttaaaaaactagtaagcttactaaatctaaatattagaaatactgatattattggtatgatttataatgctattgcttttttatatttaccctaaattttcattttattctcattttctaacttatcttctctacattaattttgtctactgatatggaacatttattctatttaattctattttcattattgtaaagatgtcttggaaatttaaaatgcatataatgcatataattttctatgtagcaaagtatgttaatactttaaacttcttcctgaatataagaatagtaggccatttaactctgatcttcaacccttacacttctcctatgtagtgtggtcacttcaaatagtctttttttgttgtcattgattgtattagtctattttcacactactataaagaattgcccgagactgggtaatttataagaggaagaggtttaattgactcacagttccgcatggctggggagccctcaggaaacttacaatcatgtcagtaggcaaaggagaagcaaggcaccttctttacaaggcgcaggaaagaaaagtgccaagtgaaggcggaagagccccttatgaaaccatcagatctcctgataactcgctcactatcacgtgaacagcatgggggaaactgacgccatgattcaattgccttcacctggtctctcccttgacatgtgggaattatgaggatgataattcaagataagatccggatggggacacaaagcctaaccatattattgatggtgttttaccaagccttctttgaatgtgtcaacaccttttctaatttccttggtgatcattcttttttgcatcttaatttctctttcatggtggcatttctgattatgcaatttgaaattcatcagtttaataggtcacacacttgggatctctatttcttaaagatggcctttatttaaataagaccccccagggaaaagcattcaccgttgatgctccatcaagctggtgtgtgaaaatatctctggttccccttttaaaggtagggctataagcttttctaagagtcttagtcccaggtctccggactatgtgtctcctccaaatgccataagggcattaaaattaaaatcttagtatcaacatttaggatctatatatgggctaacaagcaagcaaagagagtgactttcaagactttcacaaagtaagcttatgcttacttccctgctttttgttcaaattttgtgtttttttgtttattcctggttccttctgaattaaagtagtattttaaaaatctaattaattcagctactacatattaaatatatactaagcatatatacacatgctgttataaattctgggtataaaaaaaggcaaatttcatacattcatacaacttatactctgttatggaaatagaggcaggaaatatgggaaaaaatgaattatttaaaccaaaaagtgataactgctaaaaggaaagtaatatagagtgataatgaaactgatgtacagactagttggggaaagtctttaccctgggtggccaaaaaaggctaatctgattctcagctcattcattcaagctgtgaccagaaggaacagccatgtaaacttatgttggtttaaatggtttttttttgttttgttttgttttgttttcccttctcactaaccatttatctcatttttggctatagctttttattccccttttacaatttcattctgtccctccccatttcctctttcccttcagcctaaaatatattcaaacatccagaagtctcaaaaatcttgtcatgatcattagtctcttttaagttactaccttgagtctctttgttttttgatctgctattctcttacctatctttttaaataaggtttttttccattcaccatttcgtaaagcaaaagtcaacaacaaattgattaaatctactaattgccaaactagtatctttttaatcattatcttcaagtaagaccattgattactcactgaaattctctgcccagcatcctcctttgtatgttacttttcttattaacacttgaatgctctttctttatcagattctattttctctgcccacttcttcaaagcttctgttcctcatggctttacccttcattgttgtcccttctagctctaaatcctgtctataaatacacccacttgaattatttatactattttatggtgagaaagcttaagagtcttctcagtgccacttaccaagttattattattattattttatttatttttatttttttgagacagagtttcgctcttgttgcccaggctgatatgcaatggtgcaatctcggctcaccacaatctccgcatcctgggttcaagtgattctcctgcctcagcttcctgagtagttgggattacaggtgcatgccaccacacacagctaattttgtatttttagtagagacagggtttctctatgttggtcaggctggtctcgaactcccaacctctggtgacctgtccaccttggcctcccaaagtgctgggattacaggcgtgagccaccgcacctagccaccaagatgatattataatataactattatagttcaggtttctttccatatgttgtttttcatataaatgtattgatactttaaatcagcaacaaattatagaaggttaaaagttgtaattaaattatccaaaatccaactactaaaacataatcattatttaaacccatgaaagtttagttttgttcctatacaggcatatacatgtctatgttatatatgtttgtattatataatgcttgtgattatatgtgtggagaaagagagagaaacagagacagagagaaagagagaagcagagacatatacaaacagatttctccgaatctttgcctgcagaaattgaaccatgggccaaaactgaattactttctatatgaagaggaataagaagacatttagaagctatggactagagttggaaaaatggcaagagttaagtgcaaaaaatagaaatagacatttaaagaggtatttttatgaaattccatgtataatacacaataaatttaattttctcactttccaatgaaatcttcactgcacataatctttggaaagtggatttctttcagaagaatacaaagtagaactgaattatattgtaaagagtaagtttggtataaaacaaaacaaagacaaaaatatgcatatgagaatatctatgcatccatatacataatagattataaaatttagactactttcatactatttaaaaaacttgactttattttctatagactcttttcatgtggcaggcaaccatttgtttaatcatcccaatttttctattattttaaataattctatagttatcctgttggggctcagaaaaaaaaaatatacgccaaaatgaaggacttagaagcagcttcagaagcaaaagtttttctctgatttttttctgttctcctgttgctcagttccattttcccctgaggctagtcataaatactagaatccttctccaaggcaggtcacagaagccagaaccccttttccccaaagctagtgataaaacataaaaatattattctaaaacgatctccatctctctgtgtaattgtactagtcatacaataattttcctacctaccttgtttgactataggtcataagacccatattccagcgagggtcttgccccatatccagaaggtagaaatacatgttcagagaagccaagaaaaatctagacagacaggccttgctgggtaccccactcagtctattaacataagatcataccttatttgtcccatcatatttctacatgattgtccatactttattgaacttaagcataaaaataaacaatttatcctgtgtctttgggtcttcattctgaaggctaccatatatacttggtaaataaatttatatgttttttcacctattaatctgccttttgtgagttgatttttcagtaaactttcagaggccaagggtttcctttattcaaaaaagtttggccaggtgcggtgactcatgcctgtaatcccagcactttgggaggctgaggcgggcggatcacgaggtcaggagtttgagaccagccacaccaatatggtgaaactccgtctctactaaaaatacaaaaattagctgggtgtggtgttgtgcgcctgtagtcccagctactcgggaggctgaggcagaagaatcgtttgaaccccaaaggcagaggttgcagtgagccgagatcgtgccactgcactccagcctggatgacagagcgagactccatctcaaaaaaaaataaaaagtttatcactttatattatttcctttggataggttccctgaagtatagtacagatatggatacagatgatgcacgtatgaaaagtttataaagattttcattttacgcatattcccaaattactataaggcttatgtcattagattttcaacacgatgctctgtaccaagcctattttaaaagttttggcaaatttgatagatttaaaatacatcttattctaactattttatttttaatatttttcaaatatttgtctgccataacttttataaggagaaagtggttaataatataaccatattctttgtccattcttccactacaatattaattttttatgtctgcaagtattctttatatataaatgggatcaaatttttgtttatccagttatccatttacatttcaatattgcttaggacattctattgatgtacattttttgaagttcaatttaacaatcctttctttgtaaattattttgtatgtaattttcataaactgtttctcaattttaatatcactgaaagattcatgtacattttctccattaattatgattttaaaattaacagttatttcattactccacctgaaagttattttggggtataaatgaatgtaccaacggtacacagcaccatatacatgaatactacatggtaatacaaatgaaagattttctaagtgtactaggtcagcttcagtgtatccttctgtactgtggcttttataactacaccacgactgaattattttagttgttatagtttgtgtacattagttactagtagggcagccactatatattttattgctttttgactaactctataaaatgacattttaagacaataacaaacatttttattacttctgcaatatgcccacaatgtacatttttttcatggctatcattaagtgattataatttcaaatatatctagttctcatctcagaagcaaaagataccactatcctgattatgctataaatcactataactaaaattacacagctatgaaactcaaccattcagatagctccaataccagcgaatcacttggtttaccaaattctttgtagaagtcacatgctagtatgatacacagagcagatgcctggggaaggggaaggtgagagagtataagtggtgtccaaaccaattccacagaagtttctgagaaacttgccatatttatttatcgatcgaaacctctagaattgtacacctacaactttctaatactatatttgcttttcccctaccacctgatttttggcacttgacactcagagaatcttgaggtttcactaatatgactaatattttcagccattatgaatattacacatcgttttccacataattacctagtgaagtctgtcatctccatcatgatcatacacatgttcttggccagaacaatgatgtcgttgcttgtatcatcccatatctcaatctcagcatccagcttactctttactttcttgaaatcagcaacttgctcagcaatcttttctttttctgcctcaggcagttgagtcatcttagcctaaaacatgtgataattagagttaaaatcattccactatgtcaaaagcattttaggaataagtagatattataggatactcataaaacttgttcatttaaaatcagaggcacaatatagttaaattcattcaattaaaactttccaggcttaatatttcatataaaaatctattaaattataatagtttgctctagaactataatgttacatttagaataacactgtagaacttggtgtccaacatacttaaatccattttataaaataaatgtgggactttgcaaatttctaatacgcttcaaattttaaattaacatcaatttagtgtaatgcatcacctttgttagaaaagtgcgtataaaaaggtggatgtataacataatttaacttgaaatgagactatgtctacctatgtgtatatatgcaattacaggatgaattagtcatgcctcaactttaacataataaagaaaaaacaatgatgcttttagtttgaattttctgtaaatatctcagcataatgcttgacacatattgaatgttccataaatggtagctatttcttattcaataaaattatcaaaatattttcatatgtctaataaattttttcattttgtttgtattttttctatgaagaatcaaattaagctacacaagactaagtttttaactgacacaagtgctatttcttagcctctgaaagtagtttgtagtttcttttctgaggaaatgtgtcctatgtgaggttgtaagagaggagcaacttttactactgctggcatatggcaaagcacgtaaatgaagacacagctcactacttctgaaatgaaaagtaatatgcaagcacgttaagtaaattataagccaccaacccattaaactgactcacgaatagaaatgggttttctccatcttgactaccggtcattatcattctctccattctcataaaaggtgtttaaatgttcaaattacaatagctccagataggttcaactggtgcttctctttacattctgtatctcagaggtcataaatctgtgattctatttattagaataaatagtgctgaatatacactggtatattatggaaaattatttactgttctcataataaagctattcaagagctgaactggttaagtgtattccaagttcagttacttggaatgccactgatttccaatatgaccttgaggaagttacctaaccctcctgtctaagtttccctagacacaaaatgacagtaattgcaactgctatccacctgccatgcagggaacagagtcaattattggataagattgcgactgaccctgttgtggacagggagctcattggttgcacttcatctccttaataacatctcaactcaaatggtgaattacaacagacatttacctctgacaagataagagccaaaagttgggcaatagtttgcaaaattaaaagttctagagaattctggtcctttttctcagggggaacaatagcagcaacaaaacattaagttactgacacctttgcagaaggttttaagtgcttctatgatttattatatgtcatcgatcaatttcaaccacgctgaaaattccaaaggaagacttaagagaatacttgatgtttggaaagtctaggtgaaaaattctttattgaattattttgttcaagttaaacaaagaaactgaggtacaaagcttaagaaaaattaagtaagtagaatatctctgatatatatcgccaggtggctatgtgtttaggtttctgcttacatctatagagcagaactctgatagaaataactgtcaaaggctttttcaatcactgccatctgaataagattatattgtgtaactattgatcttggaatgtgttaccaaacacaagaaacatttaaacttcatagcagccctatgaggaattattattatcccaattttgtaagtgaggaaatcgagtctctctgaaacattaagtgatttatcaagattatagtgtcagtcaatggtagaatcaggatgtaaatcagaaaatatagctctagagtttttgttctatcactaagccaacaaacacgaataatattgcccacaatataccaatatatacacattctccatgatggtatttctctatcgctgtctacctttgaaagcaattgttctccaaagaatagtcacattgtttagaacctaagtttccaaatctttaaattatataccatgatctttacctgacaggctgttttggacatcaaatgatatgcaagaacacactttttgagtaaagtgatgttaactgtcaaccattacttacacaaatagattcagttctttactctctgcagtgaatctcagaactctatttataatattatccattatttttcaatgaaaagctgtgttatcccaattgcctattaggcatttttaagcatagatttcatttactaatttaactctaaaagagaggtcggcagaatttttctataaaggacaagatagtgatatatgctttgcagctcacaccatatcactccgttactcaactggcagagttgttactctgttatattgcaagagcagtcatgaatactacataaacaaatcagtgtgtctctgttccaataacaccttattatagacattgaaatttgaattttacataattttcacatgccacaaatattattctgatcacatctgattacatctattctgaattttttcaaccacttaaaaatgtaaaggccattcttagctcatgtacaaaagcaggcagcaggccagatttgacctgttgactacaatttgccaacacctgctataaaactttcctatgaccagggaacacagatttttattgtttttctctgtcttcattatccttactttgtttgtaactcctgaaagtgctgaccaagtgatgcctgaaacattttcttgtttttgttttgttttgttttaaggcagagtcttgctctgtcacccaggctggagtgcagtggcatgatctcagctcactgccacctctacctcctagattcaagcaattctcccacctcagcctcccaagtagctgggactataggcgcccactactgtgcccagctaatttttgtatatttagtagagacggggtttcaccattttggacaggctggtcttgaactcctgacctcgtgatccactctcttggtttttgccttccccttacatccaactgccccttctcagagtcctccatctccccttatctgccaaacgcgcatctcccaaagaatctgtgctgacccttttaactttcttcattatcttctcccttagcacactcatctactttcttttcttttttacattgggaaataaaattgtaagtacttactatgcaccacattatgttctgaagtgtatataccttgtggaatacataatggaatactattcagccataaaaaagaatgaaatcctgtcatttgtgacaacagggaatctggaggaaattatgttaagtgaaataaccagacactgaatgatgagtaccacatgacctcactcatatgcagaatctaaaaacggtatcacaaaaggagagaatagagtaggggttaccaggagctggggtagtgggggagggggtttgagaagatgttggtcagaggataaaaaatttcatttagacaggaggaataagttcaagaaatctattatacaacatggtgactacagtgaatagtaaattgtattcttgaaacatgctgagtgagtgtaaagtgttctcaccacaaagatgataactgtgtgaggtaatgcatgtgttaattagccaatatagttcttctacagtgtacatataggtcagctacgctactttcatgacttcagccatcactgctatgaagattacttccaaacaacctcttcagtcctgttctcctttccaatactgtgatcagtacattcactgctgttaggaatacctcatcacagaaggatgaaaaacacactcagccaaaccatttatcctcttgattttcatgtttctcagtgatacttcctgccttccagtcttgaagttttatattttagaaaattatcctcttttctttagcctattctgtcagttgtccattttatcctttatcacatccatttccctctatatattaatattaccattcctgctgtcttctggtcttaatattctcctttgttttaaatcttcttgctttgctactgcttgattcaatctttctgaatatgatggaattgtgcaatccttcatctaatctccttatctttacatcaccttatcaaataaagggtatcaattcctcaaacaccaccattatatttgtttgattaaaatagaaaattcatataaaatgcctaaatcataaatgtacagttggaacgattttcacaaacagagcaaatccatgcacctacactcatatcaagaaaccttaaaaagattacagacactcggaagcctccttctatcttctgctagtcactatctcctaagggtaatcactaacttcatttctaaaactgtagatttgcccatgttttaatcttataaaggtgtggaataatagcacatgaattcttgtgtctggctttttgtattcagcacttaagtgcttgaaatgcatctattctgttgcatgtagttatattttgtttattctcattgctctatacagatattattccactctacaaatatatatatatatatttctataaatttattcatgtttttctataaacaatattttgaaaactattccgtttttggctatgataaataatgagtattcttggacttttctttaggtgcacatatgggtgtatttctcttgagtatgtatctaggaatggaattagtacatcacagggatcatcataacctttgtttctaccagcttttcaatctcatcccatcttacttccttcaacacactgtaccctcaagctaagctaagctatttgttgctgcaggtaaatatcttgagatattgcccattaattatttttgctcatcttcccttcccccaatttgttggtccaaatttaatcatatttccaggccagactcatatagtatatgcccctttctccattcttcaagtgtgtgtaattattctctcaaaatttttagaacatgttgtcagttcttccccctagatgttcatattgttctctcttgtagtctaatcttgtgaacacaactatcttatctcacttactagagatgttgttgaaaacaatatcatctttcagaataataattatgacattacacataatttttcatttgtactttttagatgtatttttttctccttcccctagaaaataagtcctcttaaagtaggaacatattgcatgataaatgtttgtttgtgattgttaacagaaatactcaagagctaaaaaaaactcaagacttttgagctcaaaattttatatcactgatcttgtattttcattgtcaaccacatttacacaaatgccaagcttttgcctctacacagatcttagattcatttctcttatgcacttttcctagtatttttcaaactcaggtccttattattcctccaagactgtattaatagcacaattgatcgtttttcatcttcatatctgcttattaattgtactatgctcattactactgcatcaaatattgatatgcttacattatttatctgcttaaaaaatttaaatgactataattaccccttaaaagagacaaaaggaaaagaaaggaaaaaagtgacataataggaaaaatgcagaaattgttgtcatacagaccaccattcaaattccactttggccaagtattagttatacagcaattaacaatcctaaaccccagtttcatatgttaaatgataataaatttataggagttgtgtgagaattagttatgactataaacaattgtacctggaatatattagggactcagtaaatggtgcatatataaataatgtatataaatgtatcatcttggcctccaagactttccacaaaatggaaaagaaggataactaaaatattcatgtagcctacctcacagagcctaggcaagaaccaaatgaaatattttgagtaagtgctttccataagcaataaatgccatagaaatatagcgccattataattatcttattctcagaagccccagaatccacatcacttattttgcagataagaaaattgtcccagaaaggggaaatgacttaaaagaactctccagctggctagtgacagatgtgatgtttcagtccatgtgtcttcattagtagctttccctttccacaattttttttttggctttccttaactataactttttttcatggaaattaaattcttaggtaaatcatataactttgctaatttctctatccatgaaactggatgaaacatagaaatattattttgttaataaataatccacaattatgatttttttaattttataaatattagagaatttctaattaattcatatcactcatatgaatgggtagctagaactcaacattcaaaataaaatgtttgataaactttaaaaatatacacatggtatatatacatattggaaaaatagttctctaatgataactcatgttcttaccttcagcgtgtctcaaatttaatagtgacatgtacgtgttttcttaaaataagcctagaggcatttgggaaatagatgtatttttaatacatcaaaagtataaatagcatagaacactttgatggaattttagaaaatataaagtgcttttggcaaaaattcaacctaattaaaattttgagaacaaatttatttaagcaagatttatgcattggtatcctaagcatactaaattgtgatctcaaatatattcctgagaattcattaagagcaattttctgtaatattttaaaattaacatttaggaattggagttggactttaagaagtggtatacatttctacatttttatgtatagacctctaaatcagacttaaaatatatatttgctttaattagctctcagtttcctcatccatcaaaaaacacccctcttaacacccagtgggttactttcactgttataaaactgtctcattttattataaaactttataggcttcagggactgggtcgaaacagagtaaattatcaggtatatttgactgattatctatgtcttaaatataataatgatagtgattgacatttgttcacacttccagtatgccagtcactctattgagcacttttgaaaaaattatgccatttaaataataatatgatgaggtagatattaatgtccatttgtcacaatcatggaaatgagttccttagggaacatttgcagatctcctataatgaaaccctctccaatgttttatttctttttcataagaaatagttatattttatctgtgaatctagtttctctccttgttctagagataaataaaggttgtaaagggcatttgggagatggacgaaggaatctgtgtataaactgagtattaaggaaaattaagaagtgattgttaattttgttcagtgttgtgatcatattgtggttatataagagaatgttcattattttgggatattcctgctgaaatatttagatataaaatgctatgatgtttcaaattactttgatgtagtttaagaaaaacccaaatatggctctggaactatggttaaactgttatttctaggtaatgggaatatgagtctgtattgtactagtgattaaacatttctgtgcatttaatttttcacaataaaaaatgaaacacaaataacattttctacaattttttgtggaggcatgagagatcttacaggatatataatatcttatttcaaaatatcattccatctataacatttgtgaccaataatgctttcaccacttttcggactttcctgaaagtccaatgctggattctctgggcctgagaaataaagcagtccatgcacattttaccaataaaaattaaaacataataaatgagactcatgacctccagaagtaatcttcacatagataaatttcattcaggatcttggcatgtatcataatgacagaaatttacacttaagtgtggctgtagcataaacctttctccaaaaagaaaagttgtttcaaaggtggtgatctgtatggagcccctaaaacaagatgctgatgtgagcaggtatcaagaaagctgacgtgaatatcctcatccttttgacagatgtgatcctagcacggccatatagttattgcaatatatattttatccagaaggtgaagatccaagcctttatactctttcctctaaaattatatgtatatataattatatattgaagggttggtaaatttgtttagcaagagtcaatctttaaaagcctggttgatttgtttaggggcatcaacactaaagagtttctattcccaacagtgaggaccaaccccaggacttcagtgacctcatcactgaggagattctacttgagctgttaaccctttttccacttgatatcttacttttgtcttccaacaacaggcaagtacttccttctgaggcactgaattacatttttagacagaggtagttattagaaaatctttatctttcctctctatgtctacatattagcctgaattcagacctctagaacctaaaggagtatatgtaatctattttccacaagatgatcttgcagttatgtgaaaaataatcatcagatgctattaactgtcatcttcccattctctcattcattccttcacctattccttttctgtagaactcttcaattccagacacttcaagaacttgttatccagaagatcagaatcaaggttttcctttggggatatttcagtatatcatcgtctctttcataaaatgacttccagacagaattgcaaattctagatgaattctgaccagtcaagaaaacaataatggtctttgttcaggacactatattcgcactctacaaagaccaaagttgtaatagaaattttgtaacattcatgtaaattatttactcatacttaacactcaactgaaatgcccattacaaaaataaactataactaagccatatcaaaactgtcctgtatttttatttttaaatataaatattgcaaagatttacactaaatttaatttatttaattgcattgtgttttctttggttcctcgttccagaatgctgatatactttttgtcttttgatgctgccaaaactgacaatatagaaatcctcaaacagttcaataaataaatattataaaggctgtgaggaaatcaaacaatgctctctaaaagtctattttattcacaagaatgcctttaagatgctattcagtgcccagaaacttatactttgcttataatttgaataagtttggttacctgaattccatgacccagtttacagtaaattggaagtagacagaaggtgtattagtctgaccacaaagatggaaaagaaaatctatcaaaaaagagacagactactcagtcagataatgaggcccttcaagttataaataagctttcctgcttatatcaggacaccttcatcctattattgtattatagcatagtacaattatatttggtcacaatactgacaatgagtcatccacagcatcatcacccagcatttattgatgtctactgtaaagtagagttggatggcaccatttctgctctcaaacagtttaaaagatccctgtgcagaaaaagacgtatttagaacattttggttggtaaggtaaagatgcatataatacaattagaaaaccaattctagtgacttttaaaaaagttaaatcttattatatgaattttataatgacaaattatatgaatagtataacaactaaagtaagatttgagaaagaattatatacctcctagttttatatgtattttcttttaatcatatttttgcatgaatataattttattactatgtatgtattaaatgtgtaattgaatataattaccagatttccctccaaattgtttatggaaatttgaaaatttcattctatctttctaacaacaattttcttgataaaataacaatttgaggaatattgtatagaattctaaatatggcatttgcttgtccataaattatgcttacatatgtctatattattatgattcaatatgaccaagactaatgatccatataaatatgctaattatagctccttccattgaaaaccagatgcaacacctgtagtgacacagtcgtggcaaagaaaatataaaatctattctcattatattattaacaactgaatatagattatgtaatgcacaaagaaaaataagctgttatatttcacataatattaatctattgcctatttactaggtttttaaaaaggtaaaataaaatagtttatatcaatttgagtaatatactactattatttctttctgactccattactgggtaatcattcatgattcggatcgcttgaagtcagtttagtttatgacctaaacccaaagttagcagaagtttccatattctgaaatataaataaaacagtcatgcttcttctcatacattctttgagagtctcaagtttactcaagaacttcataaattactgagggcttatattcccataggccacttttcttctctgcatttctgatctcgatctactgcattcatttgagagtgatcttgtataactattcccttcttactccattatagtaacccaacattgtaaaattcttcaaaatcactcttatatatatacaagagagtgatcttgtataactattcccttcttactccattatagtaacccaacattgtaaaattcttcaaaatcacttatatatgtcatttgtgtacatgtgaaggtttgtgaaaatgtttagggacaacatgagaattttacaaagtaaaatgacttaacattgcaatatctctgatttttacttaaagatgtagaatatgggtaaaaaagtatcgcttccacatttacatcaacaaccaaagccaaaactctgcaagtccatgacttttcctaaagccaatcatagttgtcaaataataatttcactgactgagttaaacagccaaggaaaattttattcaatactgctgcaatggaggcagagatggaactcaactctgctgaagcgaagtgaaggagagtttttaagcactggggtgagctagtagaaaagtactggaggacattagtggagatggtcaatgtcattagaccatctgtgtttgctaaatggtacttactgaataggcttctaccctcctacagagagtaggaaatagaggctttacctttcttgataactacatttcagagatggttcacagatgcttaagaaagatattatattttgttaaattggcaagaaactgggacaagatgtacatcacaaagggacagagaaagaatttacaatgggaagttctctaaagtagatgctttaagaaaagggaggccaggggcctgtactcagaaggaatcccatcaagacaaggagaaatttaaggctttcttggtcagaagtcagaagtcaaccaatgaacctgagatctagggcaataagcgccttctgaaagagatatgatgtaagtgtttgcttgccttgggtagatgccacctgacactggcaagtagaattcagctagaagagttgacaaattagttgagtatgaatcatcctatggtggcaaaaagtaagtaattgctcaaaaaagaaggacctgttaaaaagaaacaggatgtccaggcctggtggctcatggctgtaattccaatactttcaggggctaaggcagggggactgcttgaagccaggagttcaagaccagactggccaacatagcaagaccccatctgtaataataatcatgaaataggaaaaaagtaaaatttaaaaaaagaaaaaaactttcaataccaaaaaaacacaaaaaaaactttctatatcaaaggttggacaatttggtcagtgaaataaggttaaactccatagactacaataaatatccatgagttcatagtgatataaataaataattgaatgaataactaaatgtgggagaagggacagctcttccttaaaactccaactaataaatatagaagaagtgagcaaagtagaaaatcatgggttaggcaaacaccacagtaattattctttggcaaggttcattgatggagattaaaatttataggtgaacatttgagaaggaacaaaattgaatagtcttaaagcactgcactttggctgggtgcagtggctcacgcctgtaatcccagcactttgggaggctgcggtgggcggatcacttgaggtcaggaattcgagatcagcctgaccagcatggtgaaaccccatctctactaaaaatacaaaaaattagctgggcatggtggtgggtgcctgtaatcccagctactctggaggctgaggcaggagaatcgcttgaacccgggaggctgaggtggcagtgagccaagatctcgctattgcactccagcctgggcaacagagcaaaactctggcaaaaaaataaaaataaaaataaacataaaaactggcactgcacccaagatattaactacaaagaaaaaaaaaaaacttagtttttcagtggaaaaagccagcaaccaacaccaaatgacaaaaaccaacatcaccagaaataagatctattaatatcttgaacctcctgatttgatggactgagaaggacatgttagttttgtgatatttcctccaaaaatgcataaccttaaaataatgaggaaaacataagacaaattcaaattatatgagattctataaaatacttcatctgtattcttcaaaaatatcaagatcatgaaacataagggaagattcaggaaataccatactctagaggggactaggagatgtaacaactaaataaaatgttgaatcctagaacagaaaaagaatataggtggaaaaattgatgaaatttgaataaaatctgtggtttaattagtagtataataccaatggtcatttcttcattttgacaaatgaaccctgggtatgcaagttgttaacattaggggaaattaggtgaaaggcctataggatctctgtacttttttcagctttctgtaattataaaattacttcaaaataaaaaattaaaaacaatgtaaaatatgcacctgaattgtcatatgtatgtcagcaaatacagaataatttacttcatggtggctaccattttcagtcattggcatcctgtcttcttagatgggccccatctgtccttttctcatctttcctgtgtgttctcctgcagcaaaatactgcatattttctaagcacactttttaagtattgtcatatatatattcatccatcagagtctcatctcccaacacggtgcagcatattttcctgaagaaaaagagtcccttccctaaaggaaagtctaaaactatttttttttctctttgctagagatcttcttagtgaggagtaaaaagaagtgagggcttaagtaaacaagaaaacattatcctatgatcacagatactcaccaaagccaatttgaatgttattaatagcttataaactgagatgctataaaaactcacctaattttggataaccacatagcttgtcaattaaagctctacccaatcttaatactagaataacatcattaaataacatgcaacttgtaatttaggatgtttaaatggatcctgatgtctcaataaaatattcttgctaagacaaactccacaggggtaacgcaactggaccaagcagcctatgctagtcttctccagattcacctcccacttgagtatttcttcctaattatcattgccacaacctccttggtttcacgtgagggtcaaaggaccgccacacactttctacctaacatcttgcctatgaaaaaataaaatttctcttaactatctttgatcagctagcataagcctggactatatataaaaatattagacaagatattaaagattttgaaaggcagacagatgcagagtgatatggtcttggtaaagaggcaactaaggtctggcttattcttctacgctagttatgacccatcctatgtattgtggaaaccatcgtatatccattactgatcacccaggtacacaaacaggatattgtgtcccaaatataagtataggtagccaagtcctacagaggccagggttttcttattatggctttctgagcactcacttctccaagtgatttacattagaaatgatagtgagttggctgggtgtggtggctcatgcctgtaatcccagcactttgggaggccgaggcaggtggattacctaaggttgggaattcgagaccagcctgaccaacatggagaaaccccatctctactaaaaatacaaaattagccaggtgtggtggtgcatgcctgtaatcctagctattcgggaggctgagacaggagaatcacttgaacccagtaggcagaggttgcggtgagccaagattgggccattgcactccagcatgggtaacaacagcgaaacttcatctcaaaaaaaaaaaagaaaaaaaaagaaaaagaaaaaaagaaaaggaaagaaaaaaagaaatgatagtgagtttgcagaagagaccaaactttcaaaatgtagttctgcaggctctgaaagtatggcccatcagaatgctacagaaaagtacttaaagcaccacaaaatatttgactattctgttgcatgccattatcaaaataattcatgtactccataaatacatacacctatcatgtatccacaaaaattaaaaactaaaaaaaaagagaatgggtcttccattacagtggtattagttttggaacttcaagcaatttgtaataccttgaaatctaccagaaattgaagatgatttctaaaattctagattacttacaaaaatgtaggcagtacctaaaatagatgtttactaaataatgttttttctaaagagaatttttggaattagaaaaaaaattcttagaaaaaggactcatcttgattagttgaaaatgttttatctgtatacacactgaatttttctattttctctaagcctccttcagctaaagattcatttaataaatccccaagtgagttatgaattatttccccagaggtgggacacaataatcaaaaaataaaattgttcgggtcaatttgtaaaatagaagtttcaatggcacgtttcaatgttatatatctatcatctatctatgtatttatatatttatttgtgtatttttttatttaaggtgatatgtaacaaacttgagatcttataggataggagaacactaggacactaattaggaactggtcccaggaacaaagaccttctggactcatctgacaagataagaatcatcaagcattcttccagcagaaagtgacaaagccctccttgagctgctcatgagaattcacaaagtaaggcaatatgtgaagaattaagatagaagagcttgcaaagaatcccttgtctctattagattccaagattgagccttagaatatttcaaaatgataaaaaaagagagtttaaaagatttgtagaagaagaatgaaataatatattcattttgaaacaatatattttcattcaggattattaataaaatgctcatgttagtgatacatgattcactaaggaaaataaacaaggaagagaagatggataaagtgataggaggaggaaacatgacacaattgagaaggcactgaggtagaaagagaattggtgtttgttggtataatttaaccagttttcattcaatcacctggaccacagaaattctcaaagtacaattcacatgcaactgtaatagattacatcttgtctgtataataagttaatgtgcaagattttgaatattttcttatatatagaatagtattattttttctagtttcttttttgatttatttttctttcataatcaagaaaaaaataaatgaaagagaatatgggagaatgtcaccagagagtcacaatgttggcatgttattctgacaattcaaaaaattctcaaagaatctaagttttaagtgctaaaaactgccagatcattttttatatttattcttctgattacagtgcctacagcattcgtaattctccaaacaaaatcatgaggcttaattgttttgaaatatacttctgtgttacattgtcagatctcaattaaaggaatcttccttctatatgcaatggaagtaattcaatccctttttatgtagtaccataatttatgttaaaatatggcacaatcactgcctaagattcaaaacatgtaaaacacccctttgctgctgcaagaatcaaaacacagggttgatggtaacacctatcctacatcagtagcactaacaatacaatcagtttgtacaagctaaatccatctggtcagaacacacaccaacattaaataaacaaaacataattcttcttgtcttctgaatgtgaatttggagggggaacatctggattagaaaggcccatagcaatagacaaggcttttccaagtaaaattccattcaggcactagaaataagaccctctgctcaagaggcagcagctgacacacgagcctatcttagtactgagacaggatatagatgaagccatgtctataaatgagcacaaaaggaaattaaaagtaaggcttcaattagttaagctttcaaaggtaaaactctagggtgtttggaggaatctttcaggaagatatattccagttttactgcagactcaacacaaatggctctcagacaagtcacatctatagtaattggaaacattttcaaagtaaaagatgagagaccatggtttttgccaaaggttcttaagcatgggctttcatgggcatgcgaattttttttaaaaagtagcagaataaacatatgtttgcaaattattttattttaccaagtaagggcaataaaacacacacgtttaaaacaaaaaatttaaaaaggaagaaaaaattaccacaaaaaacttaccatccactatcactattcttttcttaaaaagaatattttaacctcaaaattaggaaggactcagtagaaaagaacgatctttcctaagaaagaatggctgttcctttggttgattttacctctccccgactccgcaatcacaacctcattgttacttggcaatctcttggaagattattgttagtcacaagtgatgtgagaggtgtgcgctactggtgatagagtagtaagaaattatttaggcagttagtgagggtgaaagagttcttggtagaattttcttttaataaaaagcagcccccaaatcatttcttttctaataaaaagcagcctgaaaaatcaagttacaagcatagataagcaagatggaaatttgcatagataaatggcatcagctgtacctggaagctaggtacatccaacatggtgattccttcttccttttccttgtcgccacatgtgcaggtgtcatggcaccagccaggtaaaaccttatctacataataaaagatttgtgggctatgtaaatagcacacctggtcaaaccaatcccctgggcccaatttaaatcaaacaccatctcctcaagcccctctataaagtggacctcatctcaccccaaacccagaaacatacttggggaccccctttctctgcatgaggaagctctctcttctttcttttgcctattaaactttccgctcttaaacccactccgtgtgtatgtgtcagcatctttgttcctcttatcgcgagacaacaaactttggctgtttccccagacaatgatggtgcttcattggcatctactgggtagagaccagagatgctgctaaacaccctacaatgcacagggcagctactacaacaaagaattgtctggtccaaaatgtcaacagtacacggtagagaaactcctccctacactgacattttagctaaggaccagtggacattttggctcagactgaccctcatgtaagctaaccagtttacggagccagtgatctctggagtgcttggttgactcttttgttttcagtcatttttaacaataatcatcagcaacagaactgcagtggtggaattctactcaatcaattagaactagcctgaaaaattgtcactaaaatctattctgcaattctatcactttgacatcaatcccactggcatattagtttgtatctgaacttcagggcattagacttagtctagaggtagtgctactgtttggaaatgaaagaatatttagccagtttgagacaagaattagtagcctctatcaaaagatagagaacaaaaatttcgtcttacagtgggctttaataatgtatgcttcattaaatattcagtaagagtatatatactttctattaatgtaactttttaaagattaagaaaatcaaatggattaacaaccacggctcattctagatagtaaacttatagatagctattttttccttatgtttatttgaaacattttggtctataaaattatgcacaaactctcagtagtatggtaggcttctttttccctctgtactttcatacagaatacctttattttcataaaatattgtttcatataccaaagattttgaaagcaatattttaagactattcttgtaggctacatatatatgtgtcattattttacaaattatattgcaaaatgagatcatattatgtatactgttttgttccttattttttaacattataaagtagaccagtgtctgtataatatagatttgtcacattttataactcttatttcatgatttagatctggtatcatttatctacatgttattaatggttatcagttgtttcatatttatgtagataggtaggtgttttgtgtgtgtgtgtgtgtgtgtgtgtgtgtgtgtgtgtgtgtgtgtgtatactgagtggtgaatatctttctgcagttctccaaatgtatctgggcaaacattctagaagacaaagagaatgcacttttataaaggttttcaatgcttacttcccagttttcctgcagacagcttaccctaattggtatctccacaaagtgtttgagtatcaattttccataaaaactttctgacaatggatattaacaatcttttcatgtcttcttcaaatgttatccgaatatagtatttcattgttgttttcatttgcatttttgtaatctctgatgagatgggacaacaattaacatacttactataaatgtacatgtattctttatgaataccttgtaatagggcctatgcccagttttctgttggccaggcgtggaaagtggggtgaggagtcatttcttcttattaatttgtgaaaatctatttctatgaatatataaacattttcttatataatttgtgattattatctcctcaaatggatgtttgtctttattttgtgttttgtttgcttgggtttaccttttttattttgtattctcagcagtaaagttcgcgccccttttcttttgtttttggtctttggtatcacatttggaacatcctttaccatcctaaagtcacaaaaataaatatttactcctttttatctagtacatatagggccctttgttgttgttgtttatgttgctggaactcaggagctgaggattgcattagtcatattcttcagttcattgcacactattactcttggtaaatagagagtcttcctgccccaacccaaacctctcctctctttctttctccctcccttcctttgctcccttccttccttccatccttccttctttccttccttactcccttccttccttcctttcttccttccttctatatacttttgtttattcctattccttgtgcctttttttctattccctccctgcaaattaaaacataaactgtttttttaaatctactctggttcgcctttaccttaggtaacttatatttaattcactgcacaatatgaatcccttatgatttgaagttactgttctttataaacactatattttaatagaacagaccatgtgttaggcatctactttgtttttatcactacacaaggtcctttatatgcattatttctaattataatattacaaggtaggtattctctgagttgaaatataaggaaccagtatctcagagaaatatatatatatatattactaaatgtcatactgtcactaataaaaagagccaagattaatcttagggatggtgaccctaagacccaggcactcttggtgcttcttacaaaaacaatagcaaacaaaaccaagcgagttctgcatatttttagaaactatatttgaaaatgaaatcctttttccttataacaccattttatattattttaggaaattttagtaacagtagtttctaatttcatcatttcaaagaacaacatgaatctaatgctacattcgtgactacataattgcaagcaaacggatttaggcatctggtgtgataacagccctgacaacacagcacttcttttcttctgagctgcagtttgaaactggaccagggtaggcatgtggctcaagagctacccatctataaattaactagaaattcatgaaagaatcccatgtaaaggactttgtacataggaggaaatttatttagcttggccaatcaggctggctctccccagaaacccttctgaaaaatctgaagagaactaattagcaaggtgaatgttgccaagctgcaaaaatagcagagatgtcataaatgtgaatccactcaacaaataatgatgacaaccgtgatagtggtggtggtggtaatgattatgatgatgacagatattttttatcacttaatgatacatcattccttataaatattaactcctagaagcctcacaataaccctatgatgtatgtccattttaaaaataagtaagcaaaacacagaaatgttcagtaacttgctcaatgacagcagttagtaagtggcaaagtctgattcaaacataggagtctagctccagaaattgtgctctcctttaaaatggtcttagcatcagaaacgaagagacatgtttggaggctgactttttctaaaagctctgtttcttacaagtacatgactattacatagctgatgactttacactcaaggaaatgcttctattatatgtctgttcatatttacatgggattttagccaagctttagatgtttagagtgctatatagcctaaacaacttatatattagaaatacatgttcacatttctaaaaaataaatgtaagttagaagttactcactgattaaaaatatgaatataaaaatactatttcggttatggtactttcaccgtacaaaggtaatttttagaatattagaaagcacgtaaaagaaggtgttgcatttggcttctttttctgctaccttacctattactacacacttattgtctttagtaggaaaagatgtaagtatatttttgttaaccagggactaataattcaacaatatgtatacatgttcaattttcaacataaatgaaataggactttttcaatgatgacaatttaaggcagaaaaagcagagacatacttgctagccagatgtctaccacaaacacctttaaacctacaaagagaaagaatcacctgagtactttagcctcaacatttttccaaatgcccattgtctaagtaattatctactaaaatactattttggaaatataggagctaccctatttattctgtagctacattataattggttggattcaagtgctgtatctgaaacaaccccaccacccccaaattttctgcacaggtctcttttcccaaagcacatatatggttaacactgtttatttattgactcaataaatatttaaagcacatttactagccagacactgttctaagtgtgggggaatacatcatgggaaaaaaaagaacattaaaactgttgccttcattgaatttgctatctaatagggagactaaacaaacaagcaaatatgtaatacatcagagagtgaaggtaatgttatggaaaaaagtaaagaaaaaatggaaagaggttataagagagttggaaatggagtcacagttttaagtcagtggttagtggtggcattactaaaaaggtgctattcaagagaacaagtatgtcagaaaagaggagatttgttgggggatgaagtctgaaatttgaaggaaaacagacctaaagccaattccttgaggaaaaaaaaatggtcaccaagtaatacataaaacttcactgtaagtttagaaggttgcaaaataataatataaagctatgcatataagataatttccagtctagctgacatctttgcttggtttttcaactgacttttagtctagtcacagtcaaaattaatttctgctctttcaccatctccagactgctcaattcagtctcctctgtatcaatataaatagtaagcccatcttcccagttctgaagccaaaaccttgagttgtccctgactcctgtctctctcattcccaatatccaatcttttagcaaatttagttagttttacctctcaccatatatacacaatcaacaacgttcaacctccccatttctaaaatcctggtctctgtctccaccatttttcaccaaaataatagcaatggtttttaactttctgcttcttcctgaatcacttctcagactattttcaacacagcattcagaaagactcctttaaaacatgtcatatcatgattcttctggcttcaaacccctccaatggcttctcattctactcaaagtaaaaggcaaatgtcttatgatggtttatacatcatctggaccaggcctcccttttagtttcagacttctattactgctcacttcaccaacattcacctccaaaaacattttcttctcagaacttctctgcttgctatttcttccactgtaaatgcatcgatgagtagaaaactctgtttaaagaatggatggcaggctaggttcactaagtagcaagtaagtcacatatatcacaatataccacttaaattcatgccttggtggcattataaactactaaagatatagaactttggtttttttgtccatgttataaggtggaaaacgggcatttttgaataccaacgttctactctataaatcaatggaagaggagagagatttaggcttaaatcacagaagttctaattgttgcaaaaatatacttgatgcctataccttccctcactctaaaatatacttcatcattggtgataagaaaattttgacaacggaaaaactaaattaagaaaaactataataaaaaagatatctttttaatttttaaaaattatatactaagcaattcagattagctattgaatattaatttttacatagaacttcccagtaaccaaagcaggatgaaaatgtacatattttaatgaagctccactgtctgataagtaagagcatattaagatatttggtaaaaatctttcccagattgaaatttcaagaagcatttattaactcgtatataagaagttttggatactataatatacagtgttttaaactttaatttttctctgtctagatttttatacagtgacttataaaattaaagaaatgacactaaatttaaattcaagtaaagaacttaaagatcaaactgctcaagtacactactttacaatggatagagatagagcctagtgcacttgacatgtaaaaatccaaaaggagtgagtaaactgtcctttagacagcttttcagcagaagtttttgttttattaaatcaataggggctaaagtataaagaaagctttatgagaataaagggagttgggctcatctagaagaacttttgaaaggaagtaaaaaagacaaaactagaccattctgacatggaaaaatcagaaatataggctcagggaaaatcctaactctctgtcagaaacacaaggatcattgtagcaaataaaaaggattgaggttctatatcccttatatggccaggaataaaatggcgtagtgaaggacttcggcaaacaagcagatcaattaatatttacactagctggtactaaattgaatatttcagtgtagtgtctaagaatttatagtaagatttatctggcacaaggagttacaactgttggaagaaaaaagataaagaaataaattcatgtaataccctaggctcaatatattagcctagggtgtgcttttggggcaagatatcttacaaaataaagcctctccttatgttctttcctatatgacgtgattcacatatgaatctcctctgtactaagtagtgtcctacgttctgcaaatgtagtgctaaaagaagacaacatgtcccctgctgtaatggagtttagaatttagcagggagaaaaatccattatataggaaattatacagacacaatgaatatcaaaatgtgagaatccacatgtaatggaagattattggagggaaactatctcagacttgcgtatcagagaaggctgggctaatctggaatcctaatgatgagcagatactagtaaagggaaagagggggcagcgtaggaattgtgtttctcagagataatgaaatggtgtgagggtgagcctgatggttgtaagacctgagatttctgcacgaggaggtagcattgaagagaaaccggcaaaatataatgcaaatgagagcagaccctgaagttcctttacagagggcattaggagattggatttcatgctaagggcaaggggtgacactaagacctaaaagggcttttatgtatgatgatagatgacagatttttcactttggaaatatcacaggagcttaagtatggacaatggaagtttacaaaactgatggcaggagacaagttaggaacatgctgcagaaatctaggtgagaggtgccggtgcctaaactaaaggagggaccaagatggcatgaatgttcccctccgcttgaaaacggctttctccaagttgtaaaaccatctcctgttataaagaaaacatttatgagaagttttacgatttctttggttaaaggcaattagcaaatttgatggactataatccctctcaccatatctctgacaaatctttgtttcagcagagttgagctcagaatgaattctagcctttgttccattgcaaaagccttgaataaagtcttcctctcttatttaactttggtgcaattcttctttgacagtggtgatagtggagatggtgaaaaatggacaagttcagaaaatacttagaagagagtaaaaccagaacatgttgtatgattagctatgggaagactcaaaaactattcctgagtttagatttgtgcaactgaatgtacagaggtgccttaaggaatgtaagagtttgagtagattagtggattaaggtggtgcatttaggtttggaaacagtgggatctacagatgcctgtgattatttcaaggagaggaaatttgtaggcctcccaatatatgtagtcagagctgaaaagacaggactaggctagaatcacatgcctacatatgatatttgaaatcttgggattatgtgacaatgtctaagaaaagtaggaagagctggaggactatagggcttatatgagaactctaataaaccctaatgtttaaaaatagatagaggaaaaggaaaccatgaaaaatatgaaaaagatcacccagaaagataggagagcagagttactgccaaacataaaattgaaatgatagtaaccaatgatgagaaaatgtattgcctgctgtgttgctgctgattaatgaaattttatctatattgattaaaactgttttttataataagccaaattagatcatgaagatggtaatgaggtcatgtgtcccaatattctgtaaggtaattccgtacaaatttgagttattgagagtatatactgataataattatggcctgttaaaatgtttttaatttttagagtaaaccactcatccatggaattgtttttctatttcatagtgaaggatattcaggtaactgcatgtaaacaagcaaaagtgaggcagtttttcctatcaccaacataaagtttacatggcattttttttacactaagaaccatcgcaagtattttaagatttgatatgctccagttcatctgttgctattgacgttttgaggttgtgtccagtaacctaggcaactgttcttatttctgtcctaaattacttctatttatagaccttatatagattcaatggccccagagattttctctaaggcagggcaggttgacaaactatatgctcttaagtgaatataatgttaaacacatgacagaccttagtcatcaagcaaagactgcatattacaatttctgtaatttggggtcatcagtatatatgacaaataatgtatctttaaaaatgtagtataacctggtcacaatgaaatatgaaatgactatcgttgaaattataatatttaaatgtcttgtttttaatgttctattcattaaactcaattccagcaattagaactagcagattcaaatatccttaaataaaaatcttacccagtctaattcagtgctaacaaattccttttctcaccactcacctacaagacactataatcaaagtttaagttgtgtgagacagaacaaaacctttgatttagtatttagaccttattggatttcaagttgtacaggcggaggaaagaatgactgtagaatatgttcttcttgggcaggggcaaagaaagaagaggtaattataaatgactacttgcagaactatctccaacatgcatccaataaatatcagaatgagatgtatttttttctctttttttaaaaaatcattatacatctagaaaaattaaatgttgtttttttcttttttctttcttttcttttctttctttttttttttttttaggcagtctctcactctgtcacccaggctggagtgcagtggacacaatctccgctcactgctacctccacctcctgggttcaagcaatcctcccaccttacccttcctagtagctgggattacaggcatgcattgccatgcccagctaatttctgtatttttagtagagatggtgtttcaccatgttggccaggctggtcttgaactcctggcctcaagtgatccacccacctcagcctcccaaagtgctgggattagaggtgtgagtcactgcgcctggcagaaaaattaaaaattgaaaagtttaagtcctatgcaactttatgagaactgacagagacagaaactaatggattaccaagctaccaaagttccacaaggaagaaaaactcccagtgcagagccaggcattttactaaatggtgagggaaataagaacttgacaactattgggtcaacttttcggtgatgttgcattaacaagagttgcttttttggatatctatttcagttctagcttacttttgtgaatacagatttacataaacttgctggcatcattaagaatcacaatgccttcttccttttaatctcttaaagcatttcttcattagtccccttcttgaggcaaaaaataatttcaaaagacttctggtagtaaagtgtccatgatgtcaaaaatacttagtaccatgaaacaggaaaccaagtagtcccatatcaggagtcagagagatttgtatttacaaagctccctgagctactcaataaaaagtcaaagcacatcaggagcacacaaagatctgcatttttcatgagattcattttataaaaatcaaaatttattgttcacttcctatgtgccagaaaccaaacaagaattttcacatatctaattgaatcttcaaaaacacctataaaatagatattattattatcatcatcatgattttacagataagaaaattgaaagttagaaatgtaactttatgaaggtcatatggacagtaattggtggaactgagatttgagtcaaggtttatgtgactccaaagtccattctcttgacttatacattacagtagttctataaaaggcaagtcatttgctcacctattctattccccaaactctctttcaatcaattttatgaagagcctttttaaacccacagttattactcaggtaagtttgaggaacgttcagctgccaccctgctgcaacttaaataatttcctaagtctctactacgactgctgcccctattgcagaaaataaaacaggaaaaacttctagaaattagaattctcgttttattgaaacatcacacaggccaatgtgatgagacaatgactaaggagcaactgcctttgctcttctggattccgtggtgggaactaactttggatcctcaccctgcaggatcccctgctatatgaccctacttgcccaatactccacttcatcaaggtgaagtgacccaccaagagagactttcagggtctgggcattaccaggtagtttctaaatggtaatcaacaagccaattttgctattgatagaagattgtaggatggggacgtgtagaaatttgcaaggtttaaatacatctaattttaaggtttgtggtcttcagtttaacaaaccatctttctagtacagcaatttataatattgactctataatgctggctgttgcaatagtagatcaatgacaatattaagggatgatgagactattccagtttacaagtgtgctgtactggaaagagaacatgtttgaggccaaaagacctgcgatttggtcccagttaatatggcttgcataaactacttaaattttttgtttcatttcctaattagtaaaaccaaacggaaaagataacaaaaaataagctccagggctttttataaataagctaccaatttgaaaatgttctgtaaactatgatgtgttaaacagtatcaggcactgctctgtttaaatagaaaatatgatttagtctgtatgtcatataacattttaggaagcttttaggacttacaaacatcttattaataagtttagaaattttattctcttttaaaaggtgtattttcatgtctcttttgaatttgagtttttcagataaaagatgcctattttattctggctgaaagcatgaacagaataaacaatgagctctgtgaagaatgttctatgaacccgaatcaaactcaaactcctgtgtcactccggtacgcctgatcactggatataaccacgtattggtccagtgagtattcatgtttaacaattaagataattactgatttccactgctatttccattgtcacttcgtaagtcatgcattattggtcttttaatattttgttctcattgaccacagactctaaatcattatatgttagttacagacctttacaatgcctactggcatttgccactggtgacaacaataataaatgatgttgagctgaagctagtaggaatgaatacagaaagtaaaatgataataaataactgtcactccattactaaacagtgcctggttctagcgcatgtgcaatacagcagagtctgcatgatccaagaactaaaaaggcatttactctttagaaacagcaacaacaaaaaagaaatccatttactcatcttgtgctgtgaccccaaattccacactgagcatggcatgagtatttaaagacttctcaacagaatctccttcaatatcttatagtatcttctcaaagtgagagtgtgtgtgaaatgtgccaaaagttacactcagtgcaatggatatgaaattacagcaattacagctagaatgtgacaataatgtctcagatggataagagattgaagatataaatgtcattttattattataaggagtatggaacacagatattagtataaagaatatgggactcaagaatacgagatgtctggtagatattgtaaaacctatctaaatataatgttggttcttgttgggtgatttgggtggggaccaaatctgagctatccttttccttggccatctgtctcataaacttaacttatgagagtagaatctgttgtaataaactcacaaggcagatataatgtaaggggtgttattggtaccaaattatctacaatataaaataatttctcttcaaaatttaaaggaaaatttgtgtcttccccttgtcagacagctgtgacatcctttgctctgtcctctttctcattccattaatgatacatcaggtttattgctctggtggtggtctatctgtttgttttttagtaaaggacttatcataactttatttcctaagtaaactgacatgtggcaatcacagaaggtctgagtctgaagacataatcctcttactacacaagttacataaatttgagccttagtgatcttattagtaaaactggaataatattaatatagcaaatttaatgtaaaaattaagtaaataatatatatggagtaattttcttttattattttcttccaataagcagagtctgagattggaaggtagtttgttttggaaatagatattagtaaacggaactgggagcctgggaagaacgaatcaggaaagaaaggagagccagtctaaagacacagtatcaacatggttactacttgatcctactggggaccctttcaggttctgtggaaaatgcatttccaaattgtccatcttagaaacagaatagggttattggtcaagagttgctctatgtggggttcgtgcctcatataaggttgtatatgtattatcatgactgagcagttatcagagggattccacatagtagttgctagggagccccaatgcaggaagtgaataaaatccaattatttgggatttatgcagaggatatttataagagcagagagtagccaggttgaatataatgttgccaccagtagatttcgtggtcagggatctatcttgtcactaaacagtggtgaggttttcacccagcggcattccgaatgaactggattgtctgagaactgtacgcagcagaacactaatgcaagatgcagagcagtttcagggtagtttccacaacattagaagcagtggcttctatgaaaaattcttaagattcagaatcatagagatcatcaagtttgtaacctataatgggcagccagtcatctagctggcctggcctatactttggaccaagaacaaaaatacaaatgaaaatagtagtaataagaagtttaccatcgtatataatgtggaaatttttgaaacacttccatatgcattatcttatttgaagttaccagtgatgctgtgagaaactatggtattattcatctcatttttcaaatgaataaatttggttttctaaccaagtcttcatcgtctacaagtgctaagccagaataaaaactgaggtgtgtttatcctaattccagcattctaaaaagagccttaattttaacaaaatttcctttggtcaattactttgcaagccttgacacctacactttaccttcagtggcatcagcctgagtgaaccacgcacccacttccctgaaagcaagagcaaagcttacttttagcaaaatgtatttccaattcaatttccactcataagatgtgatctctaccaatgatgccaactagatttgaaggaaactaaatccagatgctgtgtgaccctagacagttttcaacacaaattggctagtagagggctgacaaataacccaaataatctgtaagaaatggaaactcaagaaagtagcatttcccaatatattaccaaatactatctgtctggctatgtgataatggtgtctactcaaagaacattttttctccactgaaatgaaatattcctattaccaaaatttgagataagcaatgtttctgataaaacacaggttttattttcttggctgatatatattatttctaggcaatctgaatgtctgaaaacatggaactttcccaaatttatcttttcccatattatgttttaccatattttctgtattttatagtaaatgagaaaatacttagcgcactgtaaaaacaaatatgtagatgcaagatattattgttaataaaaagatatagttaagctctaatgagatagctttttaaacattcatttcacatatgtcaaagtagataaacaaacaaaatattttacataatatgttgtgggattttaaaaaggcaatcaaaaagaatagtagaaacagaatgtgactctctgcatctgtttaaaattagatatttttcagtgtatttatcttatattacattcttagggaatagaaatccaaaggattctaggtaaaatttggtaaggactaaagttgttttttcttcttcaaatcagtttccacaagccatagattacaatagaatatcaaaacatgtgaggaatatcaacattttttttaaggaaatgtgcactaacactcattgtgacatggagttaaccaaacgggtctttgcttgaaatgtttctgcagagcttgtataacaatatgtctacaaaaacagagtatgcgccagcctttcaatataagtgcttcaacatcagatacaaccataagaggccagaaaacagagggaaaggttaggaatttgcttccatctccaaattttatgtcaccgaatttaactaacttaataataatattaataatgatgatcatgataatcctactattgttgctgctgctattactactatgaatgatagtaactaacagttattgagaagttactatgaactaggcactatataagtggtctgttagttgactcagttaattcccacagtaatcctcatatgaaggatactattagtatctctgctttacaaatgagggaactgaggtacagagaagctaattgactttcccaagtaacactccagaaggaggtggcagatgcacatgcattcccaggaaggcttaggcactgtgctgtactacgtgggtttcagatccaaggtttgttgtctggtctgtagttgcaagcgataagtggctaggatgccaaactttcacagatacccaggcactgggtgggagtaaagtgaagtacaatatctcagagtaattcagaaattagaataacatatttggagttgtgtggtggtggtggcagtggtggtggtggtggtggggtgtgtgtgtgtgtgtttgggggcaggcacaggagaagttattgtagagaaagaaaagtagattattgactcagacgagttttcttctccactagaattcccgagtatatttacaacttcttcgtttcttttttctagtctaagcaaacatgtacatatttcacttttatattcccatgactcctataaagatcaaaagcagtatggagtgattcactacatgacctgaaatggacttactgtgagctctcaagatagaggaaaataattcccctcatgtggtttcccttaatgctaaggcttttctccatgtgcttcacagaactagctccagatccaggagtcccacccattagaggctgcctagattgacaaagggagggcacagccttcagtgacacagtacatggttctcccaccagttgaagtgacataccctatcagttttcccttcggtctgaatgctggtgtgactgcggacctcgtgttcctcttcaaggtcagaaacatcctccagttcctctggggtctataaaaagaaagcaaaacattgctagtgggaatgtaaaagcatttcttctttggaaaacaacgcggcagtaccttaaaagggtaatcataaagttaccatatgacccagcaatttcactcccagttatatactcaagagaaaggaaggcatatgtccacacaaatacgtatacacaaatgttcacaggagcatcagtcatgatagctaacaaatggaaaccaaatgtatgcttactgatgaatggataaacaaaatgtggtgcatgtgtacaatggaatataatttggccataaaaaggagcaaaatactgatacacaccacaacacaggtgaaccttgaaaacatcatcctaagtgaagggagccagccacaaaaggccacatattgtatgatcctgtttacatgaaatgtctgcaattggcaaatctatagcaatagagatttaattagtgtttgctaggtgctaggggaaaggggaaatgggcaatgacagctgatgggtatgtggtttctctttgagatgataacaatgttctgcagttagatagtaggaatgatcacaaacccttctgaatatactaaaaaacactgagtttcatacttcaaaatggtgagttttatggtatatgaattatatcccaataaattgtgagagaaaaagaaagcaaaaaaatgatcacagggaaaattttatttcagtgaatagcaatttggctacccactatgtggttactgcaaaccaagatgcttacagttgataaatgcattagataatcatcattaaaatcatatatcatcaaaatgccaccagaaattatcaagaaattaaaattttagggacttaataaataattcaacttgaaattcagtgtctattataaagagttagctaacttccattccttctttcaatttcagcttaaatgcctctttctcagggaggtgtcttgctcaggaatcctctagactgggctggattccctgccaagtgtttcctagccccctctactttatctgccataatgatcattatactttaatatatcatcgctgaattaggcagctaattgttgaattgtctattctgtgaggcagggacatgtcttccttgtcatttttgcaaatacatgtcaaagtgcttaacaagaattagcctagtatttgttttagtgcacaaggtctcaacttaatatattttttttatttcaatagctttggggatacaagtgggttttggttacacagatgaaatgcatgaatgtgaagtctgagattttagtgagctcttcatccaagtagtacacattgtgcccaatatgtagcttttcattcctaatctctctcccatcctccctgcttctgagtctccaatgtccattattccactctgtatgattcctttgctacaaaatcctggtgacaaacccagaaaataagtatttaggtttcatagaaaacaaccaaaaacgaagtagaagatgtccttgggcctgcatctttcatgcacatatggctgctgaagactggaaatgggcagagcccatctccttagactagctctggtttgccttaaacgttgctttacacacagacattctgtttattgtcagggctgccaatagcctttcatcccttgggagcactccagagatggggacatttgatgattagctcatattatatagcaaaactaccaatttcctattcattaatggcttcagattctttctcatctcatagatctttaaacagcactttctttgttctcacacacttgcactgagcaatacccatccctttgcagaagagcattttgcatttatttcaaccaattcctatcagatattaacatcccccctctcgccaaagccttcaatgtgctattttttatctccgtgttgatctctttgcaatccttctttgctgcaactacatgcagctattatctcaggacaatttattctttcttcttaggtattaatagcacaagttcattacgatgtaatttctatacaatcatatatcgcattattagcctttttgtgcattcttgtcacagtattcttgagaaagcatctttgcaatttccctccttgttatatcaccaggccctataacatttgaacaaattcagttaatcaaattctctttcttgtgccctgttgttttgcaactgaaggctgtctggtgtccctactgtgatctattccttataaatgtctgctgtttattacttgggttatatcctatcatgcaatgacaaataacttcatcatccactcctatagtttattcaacccccaaataaagtaacaaactaagaacaattgctgctatcagaagtcacaagtgccatttttgttggggatgctgtacgaagagataagcctaccatttacacccacatacttctgtgtttttctttgtgtttaacacaggattaatagttttcttgcaaagctacaaaaactgacctcttcttttcatgaacaaaatcagtggggaagtgttcaaaacacttgctggcagcatttcacattctgtaaggcatggtgttggatggtattgtgaaaataaatagttaaatacaaaatgctacagtttaagtggaaactaagaaagagaaaggagtactctaataattttgagggcaatacattaactccttcagcactaaacacaaataatagaaacagcaaatatcccagcactttgggaggccaaggcgggtggatcacctgagtcagatgttcgagaccagcctgaccaacatggagaaaccccgtctctactaaaaatacaaaattagctgggcgtggtggcacatgcctgtaaccccagctgctcgggaggctgaggcaggagaattgcttgaatccaggcggcggaggttgcagcgagccgagatcgcgccattgcactccagcctgggcaacaagagtgaaactccatctcaaaaaaaaaaaaagaaaaaaaaatggggtgggaaaggagggatgatagagtaccctagatcatgccttcttaaaattgtctgcttctacctatctggtaaacatctggaagttttgtgtgtgtgtgtgtttgtgtgtgtgtgtgtgtgtgtgtgtgtgtgtgtgtgtgtgtttctaatcaatttcattctgtgaaagattaactatcttagaggcagtgttatatattagaaaggccctataatattgagtaatgcagacctgaatttgagttctggtcctctaatgagtgattatgggcaatatgtgttctcttttaaagtttgtttccctcagaataaaattcggataataatacctaatcccaaaagttgttgtgaggctcagttacactaagatgctttgggtaagagcttagcccacagacctagctggattgtggcaaaagtttatttctgtttgttgcttttcctcttctttctccactaccttatacctcatcccaatatacacctttatatttttattaaacatttatgtaaatttatccaaattttaatcacctttattccaaatttaataattttaatccagtataatccaaatttatttttgatttggaactttggataagccaccaatgtttctgtcctttagattctacacagacattattttgggttgacatggtacatttactagttgcctctagttacagttacctgagtttgattatctaatgtcattgtgctaaacagggtttaatataattacccatgcactgcttccttctaaaatccatgtaagagatctcttttaattggactttaatcatgtctaacagcgaaattatctcttaaactggcctcagcaaagattcactctagcatgattctcagggatgatggaaataatttgtcttctttaagctgggctgtctctaaaccagacaaagatgaagagagcccattttttcagaaaaagtgttaatcaatgcagacattaacgttatttctcatatcagaattgtggagatatatttcatattttcctattttacctctggcttattatggtgtcttccttaggcagcccaaaagtgatttggaataggcttagtttcttcacctgtaaaatagcacaaatactacctaatttttagggttattgtaaagataaaacaagatgacggactagaacattattcggtgactgggaaatactgaattattaatattgtttatgaatattatagattatcattactgttgctatctcacttgattcaagcaaaagaagccaaaaacaaatatagaagttgaagctgaaaacattcaggctgaggtgtttacatagaagccaggacagcaatgacatagtagtaatacattaagacttcagggtcacaatacatttcatatatatatcctttttcccacaaggagttcaatcctttctatagacattatctcactaatcctttcaggatccctaatgaaacaggtggcattattacaattaaaaattcacttgcgcagactttataaatatttaatattaaaatacaaaaaagaaatttgtggttgctaaattttaaagaagagagaaaaaaacacaggaagaaaataaaaaagaaataaaaagtattaaaaatactgtggaaaacaagagtcatgcttggcttcttctcagaattatgtttgaattctaaaccatacacatgacttattaaaaatataattcactggctagctttcactgacttactaaaatcaaataaccaccacagtaatgtcaggagtggtctcgcactcagagaagctcttaggaaacatgctatgaatgtccatcccaagcaggagactaacgtcacatgttcaatgatttcattccagctgaggtagtaacgtaggatgattttgcaatgtcaaaatggagagatcacaattaaaatacatttaaaaaataaaaatatatcaatgacacaatgccaaaataaagaaaattaagacatggcccttgtttaacacacacacacaaacaaacactgaagttcctgccccacacctttgaccatgagactggcactctaccttataaatattcaagaaatcagtgacatttctgttacactgaccccttttctcctcctcaaacatgtcccacttgtcagcactttccacttaagactctttgtgtctttctatttaccccttcttgcagactggatccttctcggcatgggagctcagatgctctctactcagagaagtctcccctggccagtctaactaaagttaacccttttccccatttcatttatttcttatattagtgtatatattttctttaggtcctttttcatgattttcacctaaaattatattttctcttcatttttttcctttttttggcaggtgggttacattttttattttatccctactagaacttaacttacatgaaaatagggatgttgtttgtcttgttttccactcatgaaatggcacatagtatgtctcaatttttctatttcttagctgaataaaggagcaaacaatttaattactgacaagcttttgttattgatcaatttcacaagaaaatcatgggaacatttttgagctgtggagaatgtataatcctttgccttctgtcttttaataagtattgaatcaataattccttgcctaaagaaaagtatatgcaaatattcttgaattttaaaaaaatcctatggaaactagagatgagattttgtgtagagaaaggttttccataagctcagaagagattctcagatgtggaggactaaaaagtttatgattccataatcagtactaacttgccctactccttgacaatccaatatggataaaaaagacttcagagaaaatgtcatccagtaagcccagaacagtgtttcaaatcttaccatagccccgtgccacaaacttgtcatggaaacagtggtagacctgaaagggttacatgggctgggacaatggatgtctcattggcaaccagtgtgggtaaatgacagggtcggtgagactccctgacatcttgatgcagcccaagcctccagagacagacttagcctcaagagaagtgtttctcagtcttagcattgttgacgtcttgatctgaataattccagttgtgagaatctgttttgtgtattgtaagaagtttagcaccaaccctagcttctatctaccacacacatttggaccctctcaagtcatgagatataattaaatatgtttccagacattaccgaatatcccctggaaatttggaggcttaggaatcacccacttgagaaccattgctcaagaattttggctcacttggcccaacataggtagcaggagtaagggaaggcccaagaatgactatatttaaatttcccatgagccaagttaaaaataaatttacttgcaaataagtatgtaaactgaaagtcatatcccatataataacattatgtttacaagacaaaagagagaagacattttagtcttaaccagactactggaagaagatatcagaaaatgtatgaaaatgagttaataggtgcagcacaccaacatggcacatgtatacatatgtaacaaacctacacgttgtgcacatgtaacctaaaacttaaagtacaaaaaaaaaaaactacaaacttgcttgcagccttttttaaaatttgttttttaaatttttaattgataattgtatatattatatatttatgtagcatactgtgatgtttacaacagtatatattaacattatgaaatgattaaattctaattaacaaatctatctcttcactcatgtatcatttttttgtggtgaaaacaatattcaaaagggtctgggcacagtggctcatgcctgtaatcccagaactttgggaggcaaaggagggtggatcacctgaggtcaagagttcaagaccagcctggccaacatggtgaaaccccgtctctactaaaaatacaaaaaattagacgggtgtggtggcgtgtgcctgtaatcccagctactagggaggctgaggcaagggaatcatttgaacctgggaggtggaggttgcagtgagccaatatcatgccactgcactgcagcctgggtgacagaatgagactctgtctaaaaaaaaaaaaaaaaaaaaaattcaaatcaatatgcctaagagatatctgcacttccatgttcacaatagctaagagatggaagcaacctaggtgtctttcattggatgaatgaataaagaaactgtgagctctccctctctctatatatacacacacaaacatatacactcagtgaaatactatttagcctttaaaaaaaggaaattctatcatttgtttgtcatcttaataccagaatttaataagctgctttcattctgctgatcttgtttttatcttttattcataatgagattatctaaagatatccagtgctaatctaagtttgcttgattatataatcaactcaagttaactcaactaacatattcgattgtcttacatatacagtcatgttgcttaacaatcaggacacatcctgagaaatgtgtcattatatgaatttgtcactgtgcaagtatcatagagtatatttaaacaaacctagatggtataacctactacacacctaggctgtatggtataacccattgctcctaggctacaaacctgtatggcatgttactgtactgaatactataggcaactgtaacacagtggtaaatatttgtgtatctaaacatatttaaacatagaaaaggtaaggtgttgtgtcacgatgttaagatggctatggcatctaatatggtttggatttgtgctccggacaaaatctcatgtcgaattgttatccacagtgctgagggagggacctggtaggaggtgattggatcacgggggcagatttcctccttgctcttctcatgatagtgagtgagtttccatgagatctatttaaaagtgtgcagcatctcctccttggctcttttcttccacctcctgccctgtagatgtgcctgcttccccttcaccttctgccatgattgtaagtttcctgaggcccctccagccatgcttcctgtacagcctgtggaactgtgtgccaattaagtctcttttatttataaattacccagtcttaggtagtgctttataggaatgtgagaacaaataatacaatgtcattaggtgataggaatttttcagttccattatagccttcttaggggaccattatcctatatgcagtccatcactgaatgaaacattgtcatgcacggcatggccgtatgtagacaggaacaattatgctagatactgggaatcttgaaggaaataaaacacaatccttgccctcaagagagataaagggtaagaatattagatggagatgaaagatattccatagagttatatgatttgagactgaagttgagtggttagagatgaaaaaatttcctgggatgtgtcaggcagaagagaggaacgagtgtaaagcacctgaggaaaaactgggaagatatttcttatatcgccagaaagctggtaggcttgtgttacggtgggatattaatggaacttgaagttaggatacttgggtgtcctaactaaactagttgttttttgttaggccaatctcagacttttcctatgcttaaattccttgacctttaaaatgaagatgagaagtaagtaaaactgataatttttgtaaatcctttgaattttcagtttttatgaattgatgcttaaactgaaaacataataaggctgtgacaaacattaggctggatcaaacacctcctcaacactgagagatctcaacgctagtgaagattcggtaaatctgttgagttcagttgattgaaacatagtccactctaattcatcacatcaattcaaaatagggttaatctcctgaatacacatatctttctgttatagccaccagagggagaaggcatctagtattattctcagttttataacccaagtgtctaacggtgcctggcacacagtcagtactcagtaaatacatattttattgagttaatgcaacagaagaataaatgaagatgcaaataagatgtatgtctctatttgtcaaaatcaagaattggtgacttttcttcttacaatcttttaaaatataattcaaaactgcctccaggaaccattagcatccctctattttgttattatttttctttacactattattatcagtattgtattaacatttaatatgaaatctacccttaacaaatttttaagtgaataacatagtattgccaattataggtacaatgctgtatatatagtaggatctttatttatttatcttgcataattgaaatttcataactttggagcagcaactcctcatttcccctcccctcagcttgacaactaccattctgctcatggtttctaggagtgtaaaaacattagttacctcatataaggcaaatcatgcagtatttgcctttctgctaatggcttacttcacttagaataatgtccccaaggttcacacttgtcgttgcatatgactgatctcctttttttttaaggttgaattgtattccatcttacaagtttatcacattttagttaccctttcatctgtcaatgaacacttagattgttttcacatcttggctatcgtgaataatgccgaaataaacatgggagtccagatatctctttgagatcctgatttcaattctttgggacatataaccagaagtaggattgctggatcatatagtagttctgtttttaattttgagaaacctccatactattttttaaagcagttgtaccattctacattcccaccaacagagtactagggctccaatttcttcatatactcaccaacacttatcttttctgtggctgttgataataggtatcctaagaagtgtgaagtgatatctcattgtattttttttttcatgtccatgatgattagtggtactctggctctaagttatactaagcttgagatgaattcaattttcacctatagcatgcatagaagtgtgtcagtggacctgcaagatgttcctaagttattcttttttctttaattgtttgaattaagctctacgaataagcacacctactaaacatgctctgagacagagctgtgagtttatatcctatttccaaattaggaacagaaaatctatggtaagtgacttgcaaaacttcttacaacataaggctggaactatggtagaacataatatctaggattgactatccagattcaaggtcaaacgctgcccttaatatcttgtgacctaaaacaagaacttaacttgttgagaacacagcttcctcagtggtacatgaaaagattggactaattatttataaaatttcagtcatttttattaactttagaattttatgataggtttagcaaggtatcaggaaagataatgaatatctatttcagaaaactttgtattgtcagcatatcctttattcaacatgctgaatacaattttagatcacaaatctcttatagattgttaacttctcaggaaattagaaacagctttttaaacttcctttatgcaggactatgtaggatgatgtgagggttcttcacgcacagcaattgctgatgccattgacaattgtggcaataccattactcttcttgatctatggggggaggtggttgaaaccatgcaataataataagagcagtagtggggggaatgctaaaaatggtggtggcagcagtagtagcaacagtagcagcagatggctagaaacacaccctgaccttcaactcttatgtctgaatgtcggatcaaaaatcagaacaccggtgccatgaatatcagacctattccaatttattttagtgaggaaaatctcacctttttcatcaaactctatagccaaataaactctacatatgtgattttttttatcttatccttagactagacagtaaaagggagtctaacttaaaatttgttcatttttcttttccaaaaatgctattctatagatattaaaataagagtttcagagaatgtctaatagcagagaaaatgcacttgaaatattgttaactgaatatctgtatatatatgtgtgtgtgtgtatatatgtgtgtatatatgtatatgtgtatatatgtatatttgtgtatattcgtatgtatatatgtgtatatatgtatatatgtgtatatatgtgcgtatatgtatatatgtgtatatatgtgtgcatatatgtatatatatatagtctaattatttaaaactcatattgtccgtgtatgtgtgtgagaaagaggaaaataaaatgaaaaatatatatatatcggttgggtacagtggctcacatctgtaatcccagcactttgggaggcggaagcaggcagatcacgaggtcaagagatcgagaccatcctggccaccatggtgaaaccccgtctctactaaaaatacaaaaattagttgggcgtggtggcacgtgcctgtaatcccagcttctcgggaggctgaagcaggagaatcacttgaacccaggaggcagaggttgccatgagccaagatcaccccactgcactccagcctcagcgacagagtgaggctccatctcaaaaaaaaaaagaaaaagaaaaagtaaaagaaaatatatcaacatattttattaattatcatctatgggttgtagaatattataagtgacttttcctcttttagttgatttgtctctaagttgttacaaaacatttttctatcttttatcataaggaaaaaaaacaagcaatgagtgttataggaaaatctgcttaaggttgaacgtaccatttcaaggacgtgtcagcaatacaaaaaggacaagattgcaaaatctgcagtggggtagtatagctggccttgtcaccttgcaataggtctatcaacgttgcatgatatttgaagctgatgtggacacagaaaaaatctttcgattgacaagaggaaaattgcagtgtatgtctttattatcagagcaaacattaaagggggtggtgacagcagatacagagaagtgtcccttaccaggtcccatgctatttccctgttttgtatggtcttttttgttctgtggatgcgtaaaagctgttacttcattattttaggtattacattttcagtgtcttggaaagtggttttacaaaagttttccataacaaagattttgagggaaagagatgttgtggtttgacttcccaatggggaatatagatagatagatagatgatagatagatagatagatagatagatagatagatagatagatagacagatagatgatagatagatagagatagagatagagatagagatagagatagagatagagatagagatataaactgacacgatgtcttttactttcagaaatcgttaagctgccaggtatagtatcaacaatcctaaccaaattcatctggttacatttgcaaagtaatcctaggcacagtaataaagcaaaaaactgcctgctgtgttccagccacggatgttaagtaaggataagcaggacggccaaaactgacactcctatttcactggtcaaaaaaaaatatgaaagaaattacacattactgtaggggggtgttgctccataagacagtaattcagatctatattagacttttggacatattattcaaggttactggattgaagtttgctttatgggacataagaattccctacactgctaaattaaagtagcttaagttggcagcttatatataaaatagaaaactagaatgcgacaaaacaaatatttggacaacacctaaggaagaattatgctctgtatttaaagagatttttaagttccaaaactaaaaggcctatttgtagaggcaagtgaatacatcattgtataagatgtagtcagatataagtggctgtgaaactagctcatggcaaatgcattgtgctgtttctacacagacttgtcctgaccaaaggaattaggacaaatgaggaaacaaacttaatgtggagaattgttttttttaaaatgtccatgtatttcttaacatattaaatattaaatatatacacaccatagaatctagtcattctacttgttagtatttaccaaagaggaatagaaacacatattcacacagacttgtatacaaatatttatagcagatttatttgtaatatcccagtagtgagaacaactcaaatcttaatcaacagatgaattatttaacaaatggtatgcccatttaatgaaatatgattcagtaataaaaaggaataaatttgattaaagcaacaatatttatggatctaaaaataattatactgagtaaaagaagctaaataaaaacacatactgtatgtattagtctgctctcacactgctatgaagaactacctgagactgggtaatttatgaagaaaagatgtttaatcgactcacaattccacaggctgtgtaagaggcatggctggggaggcctcaggaaccttacaatcatggtggaaggtaaaggggaagcaagcacatcttcacatggagcaggagagacagagccaagggggaagcgctgcacacttttaaacaaccagatctggtgagaactcattcactatcacgagaacagcaagggggaagtccgcacacacgattcaatcaccacccccccaggcccctcctccaacacatgtggattacaattcaacatgaaatttgggtggggatacagagccaaaccatatcactgcatgattccatttatataacattctaaaacttgccagtcaatctgtagtggcagaaatcagatctgtggttatttgagagttggtgggaggagtgaacagattgtgaaggggtatgagtaagcttttgggtttgatatatgggttccttatcttgattatggtgatagccttggggttttatacataagccaataaaacatattaaattgtatattttaaatgtgcattttattaaatgttatgcctcaatgctgtcaaaaatgtgaaatgcctatatgaactcttattacatagtgtaacattgtttggcaaaatactatattatatatgctactaatataatatagtatagctgaagttctgttgaataaatacataaaagaagtagtaatgctacaagatcatttttaatcaattaatatacacacttattttctattttaaaaaatgaacttgattttgcagcaggggaccacatattttgttgttgagtaatgaaagatgagcttcagttgagagacaccttgttcatgagtcctctcaccagaggaacttagagatcaagaaacattgcagcttttagtaagcatgctaccaaatgtaggcttttctatatggatgtgaatgtgaaaggaccactaataaggctggcaatatggcagcaaatgtgattctcctatcactttatagtgtttatgaaatatcaaagcaagtttcatttaagtcaatggttttcaaaagtaatttaagtagtaaaaccatttttaataaaattatagaatgccaatattattgacaactatataagagtactatggagctatcctaagtaagccataacaccacggagctggtgtgtgtggatatacagtgtgaagtctggatcatcaggccactggccctgcccgccttctaaagcagcccaagagagagaccacagctgagggaccaccatgctgtgtaacctgggagagttaccgtcagatgtttgattatgtctgactgaattggcatggaccaacttttagttaaacatggaggatttaagaaaattatgcacctatacttcctcttatatacgactaatttgactatagtttatttaaaaatataccagagttaagtaataataaagcaattacaaataatcattgtaataagtacaggtggcatctactggatttcatcagctttccttatgtctttgctttgtcctatttttttttaggaacctccctctctgttactactccctttggatttatccagtagtcttagacgtcaccagggccaagccatgcatatatagattgaaatgttgttttcaaaacctactcaagctatctcttgatgaacaagattagtaccatctgattacaaccctgaaggtatatgctaaagaaaactaataataacatatactattcttaaaatcaatcattctttttacaacatgaccgaaataagtcccaggcactctttagctatgctctgtcctctcttttggaataatcttttcttcccttctaaccgtcaccttatattcttatctttccacctattcaaagtaatttagtatgtcaacaatgttttttctaacattgttctgtcttagaactttttctccctgcagatctcatccactatgcagaaaccagtaataatcatttgtctctgtaaaggtgactttgttttaaaattagttttacaatgagagagctgatctactttggaaaaggatcactgttatcaatgtggcaagatgaaaaagcatgccatattctatctacttggtttaattgaaccaagcatcagcttggtttaattgaattaaccgcaatgactgtgtttgtgtgtcacactattctttttatatttatatttattattactattttttaagagagacagggtctccctatgttgctcaggctgacctcgaactcctgggctcaagcaatcctgcctctgtctctcaaaatgctgggattacaggggtgagccaccatgcccagccacactattctttttaaatttaaagatataaaacattgatttttattaaattttaaaacagagaacttttaaatagatacagattacattcagcaggtattcatggattacctactatgtatgaagtacagtatgctaggtatggtgggactgtcataaattagatgaggataccaccattatgaagctaatgtaacattgcccaagttctgtgtactgttttattcaaaacttcatgaatattgaaacagtgttcacatttttctatcaacatacagtattatttgtaagatgaaattgttaaatttaattacaaagtgttcagtttggtttgttttgctagacaccctacaagctgttcctattactctctctcactctaatgtttacaaattgttatagcttagtgctaaagtgaacagcagagtactcttcaagattttctaggatcttgcagacaaatgtatacatatattttttactcctcatgctgttttatcactttttgatccctcctaggggattaggctgtgtaattgtaaagcttttttaggctttaactatggattatttgtataatgaaaaaataagataacttatattatatattgaactgagtaaggggtaaattcagtcattcttaggtaaaaagacaggataattaggttctcattcttgtttttcattcgttcatgtattcaatcaattttttttattaaataagcactcattaatatgccagatactgtggtagttgctgatgaggaaccaataaagagcccatgtggtatcaaagggctttcctgtctaatatttatttattctgttactctggaaaacttatttggcatctggtttcatatattgaaaaataaagatagctgtctctgccttctttatgttctatattttacctctttctcattgtaaactttgtatggtcaatggagaaggatgtggattcaactctgaatatacactatgtaaggcacacttttcattctcgtgtgaaactagttttataactcagctcagagcacacagtaggttctcactaaaaattttatcttccttctcttttttcttttctaagatggtagtgtagaagataagttgataccatgcacattcaaataattaattttaaattatgataaaccatggataagaagttgtgtagcattaatcatattaaattccttcaattgtgatgtacctatcttatagggttgttgtgaggaatatatgacagtaatgtaaagtactgaatatagtgccaagaacacaataaatgctcagtaaatattagctatcatgtcattctgacttatgtcaataaatattaagtatactgtctagttaatactgttagaattacattaaataaataatgtagaaaatttgtcctggtccagttatctactgactaggtgaccttaattatgtctttttttgttaacttttagagtctagattccttattctgcaaaatggatttattgtatctcaaggcactgtgaagtttgcagtagtaagttatatgaaaatttttaaagcattatgattataaataatatgattataaattggagaacagctgctaacacaattaagaaatttaaaaatattattgcttttttactttcactcacattttgttttgttagataattgaaaacactaagaagtaacttttagagaagctaggttgtacccagacagtgaaagtttaaataagttttaaaaactgaaaactattttctctttaaaaggcatgtataggcaaaaaggaaagtccaaagagaggaaaagaaagcaggagagatctgaaatgacacaagaagtgactcagaatgggaagattgtgcactccttgttgtcccctaatgcacatggaagtatgcaacagaagctgtgaaaataacccaggtgcgaaggccaatggttttcatacatttcaagcttctctccgtgatgtccttttccatgtaaaatctaaatcaggtgtcctatatacataacatgaaatggagatgtaatgcaactgaagctaggaaacaaaaatcttgcctactagccttctctcaaaccagtgatcagaaccctgagttatttctttgagagactaagtacaacacagaagctcaagcatagaaattaagagttaaaattatgtcaagtttcttcactgaaaaagatccctattagcctttgacctaattttgttaatttataatggaagttaacaatcactaaatgttattgcttataaatctctttacctaatttaaaacactgctagttgtagctagaaataggtatttctttatttcttttagctatgtattccttcaaaagaagctccagacttttaaaattgcaccacctcagtatttcctcagtttctttttttaatacaacatacatacacacacacacacactatcttatatatactagcttaataaatcacatggtattttagaacagatcaaaacttggaataatcatgtgggaaaaaagttgtagccaggtgcagtggttcatgcctgtaatctcagcactttgggatgccaaggcaagtgaattgcttgaggtgaagagttcaagagcagcctgggcaacatggtgaaacccctctctacaaaaaattagcaaggcatggtggcacatgcctgtggtcccaactacttgtgaggctgagttggatagatcgcttgagccctggaaaaagaggttgcagtaagaccacaccactgcactccacctgtccagcctgggtgacagagtgagaccctgtctcaaaaaaaaagttgctgaggtttaccaactttttaaaatatttgctcttagacaaccagtaaaattgtttctggtacaaaagatgttcatggtttccttccaattacaaattaaaacatattgctatggttttgttataaatacttaatcacataaatgacaacttcccacacaaccagattgaaacatgacaccagtgttatacttatcaggcagagaatttaaaatactactcttaataaaggctagaatggaaaaacagataacaaacaaaaggtagtgggtaatataaatagagagatgaaaactctaagaaaaaaatcaaaaggaaatataaaaattcaaaatcactgtaacaaaaatgaagagtgcctttgataggcacatcagtagactagacacagctgagaagagaatcagtgagcttgaaatttgtcattacctacttcccaaattgaaatgtgaagagaaaaaaaattacttaataaagagcatccaaggagtgtggaacaattagaaaaggtgtaacatacattacatgtaatagaagaaagaaaaaagaaaatgaagcaaaagaaacattgaaatgataatggctgatcgttttcagcaattcatgatgtataacaaactatagatagatgaacctcagagaagaccaaacgggataaataccaagaaagtacagccaagcatattatattcaactacagaaaaccaaagacatcttgaagaagtcagtgaaaaaaggataagaatgataggatacttataatcagaaaccatgtgtaaaccattttcatactgctgataaagacataccaaagactgggcaatttacaaaagaaagatgtttaatggacttacagttccacatggctaggaatgcctcacaatcatagcagaaggcaatgagaagcaagtcacatcttacatggatggcagcagacaaagagagagcttgtgcagggagaactcctctttttaaaaccatcagatcttgtgagactcatttactatcatgagaacagtgcaggaaaaacctggccccataattcaatcaactctcaccaggttcctcccatgacatgtgggaattgaggagttaaaattcaagacgagatttggttggggacacagccaaaccatataattccaccccagcccctcccaaatctcagtcctcacatttaaaaaccaatcatgccttcccagcagtccacaaaagtcttaactcatttcagcatgactcaaaagtccacagtccaacatctcatctgagacaaggcaatttccttctgcttatgatcctgtaaaatcaaaggcaagttagttacttcctagaaacaatggaggttcaggcattgggtaaatacagcaattccaaatgggagaaattggccaaaacgaaggggctacaggcaccatgcaagcgtgaaatccagcagggaagtcaaaccttaaagctccaaaatgatctcctttgactccatgtctcgcatccgggtcatgctgatgcaagaggtgggttcccatggtcttgggcagctccgtccctgtggctttgcagggtacaggctccctctcgactgcttttatgggctggcattgagtgtggcttttctaggcacagggtgtaaactgtcagtggatctaccattctggggtctggaggatggtggccctcttctcacagatccactagacagtgccccagtagggactctgtataggggctctgaccccacatttcccttctgcactgtcctagcagaggttctccatgggatccccaccctgcaataaatttctgcctggacagccaggcatttccatatatcctctgaaatctaggtggaggtacccaaacccaaattcttgacctctgtgcactggcaggctcaacatcatgtggaagctgacaaggcttgaggcttgcaacctctgaagccatggcccaagctcgacatttgcccctttattcatggctggagcagctgggaggcagggcaccaagttcctaggctgcatacagcacagggaccctgggcctggcccacgaaaccactttgtcctcctaggcctccaggcctgtgatagaaggggctcccatgaagacctctgacataccctggagacattatccccattgtcttggtgcttaacatttggctcctcattacttacgcaaatttctgcagctggcttgcatttctcctcagaaaatgggattttcttttctatcgcattgtcaggctacacattttctgaacttttatgctctgcttctcttatataactgaatgcctttaacagcacccaagtcacatcttgaatgctttgctgcttagaaatttcttctgccagataccctaaattatgtctctaaagttcaaagttccacaaatctctctagggcaggggcaaaatgctgccagtctctttgctaaaacataacaagagtcacctttgctccagttcccaacaagttcctcatctccatctgagaccacctcagcctggatttcattgtccatatcattatcagcattttggtaaaagccattcaacaagtctatagggtgttctaaacttttccacactttcctgtcttcttctgagccctccaaaccatttcaacctcttcctgttacccagttccaaagtcacttccacattttcaggtatcttttcagcagcaccccactgtactggtaccaatttactgtattagtctgttttcacactgctgatgaagaaatacttgagatggggcaatttacaaaagaaagaggtttaatggacttacaattccacatggctggggaggcctcacaatcatgaaggaaggcaaggaagagcacgtcacatcttacatggatggaggcaggcaaagagagacagcttgtgcagggaaactcctctttttaaaaccatcagatctcatgagactcattcactatcacaagaacagcacagaaaagacccaccctcttaattccatcacctcccactaggttcctccgatgacacatgggaattgtgagagttacaatttaatatgagattttggaggggacacagccaaaccatatcaccaaataagagagtagagtaaattttttgaattgtcaattaggaaaaagaactctacatttctacacacagcaaaattattcttcaaaaacgaagaagaaataaaaactttctcagacaaacaaatcttggaaaattcatcaccagcacatctgcccttcaagaaacattaaaagaagttcttcagtgagaagggaaatgatgtgttagaaacttagatctaaaaaaagaacatcagagaagcactaaatgaaggtaaaattaaatctttttttcttatttttaattgatctaatatgtaacatttgttcaaaataatactagtaacaatatattgtatgattgtagcattgaggtaaattaaatgaatgatagcaatattataaagagttgaggggaggaattgagaatactgtattgaaagatgaccctactacccagaaagcagttttatgaaagtggacctaattgtaaatgtatattgcaaactctagggcaagtactcagttttttaagaaaagtataagttatatgctgacaataaaaaacaaaatagaaaccatatgcaatgattaaaactagagaaggtagaaaagaaaaaagaaatgaaaacaacagaggtaattcatagaaaacagaaatactaataatcactttaaatgtgaaaggtctgcagcatcatttaaaagacagagatgttcatgcttagaatggagtattcttcataaatataaagaaatgaactatcaagctatgagaacacctggatgaactttaaatgcttatagctgggtgaaagaatcccacctgaaaaggctacagactatatgatcccaattgaacagtatgttgaaaagaacaaaactagaggaacagtaaaacaatgagagactgccaatgattcaaggcgagaggaggaggattgaataggtgaagcgcaggccttttttgactggtaaatcaattttgtatatattaatggtggatacatgacatacctttgtcaaaagccatagaaatttacagcacaaagagtaaacctcaattatgtaagttttgaaaaaatcatttaggagggctaggatcctaggaaagaatgcaaagtttgacaacattatttacacatgttctgattgtaacaaataatctcactgtatggggtatggagagggaaaagttgctgatctaataaactttgaaaattaatgtaatccataagactgaagtcaaaaggaattaccagtaagcaatatgctgcacttgataaagctactttccataagggtacaggttaatgattctcataatgttatactagtgtactgaaattaaacagttaggtaaacaaatgatggtgatgggagtcaggtttttcattgttagaatagaagtttatagatgaacaagggaagaaggctagaatataaattcatgtttagctaaatatagatacagatgtagaaacatttatggacatgtggatttaccttagttagtatgcacacatatattcccttgctctgtcagctgtcacctaaaagaaatgacaccttagcagcaacaagcatggctgacactcagattttggtttctgataccattcaccaataaaggggccagggctccttagagaaatgctaattctacgactgggaaggaaatatatagaaagaacctgaagtattagatactgccaaaaaataaggaagaactaaaaaatttaaatctgcaagtacacactgaaagagttgtcaatagccatatctggaataatttgagcagtaaaataaacaaagcaatatggaattctaacccaatgtataaactaaatatccataagtccatagtgatagaaataaatgactgaatatataaataaattgaagaacatatacaaatataccctgaaaagcaattccaagtaaattccaaataattccaaagtattatatagcctgccctcaaggagcggaaaataacttccactccttaactgtgggctacatagtgacttctgtccagggtagagtgtagaaaagggggaaaatggccgggcgcggtggctcacacctgtaatcccagcactttgggaggccgaggtggatggatcacgaggtcaggagatagagaccatcctgctggctaacacggtgaaaccccgtctctaccaaaaatacaaaaaaattagccaggcttggtggcgggcgcctgtagtcccagctacttgagaagctgaggcaggagactggcgtgaacccaggaggcggagcttgcagtgagctgagatcgcgccactgcactccagcctgggcgacagagcaagactctgtctcaaaaaaaaaaaaaaaaaaaaaagggaaataaactttatagtgtagatactacaacctcagccaggtcatcaatgtcaacatcaacagcaatacctaatatcaatacttgaaatgatatgataaaaatggtactttttctcactggtcttcctcccaaaaccacatattcccagactaatcataaggacaaactcacaaattccaataaagtgacatcctacaaaatctcttatctgtattcctgaaaactgtcaagttcgcaaaaacaaggaaagtctaagaactgtcacagccaagaaaagactaaggaggcatgactattaaacgcaatgtaatatcctagatagagggctaggaaaggaaaaggacatgagataaatactaaagaagtctgaataaatcatgaacttaatattacaatgtgcacttattaatttttaacaaaagtactatatgaatgaagatgttaataataagggtataagccatatgggaacgctatgttctatcttctcaattattctgtaaaactagaactgttttgcctgtaattccagtactttgggaggccgaggcgggcgaatcacgaggtcaggagtttgagaccagcctggccaacatggtgaaaccccatctctaataaaaatacaattagctgggcgtagtggcagacgcctgtaatcccagctacttgggaggctgaggcaggagaatcgcttgaaactgggaggcagaggttgcagtgagctgagatcacaccactgtcctctagcctgggtgacacagcaagactccatctcaaaaaaagaaaagaaaaacagttagaactgttttataagataaagtattttcttaattcaggaactaacaaggtagaacattaacatacaaaagttactaatcttcatatacacaaacaataatcacttagtcaatatagagaaaagaaaataatctgtttacaaatgcaatagaaataacaacttatttaaaaataaatttggaaaaaatgagctaaatttctctgagaaaaactttcaaatatgccaggtccacataaaaacctgcacatatatttatagcagctttattcataactgccaaaaattggaaggaaccaagatctcctttggtaggtgaataaatagatatactgtggtacatccagacaatagatattattcagtgacacaagcatgaaaaaaaagctgccaagccagaaaaagacatggaagaaacttaaatgcatattaccaagtgaaaaaaaaagccagtcggaaaaggctacatactgtatgattccaactatatgacattctggaagaggcaaattatggagacaataaagatcaacagttgccagggcttagagggaggggatgtataggcagaacacagaaggcttttagggcagttaaactactttcattacattatgatggtgtttaatgtccaaactcataaattatacaaccaagaatacaccctgatgtaaggtacagattttgggcaaaaattatgtgtcaatgtaggttcaccaattgaaacaaatgtacccactctggtggaggatgttgataacgggaaaggctgtgtgagtttgtgtgtgtgtgtgtgttgtggaggctatctctgtaacttttattcaattctgctgtgaacctaaaaaatagtctgtttaaaaaaaaaacaaaaaacaaaaaaaaaacttggctgggcgcagtggctcatgcctgaaatcccagcactttgggaggccgaggaggacagatcacctgaggtcggaagttcaagatcagcctgaccaacatagagaaacaccatttctactaaaaatacaaaattagctgggcgtggtggcatatgcctgtaatcccagctactcgggaggctgaggcaggagaattgcttgaacctgggaggtggaggttgcagtgagccgagattgtgccattgcactccagcctgggcaataagagtgaaactctgtctcaaaaaacaaaaacaaacaaaaaacttctattaaggtacaggcaagcagcaagctactctcacattgggcctctggaatactggcaggatgaaattcctcaaccaccatggcattggagttgccagggaaagctgcttagagaagtggtaggatcagaactccagccagggtggagcccagagggtttggtgtgggattgtctgtagtgcagcatggccagggacacccatcaccttaagctcgacttgcttccataggagactttagccataggagaactgttgaacgtgaactctgcagggcggtcttgcctctgagatggggttgattagacctgggcaaccctcagtctactggcctcttctggggccccagcctggccgtgcctgcttgcagtgcagcccccaggtacctgtgggtgtctgcatcatagctcctgctcttgtggactgcacctgataagcagagtgctcctgcagagtggcccccaagacacacaccaggccatctgtgtcctcccctcactgcagcctcccccagccactgtgcctgcatgaacacaccataggcacccccccacatcacttagccagtgcctatgtgtgcccttgggttggatcttgcttttacttccccgacagtgcacatgaaccctgcactatgccatgccactactgcctgcatgagggtaccccaccacccttctccccaccacaccaccattgtcctaggagcattggcaggcatgaaacctgcctgcttcacctctgccagcatcctgcccctgtgccaacactgccatcagtgctaaactaggcacacagaacagtgacctgcccccagccctgagcggccaccatgccagcatgaacacatgcagagggcacacatagtcctgcacccaccacaaacatacaacacaccataatctctgggacatagctaaagcagtggtaagagggaaatttgtagcactaaatgcctacatcaaaaagttagaaagatctccagctcacaacctaacattacaattaaaggaactagaaaagcaagagaaaacccaccccaaagctagcagaagacaagaaataactaaagtgagagctgaactgaagactgagacacgaaaaaccattcaaaacatcaacaaaatcaggatctgttttttttttttggaaaaattaataagataaactgctagctagactaatgaaaagaaaagacagaagatccaagcaaacacgatcagaaacagaaaggggaatattactactgactccatagaaatacaaagaatcggccgggcactgtggctcacgcctgtaatcccagcactttaggaagctaaggcaggaggatcgtgaggtctcgagttcgagaccatcctggccaacatggtgaaaccctgtctctactaaaaatacaaaaaacgagccaaaaaatgagcctggcatggtggcacgcacctgtagtcccagctactcaggaggctgaggcaggagtattgcttgaacccgggaggtggaggttgcagtaagcccagatcgcaccactgcactccagcctggtgacacagcaagactccgtctcaaaaacaaacaaaaaaaaaaaaaaaagaaagaaatacagagaatcatcggagactattatgaacaactctatgcaaacaaactagaaaatctaaaagaaatggataaattcctggacacagacaaccttctaagactgaaccatgaagaaactgaatccctaaacagaccaataatgagctctataattgaatcagtaataaattgcctaccaaaaaaaaaaaaaaaagaagaagaagaaaagccctggaccagacggattcatagctgaattctaccagacacacaaagaagagctggtgcctttcctactgaaacttttccaaaaaattgtggaggaggtgccccctcttcaactcaatctatgaggccagcatcatcctgaaccaaaacctggcagagacacaacaaaaaggaagacttccggccaatatccttcataagcattgatgcaaaaatcctcaacaaaataccagcaaaaatccagcaacacgtcaaaaaactaacccaccacaatcaagaatgctttattcctgagatgcaaggttggttcaacatatgcagatcaataaatgtgaactaatgaagaaaacattccatgctcaatgatcacactgcacaaagtaataatttgtagactcaatgttatttctatcaaactaccaatgacatttttcagagaactagaaaaactattttaaaattcatatggaaccaaaaaaaggcctgaatagccaaggcaattataaacaaaaagaacaaagctggaggcatcacattacctgacttcaaactatactacaggactatggtaacaaaaacagcatgatactggtacaaaaacagacacacagaccaatggaatagagaatagagagcccagaaataaggccgcacatctacaatcatctgatcttcgacaaagttgacaaaaacaagcaatggggaaaggactccctattcaataaaaggtgctgggataacaggctaggcatgtgcagaagactgaaactggaccccttccttacacagtatacaaatatcaactcaaaatagattaaagacttaaatgtaatacctaaaattataaaaaccttggaagaaacctaggcaataccattcaggacgtgggaaggggcaaagatttcatgacgaagacactgaaggcaattgcaacaaaagcaaaaattgacaaataagatctacttaaactaagagcttctgcacagcagaagaaattatcaacagagtaaacagacaacctacagaattgaggaatatatttgcaaattatgcaaatattttctgacaaaagtctaatagtcagcatctataaggaacttatacaaatctataagacaaaagcaaacaatcccattgaaaagtggacatgaacagacacttttcaaaagaagacatacatgcgtccaatgagcataggaaaaaaagctcaatatcactgatcattagagaagtgcatatcaaaaccacaatgagataccatctcacaccagtcaaaatggctattaataaaaagtcaaaaaataacaggtgctggcaaggtagtggagaaaaaggaaagcttatacactgttggtgggagtgtaaattattagttcaaccattgtggaagatctgattcctcaaagatctcaaaacagaactaccattcaacccagcaatcccattactggatatatacccaaagaactataaatcattctgccataaaggcatatgcatgcatatgtttattgtagcagtattcacaatagcaaagacatagaatcaaactaaatgctcatcaatgacagatttaataaagaaaatgcagtacatatacaccatggaatactatgcagccatataaaagaatgagatcatgtcttttacagaaacatgaatggagctggaggacactatccttagcaaactaatgcaggaaccaaaaaccaaataccacatgttctcacttataggtgggagctaaatgatgagaactcatggacacaaagaggggaacgacagacactggggactaccaaagggtggacggtggcaggagggagaggatcaggaaaaataactgttggttacttgtcttagtacctgggtgatgaaataatctgtacagcaaacccccgtgacacaggtttacctatataacaacctgtacaagtaccccagcacctaaaataacatttttttaaaactccagaacatacaaaatgtacttgaaaaaaaatagaaaggcaccccatgatctacaaataaacatcacaaatatgtaaattctcctatgttaatatagttgaatcctatcctaataaaaatactacaagatacttttctggaataaaacttgtgggaaaaatatctagccatgtgcagtggctaatgcctgtaatcccagcactttgggaggccaagacaggtggattacttgaggtcaggagttcgaaaccagcctggccaacatggcgaaaccccatctccactaaaaatacaaaaattagccaggcgtggtggcagccgcctgtcatcccagctatgggggaggctgagacatgagaattgtttgaatgggggttggaggttgcagtgagccgagatcacgccattgcactacagcctggtcgacagagtgagagtctgtcttaaaaaaaaaaacaaaaaacaaaaaacaaaaaaaacagaagaaagagagaaataaagcgagaaagcatctaagaatatcctggaaaaaaaaaaagtcgatgaagcgggattagcccaattagaaatgaaaatatacactaggtgatctgaaatcagtctatactggttctcatatccacagcacaatgtaacaataaaagaaagtctagaaataaatctatatttggcaggtaataaggatgaaatctcaaaaatgtttgaaaaaggtagacttttttaaatgaatgaggttaggaaaactgtatactcattaggcttgacataaaatggatgtgaacaacatactctatagcagaataaacttcacatgaatttttaaaaatctaacttaatagaaaagtaacatacagaaatagaagaacatctggataaattatttacatcctcatttgggtaaactctagcaaagactcaaaatgcaatgcaatgaaataaaagattgataaattcaactacaggcatattaaacattaattgaatgacaaaaacaccacagtcaaaatcaaactataaataattagaagaaaatatcgacaacatgcaactccgataaaaagctaatatctctaaatgtataaaaaactcataaaaaccaagaaaaaagaacattaaagtgatcttcattttaaataagaggtattaagactccacaaatatgtcatttccaccctgttagactagcaaaaaatttaaaatcttaataatacactctgttggtgtggctgtggagaaatagcactttcatgcactggtggttagattgtaacagttattttttctaagatacaaatcaatctttggcaatttctataaaaaatctgtatgagaagttcattatttgtagatattatagaaaatattaaaaacaaattacatggtttactatgtagtactaaaaataagatgaggaagatttgtatgagataattagaagtgatattcaagatgttcaattaagtgggaaaaacaagtataagaatatataggtatcagaagcattttctgtatgaaagaaggaaatttaagaatatttgctttcaaacagaaacatagggtagataattagtcattaaccaaaatggttaactacaagatgcaggtgtgaatggatgaaagaattaagaatgggtatcagacttgtgcaagcatgcgtttgtatctgtggtgattttttattcatataaaggtcaaaatgtcacaaaataaatacacatttttaagacagcaaaccataaattaaatataaaaataagaattgatcctaatagttattaacagagaaaaacaaagatttaagtcaaggaaattttgatcacagtactctgtacactcttggttggaaatattataacaaaagaatcttgaactttacatggtaatggtactggtaaaatgattctgaaaatattttgtgtgattgtagatagagtgaatgtttaaagatattgttgtattggagaactagaattcttaatgtaagaagagatactgaactggaatgaaaaatgataagaaaatattcttgatcttatatttgaataagaggtattatttttcataatgcaatatttcttagctagtaacagtaaaagaatgacacctcaattgcaacaaaaacacataacaccgaggttttgatgactaaatataattcttcactacaaggaactagaactgtttggagatatggttctttctggctaaggtaatgtgtgcaatgaacgttgaatattttgttgggcgagaaggcaaaaaaactgccccaaacctagagatcatgactaaaaacacagagaagctagtttaaaagttctcccctaaaaatgtttgggacaaattagctaaaaaaattaatgatttcagtagtgttaatgtattaaatcatttcatcaatcccatctgtaacagtgagagagaaattgaaacagcttttctttgtagaaaaatcacagctaaaacatatagaaagaataaaataaaatcactattttgctaccagtaatgtactaattgattaaagcaagaatcatcaatggatgctaaattcattaggtaaaagtgttgttgaacaacaaggatgttactatgatctctaagtatcctcaagcagataattaagaacaaaagaaaaagtgtttcttcacaatgcggagatattgcagacaccgcctttactaagtaaaacctatctatcattactgaaacaaaatagcttgcatgcactggtgttctgctaaatgtttaacaattgactctaaaacacatgcatataaaaagggcaaaatgcttatataatatttacaaatattaatagaaacgatatgtaacacaattttttttttttttttgagatggagtcttgctctgtcgcgcaggctggagtgcagtggtgcgatctcagctcactgcaagctccacctcctgtgttcatgccattctgcagcctcaacctcccaagtagctgggactacaggcgcccaccaccacgcctggctaattttttgtatttttagtagagacgggggtttcaccatgttagccaggatggtctcgatctcctgaccttgtgatccgtccttctcggccttccaaagtgctgggattacaggcgtgagccaccgcgccaggccacgtaacacaatttacaaataacatataatactctttattgtaaactgcatataataaatcaattctcaaagaatattttcagttttattgccaaattgtcttcaattcatgttttggttgttaagtgatgaataagtgtagttctaacatggatgttggttaatatgtttgtttaccttaatgagtaagaccaacaaaaaacaataaagatgtatgccagaacttaatcatggcataagctactttttactaaattggataatagttttcaaacactaaatagtaatttcttcactttttttttttggtgttacaaggtaattgttatacacacagcaaaatataagtttagtctacattattaacacttttctccatcactttctgacaatcagtatcataaaccatgttctgatgtgtagcatttgccaattcttgcaatgtaattactgcacaatggcctacttccagctattaatgtgacatcactgaaagcggagtttagaagagagcattgtgttgtattatctccatgacagatgtaaatttggtaaaataattaagaaggaatgaaattttagtatctattacatttgcttaatacttattatttgtgagttcacataattttttttttttgagatagagtctcactgtcgcccaggctgaagggcagtggcatgatctcagctcactgcaacctccacctcgtgggttcaagcaattctcctgactcagcctcctgagtacctgggattacaggtgcgtgccaccatgcccagctatttttgtatttttttagtagacatgggtttcaccatgttggctaggctgttctcaaactcctaacctcaagcgatctgcccacctcagcctcccaaagtggcttgagccaccgcgcccagcctagttcacataatttaatgtttaataatgaccatgtttaacaactagctcagagacttcttgagacttttttttagcaatcagcttccagcaaaccactgctttgacgtgactcctgtgcaacgcaatgaggatacaatatcagcttcatagcacttctacaaaagatatttaatcttttaattataaggaaacaatcaggaaaatccagaatgttagatattcaaaaagccctctagcttggaatcttcaaaattataaatgtcatggaataccaaatgtaaaaaaacaaagtaggaggactgttctggattaaagaaaaccaagaggcatgacaagaaaacccaatgcatgaatctcaattacatacaatggcagggggcagggacagaaaaaaatttaaaactaaaaacaatacttagagaaatttgaatatgaaccatatattaaataatacaatatcaacattaaatctgttaagtataataatattgaggttatactggagaatgccattgattttatgagatacgcggaacagcaaaaataagtttgtggactgggtttggtgcctcatgccttaaccccagcagtttgggaggctgaggtgggtggataacctgaggtcaggagttcaggattagcctgggcaacatggcaaaatcccgactcaacaaaaaatttacaaaaaagtaagtgggcatggtggcacgtccctgtggtcccagctactctggaggctaatgtcgggggatggcttgagtccaggaggtggaggttgcagtgagccaagattatgtcattgtactccagcatgggcaacagagccacatcctgtcttgaaaataacaacaaaattttgtgcatagatatataaataacaataaatgatatatatctatatagagaaaaaacaaagaaaataaaatagtaaaacttattaaatctaagtaaaagaacaaaattactccaaagaaaaaataaaagcccgcagtctttgaaaagtatatgaaagaaataataataaacccaaatatatgtatatatgtatgcattaaatttaaaatttgcattttcaaagacaaagtttgaaactttctccttgaatccagaacaattattttagttgctatttattgagcaacaggtgtggatcaagaatctggcaatttactttatctatattatctcaatgcctccaaccacatgatgacatagtaattcttattgttacagataacaaactttgaatactgactatctttgggcaatgatatcatgctatataaccaacaatccataatggtcaaagaaaaattgtttctatatggccttgtattttgttgaggcaaagaaaacaatagtaggcttattcatgataattctttatgtattttgctcatttgatgataaaaatccttatttaaaagacgaattgggctgggcgcagtggctcacacctataattccagcactttgggaggccgaggtgggcagatcacctgccatcaggagtttgagaccagcctggccagcatggtgaaacccggttggtttcacttctaaaaatacaaaatacaaaaatattaaaaatacagaaatcagccaggtgtggtggcatgcacctgtaatcacaattacttgggaggctgaagcagaagaatcgcttgaacccaggaggtggaggttgcagtgagctgagattgcaccactgcattccagcctgggaacaaagggagactgtttcaaaatgaaatgaaatgaaataaaaataaaagatggattgacaatgatcaaacatctggacctttacacatcactctctctaaataagagtaatttaacattggtcttcatttcttcacaatttcaaatttctgcactatatgaccaggaaagccaaagtttcccccaggctttctggtcatgttgtttgcctctgccctgtgtgatttttctcctgactcaatgaagggaattctaaaatctgacagattagcaatgaaatcttttacaccatttcctaagattcctcttagatttatggctgcacgcttagggatatcatgatgccgaaatgttaggcgagaaataaaactatattttcccctttcttacttcagtggagcacaatttccatttattcacactgtatttcctcacacaatatgttcttcccacccaaggctataaatttgaaaatatttataggcaagattacccctgatgccatttataccttgatggctttgtgtttcagctcctaagagccactcatatgtcatatgaatggcttacaaccatgtactgccttggatttttccctgtcaaatgcaaggcccttctttgactacaatactcttgattcaatttattattaataacacaccctgctaatgacttcaaagaaagcctctttatgtgtgttcagaggtttcccaactcttgctttctaggttttacaagtcacttttagattttgagagtgagggttgtgttccccccttttctcctatatgtatttttataaaaatattcaaattatgacatttctcacactacaatagaccatcataattgtccctctcattgtgtcatatttttcaagtgaaggacatggacagacactgcaagcattatacagctctgggcgggaatcaggcagacaggcctgtagtttgtacatagaaatccagcctcagtcatcctgagatgatgtttaggtcaaacaagaagggaatatcctgggttgaactccaataaagagactttgccttcgtccggttctcccttttcctgatgattttgtaaagggactaggaggatcaactgggtatgtggcaatgggggcttttgtggttttgaaggtggcctcattagtgaatatgagtatcttgtaactgcacgctccatgtctggcatgttgcatagcaatcattaaagcagctataaaactttcagatatgttgagattttgagcagctccatttatgcacagagtagggaccaaaattctaactaactaatcgccacataacatgaagagagcttagaaatcctaaagagagaaaacctattagttgttcctcatccttcaaatttttgcaccaaaagcagagaaccagaggaaatgcaatttaacttaatagtaaacccccttcaaggagattaattaatccctcctcctttcaattctttccagatgaatgttgttaagtaccaatgtaatcgtatctggtatctttgaggtatagtgaactctgaggaaggtaatgttaagatgcatttcaagagtataaacaatccacgagcaaagtagagaaaaaatttagtctcctgacattttataatacaattaacctgaagaacagagatctatgttacgatttctctaattttatctttctaatgatttaagccctattcataatgtcgttaggtattggggtttccatttgtctttatgtatttgttctctcctagcaataaaatgacctattgtttattggtcactgttgaacaacatacctgaataactctttaggaacattctgtcctattctgcaaatcccacattgcatggctaaaaaggaaatgcagccaactcatttgtaaaagacctatgtgaggaagtgccagttgttatttttaaacaatttgttataacagaagtagttctgacttttcttcttaattgcttggatagttcatggagagtatcttctctcttactttagtctatgcttctttatgtttttatttaagagattttgtcattgttgttgctgttggttgtgatgatacttgaggagaagcagggtttaagaaacatcataatctaagaacatttcaatagaaaattttctgagtctgggtacactggctcacgcctataatcgcagcactttgggaggccgaggcgggaggatcacctgagctcaggagttcaggaccagcctgggcaacatggtgaaactccaacactactaaaaaaacaaaaattagcctggcatggtggtgcatgcctgtaatcccagctgctcaggaggctgaagcatgagaattgcttgagcccaggaggtggaagttgcagtgagcttagatcatgccacttgactctagcctggcaatagagtgagaagactctgtctcagattaaaaaaaaaaaaagaaagaaagaaagaaaaatttctgagaaaatgtttaattgcagtatagtttgcttaacagtaattagtttaatatttaaaatttcaagaatgtttgaggttaaaatttacattaaagaatattgttatttataccaaaaaaaagcaaagagatgactccccagaatttaggattgaatgaagatatcctcaaacagttaaacaattgttaaactgtaaaatcaacatataatttgccaagatcagagacataaaaattctccaattatggagaaaatctccatcctaagacagatgtatcttaacttgcctcaacatatttaagtgagatttggagggatgaggtacagataaatatagattaaagttttattgtttttgtcatactccagtgaattgattttatataaacgataaataatttattcatctgatagtgacaaaatatccccaaaataacagcacatataagagaggttgacttaaaattgtacttagagagtcactgaaaacagtaaaacaagcaaaacactgtctattcgaattcaagcattgccaacaaattgatgataatgtgtattctgaggcagatgtttccttatagagaagatggatagcccaggttattaaagatatatcccatatgtctttcgcaattattgtctccatgtctgtggattctctttttattctcttgaaagtgtctttcacagagcagaaagcttacattttaataaagtccagcttatcaatgctttctttcatggatcgtggctttggtgttgtacctaaaacgtctttgccaaagctgtttacctagatttttctcctaccttttagaaatgttataggtttgtatatttatttaggtctttatccatttttagttagtgtttgtaaagcatataaagtctgtgtctaaattcttttcatttgtttgttacatgtagatatccagttgctccaaaaccatttgttgaaaagactatcttttcaccattgttttgccttgactctttcatcagtggtcagctggctttatttagttgggtctatttctgggctctgtattctattccattgatttatttgtctattatttgaccagtatgacactgtcttgattatggaagctttatggtaagtcttgaactcaatgttggtcctccaacttttttcttttctttaaatattgtcttgtctattccaggtcttttaactctacatatatactttcaagtcattttgtcaataaaataactttctgagattttgattgggattacactgaatgtgtagatcaagttggaaataatagagccagttttgaaacaggatttaaacaagatctgttcagctccaacattaaccttttgctatgacactgtgacagcaattaaacaaccataaatcacaggttaaaactgatatatttcaaagacattttaagaattagagacctcaccacaatgcataatacttgtttttgggtagttttcttcagtgaattctaatgctataggtattactggcagaaattttctaggaaaagagcagagtataaaaataataaataagacaagcatatggaaagaaaaagtcagttgcagaggaagaaaagttaaaaggattgtgtctttttaaggcggtgaataatacttagtagatcatctcaaatgtttctgatttctggctctgcttccagaatagcaatccattttaagcagttaaatacactaaatttctgacagtgtaatatacaatactttatgtattttattggaaaaatattttaatatatctggtctcatatatttcctaatagaatataccaccaccattattatggaactcaattataaaaatatgaaccatttgacagaaattggctatcctgaaaaattggaatacatatgcattattgatcaaaatatgcttacagtaccaaaaaagcatagagttagttcagtgtttttaaagcttgatattatgataccaagcaatagccgctgaaatagaaaggagtatactttataaaattaaaatcaggtttttaaaaaattttcttcagagggctaactggtccataattgtttttaagtttcttgctgaaaaattgaaataggtcccaggagaacttatggcactgataaagtaaaactgtcactttccagtttggtcgtcaaatatatcatccctctgtctattacacacagcagttctgccacaaatcttgtttctactcacaattaattaagcaaaactaaaatgtttaaagctaccacaaatcaaatttaatttaaatggctacaataacttaaacagagataaatgaaatgactttcttatgcttcattacttcctctaattccttttaaaacatttctgtagaagaagttctgaggatgaggagacaggggtggaccaatgagatttcaattaaactaccaaagtaataccttaaccgcaggtggtcccaggaccagttatttccacttattccattccctttgccacacagacactttaatgtgaattttaaagatatatatgttacaattttcagagtctgatttatcttaaaactttaaaccatatgacatttctaatgtaaaaatgtaatcttgatttaggtgcttaattaaaaggatggctgctttattaataactcaattataagtttaaaatatgtcatagtataatctaatgattgtactgttttcccccatgggacctttaaatacacacaaaataattctatgccctgatagaattctattttttgttgttgctaagacaatttatttttgttatttcgtgacttcactgcattttattgcatttctgtgatttctttttttactgcagcatctctaaaatctcttcttacagtttgggcatagaattgagagcaaaatggaatttatcgcaactacctcatgcattttttcttaaattgaaatcagattacacaaatacttatgttttgtttccatggttatgcaagaaaatagtttttcagtcacttatacaaatctatgcagaatttatacatgtattgcttattttattttatctttttatcaaacttagcatgttaggaaacattactaaattctgaaaatgttaggaatttaattaataatgtatttgtagcctcgaccatcttaagaaaaatatatggtgttggctggttaatttatatttatttatttatttttttttttgagacagagtttcgctcgtgttgcccaggctggagtgcaatgacataatctccgctcactgcaacctctgcttcccgggttcaagtgattctcctgcttcagcctcctgagtagctgagattacagggaccagccaccacacctagctaattttgtattttttagtagagacggggtttctccatgttggtcaggctggtctcaaactcccagcctcagatcatccacccgcattggcctcccaaagtgctgggattacaggcgtgagccatgacacccagccttctatttaattttttaataggcaggcattaatgtcagttaatgctatataaaatgacatatatggagaagtctcaataccaaaattgccttctattccagtatccactccccttccacatatgcatacttttagggaactctataactagtttatttatttcagtatttctcttaggaaaatgtaatgaaatgcatatttgtatacccctacttttgtataaaaagtagcttctatattatgcatatacactattctctcccttgctttctttaataatatttccttatgaacaactcatatcagtatatagacatcttcattcataaaggagaccctacaaactactaagtatttattactagttaccaggaatcaaaagaatagccttttagccatcctttgaagtatatccatatgccgttcaagactctaaaacctgtaagggctactccacagctctagcacatggctttcctttccaaggcccttctccacacaaagacaaaggggaatgtacattagcaccatatcatgtacaggtaaactagagtggaatagagaaagcctacagatatggaagtagcagagaggcccatgaagctgtccttatgccccagagaggtttgctttgccccagtgggcatagttgctttaaatatatcattgaaaggactccaggaaagagttcctgacacccaaatatctctatatatcatttatagagaaagtggggaagggtttctctactctaaatgactatgtaaaaataggtccttcttggtgaagaaaatggtcttgtggaaagaggtaaccactggttctcaatgcctgataacagcagtcattttcattgcactaacttggacctgctgagccagcttattgcaaagcaagtaacagggaagggaatgagcctccagggtcatctgggtttgtttctcttcattaagtgttttttattttttttcataagcattgctgcttattcatagatacacatagagatgcagaatcaaaatgagacatgaatgctggttatcagctgcactcactcactaagtggctttccttctttttcttttgagatggagtcttgctctgctgccaggctggagtgcagtggcatgatctaggctcactgcaacttctatctccccggttcaagcgattctcctgcctcagcctcccgagtagctgggactataggcacgcgccaccaagccctgctaatgtttgtgtttttagtagagacagggttttaccatgttggccaggatggtcttgatctcttgaccttgtgatccacctgctttggcctcccaaagtgctgggattacaggcatgagccaccgtgcccggccgaagtggcttttttatatctcagctttatactatgaggtgaaaatttgagtcttagtaaaattcaaaatactggcccttccaggtcattttcagatggctgaagctagtcaaaccaggagtagcaactgcctctactgaataaaatacaacagtgtaaatctaatataataaaaagaactagacctgcctcagtagaatatgatctggtttacactgagtaatagatactttatttaacaggagttactccaaactttcatgcaagtattcattagacctctcccactctctggacaccacataggatctaaaggaatatgagttggggtccagcataaagacaattacagacaataggataagacaaatggcactctgttaataaagcatgtattctgtttgtttggttggttggttttttgagccacagtttcactctcgtaactcaggctgcaatgcagtggcatgatctcaggtcactgcaacctctgcctcctgggctcaagtgatccacccaccttggcctcctgagtatctggaactacaagcctgcaccaccatgcccagctaatttttgtattttttgtagatacagcatttcaccatgatgctcaggccagtctcaaactcctgagctcaagcaattcacgcgcctcagcttcccaaagtattgggattacaggcatgagccaccacacctggtatttttaaccagggaaaatattagtacttaggagatctgatagaggcagaagcagtaaagggcagtttgttgaaataatatgaaaagttttcctgtagaatatgcaaattttgactggttagaaagtcagaaagaaatgcttttgttctgaggatataaaccttctaaattgctcttgaaggttgaaattttttggttgctgttttgttgcttcatgttttaattattattatatttatatctctcttgttaaatctggggtatggggaacagtgccattaccagagaagaatttacaggattaaccttaaatagaagaaagtgtctctcttctaagtattaagaaattatctctgtaatagtgaacttatcggtaatatgattcagggacaatcattctatgaaatataattaaatgcccaatattcttcttttttaaaaaaagtttctattagatttttaaagtacagctataattcatgttgtttgtaacaaaagttgcaaagattaaaaagaactaatattttaccacttgtcctcctttctcagtctctgaagtataatcaaaatgatatgatatatagtgttctcattttatccaggtgttttatgcatctgtagtatcatctctttgtttgtagaacaacagatgactctccctcatttatttttaaaggctacataatactccatagaataactgtaccatggtatttcagacagccttttgagggacactcaggttgctttcagttttttttttttttttttttttgtcgttgttgcgccaatgctcttaacagtagaaaaatacctttcaatatatatctatatttagtggctgttttatacctgtaagatacgtttataaaagtatgtaaaatatgtttatattagtatgcatattatgtttagtatagtatgtatagtatgtatgtatagtatgtatgtatagtatgctatgtttatattagcatgtatgtatattaatatgcttataaaagtatgtaagatgtgtttataaaaattgaactctggattcaattttaatttgtatagagactgctagtttattaatttatcaaaatccacatcaccatatacttagtcacactagatgctatccccatttttgttcttctgaagggtgatacaaggcagctcattattgttttatttcctatatccttgattgtaaacagaattgaaactcatatccttattgctcaaatattttccttctctgtaatttacttttccatttttctgatgaatcatttgcttttcttagtattttcaggagcttgtcatatattatgggcattaatgtcgggtcatttacaataaaaacatttttcttgtcaattttttgttcttttactctgtttatagtatagtattgcctatatttttagttatattttatgtaaaccagtcctggcttgtttaagaaaaatctcaccacaaaaatgttgcacaaatagtatctactagtttttaaaaataatatatatatgctatggtttgaatgtattcctcgaaaattcatgttgaaatctaatccccatggtgttggtatgaataggtgagatgtttgcagaagtgattagtcgtgaggtctctgccctcgaggatgggattagtgcccttatcaaagtgactgaaggagtccctttggctcattctgccagaacacagcattccccttttcattatgtgaggatacagtacttcctgcttcctccatatgaggaatacagtgagaaagtgccatctctgaagcagggagagagccctcatttgacaccagagctgctgggtctttgaacttgtacttctcagcctccaggactatgagaaataaataaataaattatccactctaaagtaatttgttatagcagcaggagcaggttcaggctaaggcattatgtgtgtatgtatttataaaatgttgcacaaatagtaactactagcttttaaaactaaatatatatttatatgctatgtatatatgtacactgacagctacttatcatattcaataagttttaaatagattacaaatctaaatgtacagttatatacattaattttgaccttacatgtaatgaacatgcattatatttagatatttatgtatataatttaactacatagttataattaactgtaatttaactacgtagttaacaatacttgttatagtttatagttcaattatagttaactatatagtaaaattatgtgcacatatatctaaatatgaataaatgcatatatatctaacgcatatatatgtatatataaagctaaatatagttaactatatagttaattataactagttataatatataatatataaatatatataactctatatttatagttaactgcatagttagccatatcattaaaatatatgcatatgtatatttaaatataaggaatgttcattatacataagattaaagtcaacatatataattgcacatttagattattaatttctttaaaaattattattgaacattgtaagtagctgtcagttttttgttttccatgtaaatatccaattaagccagccataactattaactaataacttcattagttaaatgggtactgaattcaatcaaatcattttgtggaattcactatacaattatatttttcttcttttattgtgtttttatcaattatactgttagtttttctaatgtatgaacacccttacacttttaaaataaagtattcttgatcacaaatgatattcttattgcactgtaaaatttgatatacttttactttatttagaatggtagcattcttaatcataagtaaaattagtttgtagtttacattcttatgcatctttttcagattattaaaattacagttctttataaattaaattaagctgagtatcatccatttttatagtctttcactttaaaaacaatggaataaactatctcattattatagcaaaaaaaattaaaccataaaagtatcaggcccttgtatttatttgtaatggtaaatattcttcaatatgtttttccacacttcaataaaagtttttcttttccttctttatggtttctaaatgtccttgagttaacaatggacttggattattatttcataatctttctaatccacaatgaacttattttggtttttctttgttttccataatggttgatatggtttggctgtgtccccacccaaatctcatcttgaattgtaactcacacaattcccacgtgtcatggggggaaccccgtgggaggtgattgaattatgggggtggatatttcctggtctgttctcgtgatagtgaatgagtctcatgagatctgatggttttaaaaacaagagtttttctgcacaagctctctttgcctggcaccatccatgtaagatgtgacttgctcctccttgccttccaccatgattgtgaggccttgccaggcatgtggaactgtaagtcccttaagcctctacttttggaaattgcccgtctcgggtatgtctttatcagcagtgtgaaagcagactaatacaatggtgtttgccaaaatatatctattatggtcttttaaaaaaatagcttaatttttttctatttttttatttttaatttttatagatatataatagtcatacatatttatgggctacatgtaatattttgataccagcatacgatgtgtaatgatcaaatcagggtaactaagatatccattatctcaagcatttatcatttccttgtgttggggtcattctaaatatcttctattttgaaatatataatagattattattaactatagttaccctataatgctattgaacactacttattcctcaggtaaaactacttatcattccatttatttttattagctgattttctagttcattataatcacatatttttgttttaaacctgatttcttaaggtaaaaacttatcttttaatacttttactgaggaataatgttatgctatacagtgtagcattgtaagtgtacaatacaattatttttaataagggatgggactgtatttcttgagttgtttcccttcagtggcttcaatccattattaggtccttgtctaatttatatatttgcatttctcttacgaagtataaactgtatttaataaacttttaaaatgcaattataaaattgattcatcacttgagcaaatatgttttattccttcataagatgtcaataattggttcaagagttggtaatataatatgtattcaatctagtggcagaaatagacaagaaaagacttaattgtaattcagaatgtcatgtctaaattgatatttagataaagtactatggggacaacttatgaaggactggttacttctagcttgaaggaagtgtgataggagggctgagataagataaagttttcacgaagaagctcacatctgacatagctttcagagactttcttaaaagagaaaaaggaaaatgttttaactaaaaaatgataatagtatgtgcaaatattaggagttataatgacacatggaatatccatagaattttgaggatatttacttctgatgctcttcagtttgttttcttatgtttggtaacatgaaatttaaaaagaccaaattcaaaagtttcataacaaatgagtcacacgtgactcatttagcaagaaaggatttcttcacttacaaatctttggatttctagaatgtactaaagatagaagtatctcctgtaaatatctgataaaaagagatatacttgcctctgttcttcagccactgaagggaaacaagaacgacaagctcatccctaaggatgatatcatgcaccttcctaataactttaaatgtcttgacatattaaagtttgagttaagctacaccagagttaaaagcaccaaccaattcctcagtcactttctatacatgcttcaattctttttaaaattaggttgaataataagttatagcttaatcattgatttaactagaaatgataatcatctggatcatattaatattggaacacatagattgaatgctatagaaataaaatttatgtggctacatttctgccagggaacttaaggagtcctataaatcatcatttcagataatccaaataaccaagaatgtggaaatcatattgtatctatgcttattcttgtttatataaccatgacaaattatttttacataattgacacagaatcatttcattcctgctgtaaaaagaaggaaaaataagtaccattcaaaaacattctactaaacttgacagaaatattaagacagcagaagatgttttcaagatattgaattatgaataagcagaatgctagaataaccatgaaagttaaatatacatccaattttacaagcacttggaaaaataccagaaaataaagatacaggcactgataatacagatattaattgtaaatgatatactatgatggaagttgataactaatacaactcattagctaaattatatttccaaaacaggaagcacagatatacataatgggacaaaaagtaaaataatgaaaactaagaatgttctaacaacacaaagtataaaaattctcatgtatactttcacaatataaagaaaactaacaacatgtattctgaattcactgtatcagaatgtcttatagacattaatcaaagtctaataataactaaaaatgattttaagatgagaaagagtgtataagtttttaaactaagattcttggtaattttcaaaatgctgtgcaaactatgcctatgaccctcaagagcatttttgaaataaaaaagaaagtatgactttttcctattatcacctcttctggcaatgctgtacactaccatgagctttgactacattttccagccttctaaagtgccctactgaaactttgttatcctttctctttattgaaagtagtccaattcactgagctccaggaatgtgtaaataattttcagtaagtcatcgttcagtttgagttttaagccattattttcttgaatattttttgtgcctcattctcactctcacctgggactctaattaaatatatgttaaaagttttaatattatctcatagacaacttgggctctgttgatatctttaactttttttctcttttcttcatattgatctatcttaaagtttagtaattatttcctttgtcatcttcattcttctataaagcccataaaatgtttctttttcaaatatgcgtgtttcagtatgtttcagttttataatttgcattcagttcttttaaaatattttcaatttctttactgagatttcctatttatttattaagtttattttattaagcatagatttattggctgatttatagtctttatctgaaatttcaacatctgggtcgtctcagggttggactctgttaatcatatattttttctttgaatgtgaagccagtctgtattgtatccaagtcattatttctgcattctctaatattcctccaaagaaagatactatttttatattagaaggcaattaattggttaggctcaaattacatactttgtgtgcctatggagggagacagccaaaatctcagtgttgttcttttagccttagctgcaggatgttttgagtctgctgcagacatgctcaattcacctgtcagcctgagaattgggcaaagtttgtataccaatttgggggctcttatcttctggatttctcttttctgagatgcctctccaccttactttctagtacctgcagttatcccaggctcattcctggatgccaagaggatagattctctaccacagtgttagttatttgcagtccactgcacctgcagactgtccttacactaagactaaaaaatgaaaacgtatcctatgctggtcctgtcttccaagttttgtatcatctccaaatctgcctctgatacttaataatttgtttacacacacacacacacacacacacacacacatacctatataatataaattatacataataagtttttttgtttatagttgtgatctgttggcgggctggaccatttgaaacttactccttactctatcataccagaaatggaacttttagtaattaatctgaagggctgcaatctctatcatcactcataaggtcaagattaaacccatacctttaaacacagctcaaaatattcagcaaataaataaggcagtcactactgatggtagtaattattgtccaagacttgtattttttggagatatttcttatccccaaacatatccagcttcaattggtttatttctggtacttaatccttggttctactcttttatttataatccagcaaatcctctttggacttatattttaaattactcctgactctcaggtctccttatcaaggatattagtctactgtagacttaaacaatcagctcttttaacattgagcaactagagtaaaatatacctactacccaccctctcccatactacgacaggtcttttggaatcttacttatatagcacattcacaaaagacagcctacaaatatatcttctgctgcaaaggatgtttgttttagtgggtcttaaaaatatcttgatattcattttcaagggtggatttttacattagctgtggctcttacttgcaagctactgttaatggcaacattttcccatttgccgaaaactactcacaatgacagtggcttccaccaacaattttcgtcaaaggcaagtgatagtatatttcgtttttagaaactccctgtagtagtttctggcaatcatctttttctctctctactttttgaaaaagttcatatatatatatatatatatatttcccttgaacaatttatatgaagctcaatattaggaaaatgtcctattaattttttaacactcactagaaagcaatataacaagatgacctgtttaagcccctagtacagctgtggtaaccaaacagttcttttagaggaatatgtgcacattctctagagttgtttgacaaagagttgacaaacattttctataaacagccagacagtaaatattttgggctttgtgaggcatacaatattttccacaacaactcaactttaccattgtagcacaaaattagccattaaaactttatttacaaaaataggtggcaggcaatttggcctgcgggctgtagtttttcaatctttgctcaagagtatagtgtgaaacaattccaatttgccattgaacttctccagcattcttttatgtgtcccaaagcagacagaagtacagagactcataacttagagagaactcttgcatcttaaaggcaacttaactcttgtatcttaacagtaacttcctaggtattgatatgagaactcattatttcagtgattccataagccaagtgactaagacacttggcgagagatacaaattatggaatttctgctgtcctactcaactggaaaatcagtatctgtgttatacttgtgccaccaaattaaataaactaaacttcatgtcacattttgatttcaaaagtggcaccattctataaaagttatatcttaatcaggaaataataaaagaaatacctgtggctaaaaatggcaaactgatcaatggaaaaaagtccagaaacaaacccacacacgttcctgatctacagcaacaacaataatatgaagctttggtgctgtggggagcggaggaccatcttaatacattgcactaggtcaagtggatatatgtatgagaaaaacatcatctagattctcatctcacaccatacacaaaagttaatgtcataaaaatgtgttatataaaagtaaaatataaaacaataaagcttttagaagcaaacattagagaacaattccatattcttagggcaaataaaaagttgatacattgaactatataaaagccaagaacttctgttttttaaaagacattgttaatagagtcaatgaatccacagtgtgaggagcgtttcccagaataaagaaagaactcaaaaaaaatcagtaaggaaaaggaaacacaacagaaaaaatgaacaaaagattgaaaagacactttatcaaagaatatatccaaatggccaaaatagtatattttaagaagacttcaagttaattagttatcaaattaaagtcatgctataccattacacatccaccagaatagattacgtatgctgaaactctgaaaggtagacagaagttagactggtcaggcatcttgggacccaaggaacagcatgatggtgaattacctgggtttttattctccctcatatatcccagacttggagctgaagaagctgaccacaggcctaaagaagcttgcaaccgactaaagaaaggaaacaggagggatccttgtgatgatagaaatgttctatatcttgactctatcaatgtaaatgtcctgtgattttgttgtgatgttggaccacactttacaaataccgccatcaggaaaaaactagtaaaggatttgtgaagcttctattacttcttaaattcacaggtgaatatacagttaaaattagaaagttaatttaaaatatttattcaatgctttctgtgtgccaagtacaattatagatgctaggaaataagcagtgagcaatgccaacaccatctcttcaagatgtttgcaatctagttagggaaacagacaataaacaaacaataaaaatgtcaagtggtgaaaatgaaggaaaaaaaaacagtagtgaacatatagaaagatagaggagatgatatttcacatatggcattgggagtggtcttggcatggtcaaagaatagtaactaggcctttgtatccaaagtgtggttaatgaggtggagactggtaggattttgagttccaacatagtgggaagccagatcatatagtgccttcactcataataaggctcaattttaatctaagtgtgtgaaaggtgctgagggagagggatcatgtataattttgaatagggcattgccttgttctgacgtgtttaaataaggtgactatggctgtcttgttgagaacagactgatgaggaggacgtaacctattgattttcagttttgtatttcatttgcatttgggttttggttttgttttgttttgctttccttatttccttttttaaaatttttccataagttattggggtacaagtggtattggttacatcagtaagttctttagtggtgatttgtgagactttggtgcacccatcacccaagtagtatacgctgcaccttatttgtagtgttttatccctcgtccccctcccactactcctcgcaagtccccaaagtccattgtatcattcttatgcctttgcatcctcatagcttagttctcatatatcagtgagaacatttgatgtttggttttccattcctgagttacttcacttagaataatagtctccaattccatccaggtcactgaaaatgctgttaattcattcctttttatggctgagtagtattctatcatagataggtaggtaggtaggtaggtagatagatagatagatgatagatagatagatagatagacagatgatagatagatagatatgtagatagatagatagatagatagatagatagatagatagatagatagataatcacactttctttatccattcattgagtgatgggcatttgtgttggttccacaattttgaagttgtgaattgtgttgctataaacatgcatgtgcaagtatctttttcgaataatgatttcttttcctctgggtagatacccagtagtgagattactagatcaaatggaagttctacttttaattctttaaggaatcgccacactgttttccatagtggctgcatgagtttacattcccgcctgcagtgtagaagtgttccctgattatctcatccatgccaacatctactgttttttttattatggccattcttgcaggagtaaggtggtatcgcattgtggttttgatttgcattttcctgatcattagtgatgttgagcattttttcatatgtttgttggccatttgtatatcttcttttgagaattgtctattcatgcccttagcccactttttggtgggattgtttgctttttcttactgatttgtttgagttcattctagattctgtatattagtcctttgtcagatgtacagattgtgaagattttctcccactctgtgggttgtctgtttactctactgattgttcctttggccgtgcaaaagctctttagtttaattaggtcctagctatttatctttgtttttactgaatttgcttttgggctcttggtcatgaaatctttgcccaagccaatgtctagaagggtttttccgatgttatcttctataatttttatagtttcaggtcttaggtgtgcatcttgagttgatttttttataaggtaagagatgaggatccagtttcattctcctacatgtggctagccaattatcctagtaccatttgttgaaaagggtgtcctttccccactttatgtttttgtttgttttgtcaaagatcagttggctgtatttgggtttatttctgggttctctattctgttccattggcctatgtgcctatttttgtactagtaccatgctgttttggtgactatggccttataggatagtttgaagtcaggtaatgtgaagcctccagatttgttctttttgcttagtcttgctttggctatgcaggctcttttttggttccatatgaattttagaattgttttttctaattctgtgaagaatgatggtggtaatttaatggaaattgcattgaatttgtagattgttttggcagtatggtcattttcacaatattgattctacccattcatgagcataggacatgtttccatttctttgtgttgtctatgatttctttcagcagtgttttgtagttttccttgtagaggccttttgactccttggttaggtatattcctaaatattttatttttatttttatttttttgcagctactgtaaaaggggttgagttcttgatttgatgctctgcttggtcgctgttgttgtatagaagagctactgatttgtgtacattaatcttgtatctggaaactttgctgaattcttgtatcagttctaggagatttctggaggagtctttagggttttcaaggtaaatgatcatgtcatcagcaaacagtgacagtttgacttcctctttaccaatttggatgccatttatttctttctcttgtctgattgcttggctaggacttccagtactatgttgcagagtagtggtgagagtgggcacgcttgtgttgttccaggtctcagagggaattctttcaacttttccccattcagtataatgttggctgtgagtttgtcatagatggcttttattacattaaggtatgacccttgtatgccaattttgctttgagttttaatcataaagcgatgctagattttgtcaggtgctttttctgcatctattgagataatcatgtgatttttatttttgattctgtttatgtggtatatcacatttattgacttgcatatgttaccatccctgcatccctggtatgaaacccacttgatcatggtagattatctttttgatatgttgttgggttcggttagctagtattttgttaaggattttagcatctatgttcatcaaagatattggtctttagttttttgttttctgtttttttttttttttttggttatgttctttcctggttttggtattagcatgatgctggcttcatagaatgaattagggaggattccttctttctctgtcttgtgaattagtgtcaaagggattggtaccaattcttcttagaatgtctggtagaattctgctgtgaatctgtctagtcctgtattttatttttgttggtaatttttcaattactatttcaatctcactgcttgttgttggtctgctcagggtatctaatttgtcctgatttaacctaggagagctgtatttttccatgaatatattcatctcttctaagttttctagtttatttacataaagatgttcatagcagccttgaatgatcttttgtatttcagtggtgtcagttgtagtgtctcctctttcatttctcagtgaggttatttggattttctgtcttcttttcttggttaatcttgctgatggtttatcagttttatttatcttttcaaaggacccgttttttgttttatttatctcttgtattttttgtttgtttcaatttcatttagttctgcttggaacttcgttatttcctttcttctgctgggtttgggtttgatttgttcttgtttctctagttccttgaggtgtgactttagaatatcagtttgtgctctttcagtctttttgatgtaggcgtttagggctatgaactttccttttagcaccgcctctgctaaaaattccagaggttttgttaggttgtgtcattattgtcattcagttcgaataatttcttaatttccattttgattttgtttttgacccaatgctgattcaggagcaggttatttaatttccatatatttgcatggctttgaaggttccttttggagttgatttccagttttattccactgtggcttgagagagtgcttgatataatgtcaattttcttaaatttattgaggctcattttatggcctattatatggtctatcttggagaaagtttcatgcgctgttgaataaaatgtgtattctgtggttgtgagatgaaatgttctatatatatctgttaagtcatttgttccaaggtatagttttaattcattgtttctttgttgattttctgtcttgatgacctgtctagtgctgtcagtggagtactaaagtcccccactattactgtgttctgtctatctcatttcttaggtctatgagtaattgttttataaatttgggagctccaatgttaggtgcatatatgtttaggattgtgatatttttctgttggacaaggccttttaccattatataatgtccctctttgtctcttttaactgctgttgttttaaagtttgttttgtgtgatataagaatagttaccctggcttgcttttgatgtccatttgcatgaaatgccttttcccacaccttttctttaggtttatgtgagtccttatgtgtaaggtgagtctcctgaaggccccagatggctggtgagtcctcatgcattctgcagttctgtattttttaagtggagcatttaggccatttacattcaaatgttagtattgaaatgtgaggtacctttgcattcatcatgctttttgttacttgtgtactttggatttttggttttgcttttgttatttacttgtgtttttgttttataggtcctgtgtgatttatggtttaaagaggttctgttttgatatgtttccagcatttgtttcaagacttagagctccttttagccattcttatagtggtggctaggtaatggcaaattctctcagcatttgtttttctgaaaatgactgtatctttccttcatgtatgatgcttagtttcgctggatacaaaattcttggctgataattgttttgttcaagaaggctgaagatagggccccaatcctttctagcttgtagggtttctgctgaaaaatctgctgctaatctgataggttttcctttataggttatctggtgcttctgtctcacagctcttaagagtctttctttcatcttaactttgtatagcctgatgacaatgtgcctaggcaatgatctttttacgatgaatttctcaggtgttctttgtgcttcttgtatttggatgtctaggtctctagcaacacaggggaagttttcctcaattattcccccaaatatgttttccgaatttttggaattctcttcttcctcaggaacactgattattcttaggtttggtcgtttaacataatcccagacttcttggaggctgtgttcatatttttttattctattttctttgtctttgatggattgggttaattcaaagaccttgtctttcagctctgaatttctttattctacttgttcaattctattgatgagactttacagagcattctgcatttccgaaagtgtgtctaaagtttcctgaattttttattttttttttctttaagctatctattttcttgaatatttctcccttcacttcttgtatcttgttttggatatccttgcattgggctttgcctttctctggtgcctccctgattcatttaataactaacctcctgaattctttttcaagtaaatcaaggatttcttcttggtttggatccatggctggtgaactattgtgattttttgaggggatgttgaagagccttgttttgtcatattaccagggttgcttttctgggtctttttcgtctgggtaggctctgtcagggggagggtctagggctgaaggctattgaccagattcttttgtcccaaggaatgttcctttgatgtagttattctcccccttttcctatggttgtggcttcctgtgagccaaactgcactgactgttgtctcccttctgggtctagccacccagcgagtctacccggctacaggctggtactgcaggttgtctgtacagagtcctgtgatgtgaactgcctatggttctctcagccgtggataccagcacctcttccagtggaggtgctgggtcggggggtgctatggactccatgagggttcttagctttggtcatttaatgctttatttttgtgctggttggcctcctgctgggaggtggccatttccagagagcatcaggtatagtagtatggagagggactgacagtggtggggctctagaactcccaaggttatatgccctttgtcttccactactagggtgagtagggaaggaccatcaggtgggggcagggctaggcatgtctgagctcatactctccttgggcgggtcttgctgcagctgctgtggggggtgggggtaagattcccaggtcactggagttgtgtacctaggaggattacggctgcctctgttgagtcatgcaggttgtcagggaagtgagggaaagctggcagtcacagacctcacccagctcccacataaactgaagggctggtctcactcccatggtacccctgcaacagccccaagtctgtttccaggtgaagggcgagatgggcttgaaaacttgccccaggctacctgcctttcagctatgaaagaaaagggcttggttattccccctcctgtggagtctgcacacaggatttgcaccctctccccatttctggccaggaggcttctcaccctgttcaaatttttacaaagttccgttagtgatttcctcctccctgtggagttttaccccctgctcctctggccaccctcccaatggatctctgtggtgccaggaaggaataggctgctaggggacccagtgagctcccagggcctttctgctgctttctctacccctgtatttctcttggttctctaaattgactcatctccaggtaaagtcagaaatttctcctgcaaacagaccttcaggttctccagtgggggtgcgtgtttgagagaggagggtctccctttcccacttcttcagttaggacactcacagtatttgcagtgtctcccacgttttgcaggagcagtctgcttccttcagagggtctctgggtcctcttgggattgctggtttgttcttgcagttgatttcacttcttacttctgggtttcagttatattattatatataagctatatgcacaaggagattatattttttggcagtgatgcttaaaaacttggattccagacccagactgacaatcactagctgcatgaccatgttcaagttatttagcctctttcatcttcaatgttttcatatgatctatggtgcaataatagcactcaagtcagaaggcttttattgggattaaatgtgttatatgtgtaaagatcttcaaatagcttgagacatggtaagtaccatggaagtgtttgctatgtcatttttgtgttggtacatatttgagtaacattgtaatgaaaacaattaaaagcaacatgggagaaagcataaaaattattttccttaagagggttcatactctagtgactttgaaaaactgtttgagagcgtgctaatgtcatatagctcagatgcttactatttacacatcagtaattattgtaggggcagggaaggcactataaaatttgtctgtaaccaaaaattaaatatttttttctaacttgcaggccaatcacattttattttaattttaaaattaaaaacccaaatatgatgtatatagtaaataccatcaagatacctattaatgagaactattattttctaatttcttgagtggaagttattgtagtagatatattctgctttttgtcctgcatttgtacatttgggcaacttctcttctctctgtattgcactattgggaatataggtcatagattgccaaagtgtcctgttctcctggccacaatcattgattcaggaataggaaggtatccaagaacagctaaccagtttccacatggaattggacatatggacactgttttttttttttttagatgtttccctcttcccctcagacacatagcaataagagccaaattaacaacacagagtctgtctgagaattaagttaaataatcccaacgtgaactagaaaaagaaagaaaatctctgtaaatgttatttaattatagaacaattgacacaatacataaaaatatggttgtgttctatgtgaaatttgtctttattctagaatagtgattttaaacatgagagattcttacctaataatatcaattgatcaaatttgtgatactaaaacataaatcagtattcatccttccaacactggttctatttacatgaaattgtatcattttagaggggaacaaatgtgatttgccgttttttaaatgaatcttctgtaggtcacattatatttgggagtagtttctaattattattcaaaaaaagaaagaaaggaaaaagggaaaatttctgttcctatctgacacttggcatattagtcaagatcaaatacagaatacaataccctaaatgaaaataatatgtgctatatacaccatggagtactatgaatccataaaaaagaataacgtcgtgtactttgcagcaacatggatgcaactggaggctgctatcctaagtgaattaaggcaggaacagaaaaccaaatatcacatgttgtcacttaaaagtgagagctaaataataggtttcatacagctaaagaatggggaccctatagctcatatgccatatataaagatggcaacagtagacactggggaccactagagtgaagggggtggaggaagagaggggaacaaggaatgaaaaactaattattgggcaccatactcactacctgggtgaagggatcaatcatacatcaattttactctaagtaaaattgcattatgcaatatacccaggtaacaaacctgcatatgtaccctctgaatccaaaataaaagctgaaattataaaaaacaaaagaaaatagtatgtgctaaatatttatatggtgttggttagtcatcatttctaaaaacccaatgagtcctaatgccagtcttctcaaaagctcatatataggatagaggaaaaatggtgaaatatatagtatttatttacaaagagaaggcactatagatgttcatttacttcactgtagtgaagtattattaccatcttattatatatgtgcatgtgtcatcattttgtataccttcaatatacacaatacaatttatttatttattttattattattattattttgagatggagtcttgctctgtctcccaggctggagcgcagtggtgcaatcttggctcactgcaacctttgcctcccaggttcaagcaattctctgcctcagcctcccaagtagctgggattacaggcacctgccaccacacctggctaatttttgtattttcagtagagatggggtttcaccatcttagccaccttggtcttgaactcctgaccttgtgatccatcctcttcggcctcccaaagtgctgggattacaggtgtgagccaccgcacccagccataaaatttattttcaaaaatgctttcacagaaattatctcatttgaacctcaaacaaaaccttcaagaaggtaactgcattattttttaagaaaaaagtttcacagaggccaagtgtgatagctcacacctataatcccagcactttgggaggctgaggtggccggatcacctgagatcaggagtccaagagatcaggagttcaagaccagcctggccaacatggtgaaacctgtctctactaatggtgaaaccggtgtctactaaaaatacaaaaacttagcaaggcatagtgatgggcacctataatcccagctacctgggaggctgaagcatgagaattgcttgaacccaggaggcagagtttgaaccgagctgagatcgcaccactgcactgcactccatcctgggggacagagtgacagtctgtctcaaaaaaaaaaaaaaaaaaaagaagaagtttcagaaagattaagtagcttatctatggttaaaaacaaaaagcaaaaaactggtaactcacagaggtagaatctagtctcagttcagctgtttccaaatctctatgtggtacataacatattttcgaagtttgcatctcatgtgacaatgtgggaggcataatcaaaacatggaaacatgaaacaactagagaagtaatcacataattaactattataacagcaaaaaaaattaaaataggattaaattgaaggggtgaatgaaggttagtgtgatcagttagtatgatggcagaaaaagaaaaatattcaatgtgtcctaaaggatacataaaacaggaacaggtgtcgatagagttcatgtaacagtaagggacatttcaggaagcttgagtttggtgggaggagtggagctttggagatacaatgggaggttggagaggtgtgaagaaaaaggtgatgtcactttataaaggaaactggaaagtaaggcagagcaatttagacttgaaggaatttcatttgcttctaaaaactgaagtattgtaacatgcaatatgcctttcacaaacaaaatagtcacatatgcctctcagaaagaaaaggtaccatgaaataagagaaagggacataggacactgtgctgtatgtaaaaaagaggagagattaagtgtgataaaatgttctacttttaaagcaggtaattccacctttctgccaacaattattattttaaaaggaggcaaatagaaaaaaaattatatgttagattactaaagaatatacttcaaatctataagaattgaagcagttagaaaaactaaatagtttacaaatgtgacagcaaacgttaagtttcctgtgagatttacaatgtctttgtatctgccctagagatcactggggcttaatagaccaccaagtacaaatgaatcgttttaaaagattttaacgtcttttgaagttcctacttagaagtaggatctttaattgactaataattgtgttaaatcaaaatcatggaaaataagaatgtttataatattattttactttaatttttggcaaggtagaaagttatttaaagagacatcaaaaacaagttgatctactttattactttgttaatctatgtcctctgagaagcagacatctcatgggattaaaatcaggaggaagctggaaaaggctaagagaacagtcagatcatgatgaaattattaacctgagtgaaggagagaagaaaggatgattgggtacaaacttcctagactgctgtgcagtttgaggaaaatgaagtgaagttactgaggagtcccaaggcacaggtagccaccagaggcatcaagtgtgtccagaaattggcctgccttaatatcccagatacacctagtcatcggctaagcacagcccatgggaaatgtagacatagcctcagcatagatgcaatcatgggtttcagagcatgacagctggagctcttggccaattgccctccttgtggttggagatctaagaggtgcattcctatgggtgccagagtcactttgcttaaggctggacatgatctcatgcaacattaaaaagagcttttggcattttatttttgatgaacaatatataactgtgagctgtctattctactggaatttaatacttctattactttgtagttcttatattgtgtcacaaatggaaactccccataccatattgtgaagtgacatcctgaaagataatgagagccacagctataggcaggcaatgccaccgtttctagtaggccactgaattatccgtccactcatctagttaaggtatccatttattatttttttttaaaaaaatacacatagtctggcctttgcctaacttttcaacctcatcttttatatttcacctatggcttactgtacactatcgttcagtggtttttttctgttcattgagcaagccaaactcattataacctcagaatagtaatagctatactctcctttgcccggaatgttcttttagattttcacatgttggactctcacactattcagacctcagtgcaagtattactacctcaatgaagctttggttgatcagctcatctaaactagcaccttgtcatccaacaacagctatccaattactggtgcttttttatattatagtacttactagtaactgcaataatatcattttgttattctccagtctttgtagatttgtgtccctggaaaatcatagaactaatgctctctaccatataatcaatatctagactagcaattggcagctaaaagtcaataaatatttgttgaataataattgacaaaagaagacttctatatttcagttgctataatgggtctgagaattcaaagatatgatttcttccctcactagagattatagtccaaatagaaagtacagtctaattgcttagaaattacttttccctcacctcctaacagtcatctattctttcttaagttgctccaggcattccttctcatgtaccaattaattgtctatttttgttgttgttgttgttacataaataagttctttagtggtgatttgtgagattttggtgcacccatcacctgaacagtacaaattgaagccaatctgtagtcttttatccctcactcccttccttccctttacccccaagtccccaaagtctattgtatcattcttatgcctttgcatcctcagagcttaggtcccacttttgagtaagaacatacaattcttgcttttccattcctgaattacttcacttagaataatagtctccagtcccatccaggttgctctgaatgccattaattcattcctttttatggctgagtagtattccattgtatataatagtttctttatccactcgttggttgatgggcatttgggctggttccacatttttgcaattatgaatattgtaatgctataaacatgcgtgtgcaagtatctttttcatgtaatggcttcttttcctctgggtagatacctacagtgggattgctgggatcaaattgtagttctacttttagttctttaaggaacctccacactgttttccatagtggttgtactgtttaccttcccaccagcagtgtagaagtgttcccttttcactgcatccatgccaaaatctattatttgtttattttttgataatggccattcttgcaggagtaagatggtattgcattatggttttgatttgcatttccctgatcattagtgatgctgtgcattttttatatgtttgttggccatttgtatatcttcttttaagaattttctattcatgtccttagcccactttttgatgggattgtttggttttttcttgctaatttgtttgagttccatagattttggatattagtcctttgtcagatgtatagatggtgaagattttctcccactctgtgggttgtttatttactctgctgactatttctttttctgtgcaaaagccccttagtttagttaaatcccacttatttatcttcgtttttgttgcatttgtatttgggttcttggtcatgaaatctttgcccaagccaatgtctagaagggtttttctgatgttatcttctacaatttttatagtttcagtcttagatttaagtccttgatccatcctgagttgatttttgtataaggtgagagatgagaatccagttgcattctcctcctcattgtctttttttttttttttttttttttttagatggtagaatagctctgaacaacagagactttggaacaacagaaatatggcattcaagaaggcaatttctctagaactttatttccacaaattcataaataataaaacactagattgcatgcttctgaaaaatttgaagttttacatatcaagatcttttagaattttcttgaataaaacattactacatttggtcaacaaatgtctgctgataccaaccatgcaccaagcaatgttttgaaaaaatggagatacaatgcagatccaaacagataaaatccttacagacttagtgtttacttggaaagagagatatacacaataggcaaagaaatgaatatcacaaactgagatagggctttgaagaaaaaaggcaccaagtagggaaaactgcatataaaaggcttagtctagttatatagatcagagaagatgcttcagagaaagcaatgtttacccaaaaaaaaaaaaaaaagttactgggtaaaagtgaagggtatgtagttaggaacatatgaaggcaagagccttctagcagatgaaacagcaagtgtgaaaaaactgaaagaaatatctaacaaggggctgggcacagtggctcttgcctgtaatcccagcactttgggaggccgaggtgggtggatcacttgaagtcaggagtttgagaccaccccagccaacatggtgaaacctagtctctactaaaaatacaaaaattagcaggtgtggtggcaggcacctataatcccagctacttgggaggacaaggcacgagaatcacttgaacctgagaggcagagattgcagtgagccgagatggagccactgcactccaacctgggcgacagaggaagactctatctccaaaaaaaagaaatatctcacaatgacctgaaagaaaataaggaaccataatatgtgtaagtccttgtaaagtttgtaaattaggctaatcttaattttaaaaagcaaacaaaaaactaactatgctagcctttatttaaaaaaaaaaatcctaactttgggctgggcacagtggctcacacctgtaatcccagcactttgggaggctgaggtgggtggatcaccagagatggtgaaacaccatctctactaaaaaataaaaaaatagccaggcatggtggtgggcacccgtaaccccagctacttgggaggctgaggcaggagaattgcttgaatctgggaggcggaagttgcagtgagcagagatcgcgccactgcactccagcctgggtgatagagcaagactccatctcaaaaaaaaaaaaaatttaatataaaaaatgacataaattaaatgtgcacaatctatggaccttaagcatgtgttcgttatgatgtcctgcttggcaaagcttctagaaaaactgttgtttggttaggctcatccaggtttggactagccaagtatggaagaaatcgagcagtactggttctaatgatggaattagctgaaacttggagccatgattttgcaggtggtgtgatgaagaatggcagaccctggatttattgaaaatttaattacatacttagtacaattaaaccatgaaatcatgagggaacaaaaaaaattaaaaaaaatcatcaatgctgctgggcagctggaaacattttcatattacagacttaacttctattatcagtgtcaatatctatatcatcctctaatatctcatatgaatttcgctaatggaattaggaacaaaatcaggtggcaaagagcaagtatgctcacttattgataaaatacactggcgttgtttgatctcttcttcacagtactttgcttgtcctttgttgccctgaattacatgtatcccttatgagatgaaaagctaatttatatgattgatgttatatgcttcctgaaagtttaagtatatgaccaaatgagagagcagcaagaaactcactattttttaaaccataattgtgaaagatatgattaaaaatatagagtttctatatttgatagaaaacacaaatttatgtaatgatcttttcattagtttagcaaagcctttgttttcctgcagtaaatgtataattacaaaacttaatttagtatttggctcaattaactctctgcctgtaagttatagaacttttgtaacctgaataattgaatatgttttacattatcctatgtaattgtttgtttttaattttagacttaacattcttgtttattttatctatattattttatgtatgtgtgtatatatatttatttttcttgtttatttcagacattttgttatgattttttgattttgatgaccattatttgcgagaaaatttccaggtaatttttcattcattgcatctatgataaattgatggtatttctttaggaaagaaatacctgttttatcaagcaatcaccttcagaagaattcatatacagtgaagaagaaaatggtccttaacccattagttgaatgaaccctggagcctgtgttgcagctagcttgtcctcacattcatatctaaaccctgagctacaaaaaatttcatcattttaattagatgacttgttcaaaacaaacacatctacgagcaaacaacaacaataaaaacaacttggcatctaatttgaacaaggcattataatagctgtcttgggtgatgccgagatagatacaacaaatttacagccctcaaataatgcacaattaagaagacagtaaaagcatacactgacccagtggagcctgagagagggagtttaaaggggaatatacaaaggactatggaaattcagaggtggttgtgagagagttgaggagaagcaaagggaattttatgaaaaagcacatcttttcatgtacatcctaatctattagaagggtttcactaagtgaataagaataatacatttgaacatttaccatgataagtgagttgtggaaccttaaaaaacatctatgtttgcattcaggcaaaagaaggggtagaaaaagaaaaggtagagtatgagatattttgagaaaacccagcaaacaacacagatataaaagccaattgacaagaaagttcaatggaggaggagatgtctagcaatatcgaatgttctaggtgatcaacaaggatttaaatggaagatttagtatttaatgtggtaacaaagaatattgagtttttcagtttgggaggtagagttaggaggattgcttgaacccaggagtttgagaccagcctgggcaagataatgagactccatctctacattaaaaaaaaattagccaggcatggtggtatgcatttctattttcagccactcagaaagctgagacaggaggatcacttgagcctgggaggtagagggtgcagtgagccatcatcatgtcactgtactccagtatgggcaacagacagagaccctatctcaaaaaaaatcaaaaaagactgttgcagtacattgagagagcaaatgtggtaatgggagggctaaggaacacagagaatttaggtacatattttttattttaatatttaaataaccatatttatattcatagctacaacttatttgtgcattcaacatctattgagcacctactatgttccaggtactcttataagcatacaacaagaagcagaaactgaggtacaaagattttaagtaacttgctcagctggtaagctgaagatgccaagattaggagccaggcagtctcacttcaaaatccgtgtccctagtctcaaaaaaatagcctctttctctgttctaggcactctgatgctttcaatacattacttcatttagtacccactacagtcctgtgacatattgctatgctgatcattgtttaggtaaagaaactgaggcatagcaaagttaagtaactttcccaagctcacacagctagaaaaaggcggattggaattttagtctaaggaagcctgatcccaaggcccaggctcttatttagtataatactatgcaaatattttatttagagacattttggaaaaagtttggaaaatggtaaaatataacaaagaaaataactctacctagcaataactactaccaaatttttaatatatttctttacaatattattgtgcatttttacataactgaaaattttaaatatatacaattatatatgattattatcaagatttaaattatgtgcaaaacactgacgctgcatctagtacatagtaggcattcaaagaaggtatgtacaattatatttctacttttatcattttaattaaattaacatacagttgacccttgaacaacatgggtttgaactatgtgggtccacttatatgtcaactttttttcaaccaaacagggatcgaaaatagagtatttgcaggatgtgaaacctgataggattcgatagggagggctaattttttgaatatacaggttctgcagagccaactgtgggacttgagtgtgcatagattttggtaaacatgggggtcctggaaccaatcccccatgtatactgagggacaaatgtatttatatagtgcttcatacattaaaaggtatattcacatatgctatctcctttgttcttcaatgcatttccaataggagcatgaactttgttacattttcatttaacaaatgaaaaattcaacccgtgaatttaagtgatttgcttaaagttacacacacaagcagtagtaatgcttggcctagaacaccatgtcagataaaatatatgtaaatgataatcaatgtgtcattgcctcagatattgagaaagaaggtacaagatttcattttcaccatgagctaatcatataccaatttcaattccttggggtagaagctacatgatatcttattttgccccaacaatgaccctatgtggcaactgctatgtcggccccacagaatcaacacacacatgcacacacacacacactcacaaccctcagctaaagccatgacaggttaactgacttgctcatatccatgctccttctagatcttgcaaggagtgtatatatctcttttcttctacaactgagggaatagaataagcagagtacaataagaaagatacagactatgaatagaataggtatagaagtagaatgtgcaacttccgttactataaaataccatttcagagaaaatagagtcgagtcaacaccagtggatgcagtgtagggatatgcatttaaaagacagggatatcaccaaacactgaccaggtagagctgggtaaacagtggtgtgggtacctccaaaaagtcagggtgaaggactgcttttgaggcagttaacacaaataacaaaagggtaggagcttgagacatttggtggaaacaccagctattggtgagaggagggtattgtcaatggacaagattttctgcttaactcaccagtcacaatggagactatatggttactgtcagctaatctttctgcagattaatttcccttccaggtgctggcctttagactgatgctaacactcaggattcattaaccatatttatttaaagaaccacaaaaatgccattattcagaaatttcttatgaaagtgcctcataacaaaagaattatcatgggttaaacttatgctgatgctgacccaatgaaaaacatgcttacaaaattatctgcgctgacaactctacaatagtctaacacagggataagctcaagaattctttggagttccattcagcttttataattaggtaatttttctatcacagtcagctggagattaatcataaaatgtgaacagttttattttctgtatttcaggaaacgtaattggtgataatcattataattgtaaagaaatctgcagagccctttcattgtggccatagcaccggctttaaaacaagttcagttgatgtctgtgtgcatgtgtgcacacacatacgtgtgcgcacatgtatttgtgaaagagtataattatacaattaaatgaagaagtaaaaagattcttaagagaatgtgacagttgatggtctgaaagtaaagaaaaggagaaaggataatgcttctgaaaaccatcatttagacacgcaaatggaggcttacataaacctgttctgaccttatgtatttgaaatatttttaaattactgaagtctttggaaactgcaaatagtttcttatgaaaaaagatgctcttacataaaaggaactattaaacttagagaattgaacaatggagagatcagatagtaacttactattctttaaaagtcttaaatatatgtaaaattcacaaaaattcacaaaaagcagaggaatatttgtgtccccctaaaattcatatgttaaaatcctaccccacaagatgacagtattagaagttgagggctttgagagttgattaggtcatgagggattagtgcccttataaaagaggccccagagagctagctaccatgtaaggacacagccaggaagtgtcatctatgaaccagaaagtagaacctcactagacaccaaatatgccttgattttggacttcccagccttcagaactgtgagaaataaatttctgttgtttataagctacacggtttatggcattttgttacagcagcccaaacagactaaggcagaggcttacataaaccctgttctgacctcatgattgtgaaatatttttaaatcactgaagtcttaggaaactgcaaatagtttcttaagggaaaaaaaaaagtgttcttacttaaaaggaactcttgaacttagagaactaagcgaaggagggatcagacggtaacataattctctaaaggcttaaatccgtgtaacactcacaatgcagaataaacatgcacccacgcacaacctaaatctaaccagttactgctgaaaacctgaatgttttggggaagtgtgccagaaagctctaaagatttttaagcttttcctgacctctttattttcactgaaatgcaaatatacatttaaaaatctgtttacataaactgaagaaaaagaaatcaatataaaattttccaaatttcctggattttaaggttagaagcaaaaatgagagaagatattttcataaaaagtaagaaaataatcagttttgattcactaggtccaaaaaatgagtagaaacatacatctaaatgcaccagatttttaaaaattttgttctttatttcaagaacaacactgcatttttggagggatctatttttttcagggaagaaaatatcacaattttgaaaaaaaagagaccaatataatctccctttttgaattctagacgaacgataaaaagcgattttgttaatgattttttaaaaatgagctttgcaacatattggcagccctagactgaagaattttaccgttctaattacaaacagtagcagttattttatactaaacataccaaaacgtaagtgagcattttatatgaatatgaattatttctactgggtacctatatacatgttttaaatattctgtgatttacccagaatctagtcagaagtaggccattttgataaaaagtgcctttagaacatcgatgggtaactaaaaaatctatgcataatgtaaacattccaactatttgttaaataagaaacatttttgattattacttttttaaactatattcaatttggttattggtaaaatttagtttaaggcaggcatatttcttttcataattttgttttcttttttcatgaacatttatcatgtccagaaggcaggcatatttcaatgaagtaatgtttatgcctagctaacattttttatttttaatgatatgatactgggtatattaatgcaaagatcctacaattttattttataaactcttacctgattttgaatccttttttcaacttttccagttatgcatgaagacatcatacttgaaaaactaaatataaattagcttctcttttgtaaaataaaaacaaatttgcaggacttctgctagagagatggattaggtatacattcctctattttttttcttaagtaaaatatacaattaaaaaccttgaaatgaaagtgtatatgtatgtgtatatattacagacacatatatatgtgtatacacatatatagggatatagtttattaagtacaacatacaactacaaaccttgaaagtgtatatatatatatatatatatatatatatatatatatatatatacacacacagatatagaaagagagaggtacatacacagacacacacacacatacacacaccccttaagagttcttaaacttgacagcagaaatatataccataaaaggaaaaattgataaactggatttcatccaaattagattatattactctgtgaagaactctgttaagaggattcaaaaaacaagctacagagttggagcacatatttaaaaaccacaacatcaacaaaggactagtatcaagaatacataaagacctctcaacacttaacattaaaaaaatccagttggaaaatggataaaatacatgagcagataatttataggagaatatatgaatagtaagcacacaaaaatttgctcaccatctttagccattaggaagttataaattaaagccacatgaaatatcattacatacctatcagaatggctaaaataaataataatgacaacacccaatgttagtgatgacacagaaactgtgtcactcatacatggctaattggaatgtaaaatgacacaaccaccctggaaaagagtttggcactttattacaaaaactaaccatgcaactattacataatcagcaattgcctttctgggaatttatcccagagaaaataaaagctatgttcaccacaaaaacctgtatattaatgtttataatagcttaattcataatagccccaaactggaagacatcctgatatgctttaatgagtgaatgattaaacagactacagtatagccatatcatggaatctcgcttagcaattaaaaaaacgaacctactaacgtatgcaagaatctggatgaatctccagacttacgttgagtgaaaaaaagtcaatccaaaaaggctatatactgtatgaaaaattgtagagagaatactttaatggttgacactggttgaggaagggttgggagttggagggaagtatatgtggctataaagggtcaataggagcaatctttatggtgatgaaaatcgcctgtatcttaattgtatcaatatcagcaccctggttggaatactgtactatcgctttgcaaggtgttatttattgttgggtctctccatattatttcttataaatgcctataaatctatagttatctcaaaataaatagatctacttaaagataaatggctaaataaataatttgcaagctctgaaaggatctccataaaggcaatcacaaaggaaagctcttctaggtttttgagattttttttccatttttcatttaaatttttaagtttttctacgggaaacttatactgctgtggtaataagaaagacaaaatataatatgcttgtaatctaaaatatttttaagatacagtttcattcctgtgttcacatcaatacaatgttctatatatgagaggcaacttctaaattcaccatctgtctattatgaaaaattttatcctgtggtcagggtattttatagctagagtataaacttgtaatttgaataaagagtatgggttgaatagtagatgtgccagctttgctttttttctatcttagaaatttataaaaaattaagtttgcttttaaaacttaaaagtgttagttctgaaccctagagatgctgacctaatggcggcatattatggctgtatgctgccaattagataaaagcagcatcaggaatcatttcatatcgctttgcttggctggaagtgtgtgtgcacacagatacataaacacacttctaatttctgcaaaagatcactgttagttctttagaaaactgctggcctattttcaaaagccgaaaatgagctggagcccagtgctgaacatcagaaatcaagaggcaatctaagtgatggtgacagtaggttttagtgaatacaaaagatgaaatggtaggaagctggataaagataattctgctccaaaatccaaagggcaagagaacataaagatgtcagaggtcagtatcattgaggagggaagagttttgtagctctaattgattctccgggctcctagagggattgaacttcttttggaaacataaaggtagagggcataagcagaaaatatatatcagatacaaaaccaatttctcccagaatacatctcaaaaagtaatgtcattaaattctggagccctgaagcaaaattcttcaaagttgtctccttgcagttttcacaagaaataacctttgccatacgccctgggaaactcatgttttcatccgcaatatggcagtgcttatcagtctgaaaagattattctgagaagttacataaacttgtaaactattaaaccttaagtgaatgtaaaaatgttacgtcatcttcattagcatgcctccctaaaacaatagagagtgcttagcctgagaatctgagctaagcttgaagtgaaacactactctgctgtgtaattcattacttgaagaatttacttccggcctaaattctgtttagtggtaggtctgccatctagtggccacttacataaatacaagttgtgatcataaattaaagaccatatgaaaatactaggtcatccaaatggaccatttctagtccaagtataaaaaggcaaagaggatttgactgatggtaagaaaatttatattcagggatcacttagaggtaagtgtgctgactcaaaacactatgagtacaaaagcaaagtaaaaagtcatttagacttatgtggacttcaaaatgagaaatttatattcataaactttcactaaatttaaaagaaagtaaccgttgtgttaacttatttatgttttctcctcattatcttttagttcaatcacatttatattttctacttaatgtaaaccatgaaataaaattttcttcagtacttggatttgtgctgccaatttgcagaattgtcagttattaaataaaatgtaacacagtttcagaacttaaactctaaaatacaaaaacataacattgttcaccttcaaataatacaataacttttggggctctattattattattgctttctttgttaatagaaatgacaggtaatgctaggcctttgatgctcattctcttggcataatttttagttatttgtccaaagctacacactcccaccctcagttccttccagagtgctaacctgaaagcttatatttgtaaaagccccattattattaaaaagctcattaacatacctgcaaatggtatttgcacagtggctaagtacactgaacacaccctgagaagtatttactaagctaaattcatcagacaagtgtacaatattcacatttcagtgttacaattgttatttttatttatttggtttttgagttggtatgcttaagaagagattaaatctacctccaaattatagttctttgacatactaatcagttacattaaagccatttaaataaataatattttaaaaatccccaaaccattaggcatgttttcattattgttgtatccagttactttccccttaggcttattattattgcttgaaataacaggatgatatcatattgttcaaactggaaatatagataattttgcaattgctaatgttgtgtaaaaatgtcctatgataatccacaaaccaataatctgtattgttgatatcctaacaagtatttgtaaaacacaggccaaataataaaacaattcccattccatacttaatccttgattttatggggtcccatttatttgtaatttgtaaatataatctcttacaatcaagtatgggagcctcaaagtcatgaatgatctccaatttaaggtaagaatgctcatacatttgcttgtggatacatttctttttttttttttttttgagacggagtctcgctctatcgcccaggctggagtgcagtggcgcgatcttggctcactgcgagctccgcctcccgggttcacgccattctcctgcctcagcctcccaagtagctgggactacaggcgcccgccaccacgcctagctattttttaatatttttagtagagacggggtttcaccatgttagccaggatggtctcgatctcctgatctcgtgatccgcccgcctcggcctcccaaagtgctgggattacaggcgtgagccaccgcgcccggccggatacatttatttctaaataagaacatctcatgtggttcctaagactgattatgccaagacccatgtacttcaaaatacggcattccaatgtgtggaattttctttttccactcaatctgtctactttttaacaacatggccaaactcccaggatcttaatgccaaaaaaagatgatttttttttaaaagaaataatttaagatcctaaaatgaaagcaaaatgtccatcctcgtgaacaacaaagtcagtcacaagactgaaaccatggtctataataatttaaatttatttattacttactctattatgtgtcaaacttaccctgagtcaaaatcgtgaaggtgaacgtaacattaaatgtgcgttttctttaaaccacactgtgatgaaatggactctcactcgggagtctggctccagaggcctcacccagcagagtgttcactatcacagaggacttttcacacatttcctcggagaggagggaagaaatccatcaagaaaggggatttatattccaaaatcacaaaatggctactatatcaactggagaaaaactactcacaggaagaaaaacagcacagaacaaacctttagacagtccatgccctagcacaggatttggacagacataagccaagggccaaatctggctctctatctcttttgtaaataaagttttattgtaaataaagttcagtggacacaccatgcccatgtgttcccatattgtatatatgtatataacttctgtctccttttattcattgccttctctgtatgagatatgcatttctcttacctcaatcaataaaatccaacctatcgtgaaggtataactttgtataatggaattaaattgaatatatcatttggagccttgtttttacatttaatattttttctgagatttatggatactgctgaatataagtgtagcttatcaatttccactttttaagtgctatggactattcaattatacaaatcaataaaaattaacctatactatgccaatgggcattgggttggggttaacactttggcttttctcagtaatgtttctatgaatgtttttgtacatatttcttgatttacaaatgcagcagttttcgagagtttttacctaaatgttgatttatttttgacatagttggtaaacacttgacattgtgactttttttctttttggttagtagtaaaaggaatcttttgtgggttttattgataccaattatataccaattatctttttatcattgattgccatttgtgtttcatcttctatgaaaagcctattcaattttttggctttttccaatcctcctctcagtttgcttgtctttttaccttattgaattgaaggtgtttttttaatatattctagatactacctctttatcaattatatgttgcaaatatcttctcactttataacttgtattttgtgtatgaggtttttataaaagaaaattttacggctcacgcctgtaatcccaacactttgtgttgggcagatcacctgaggtcaggagttcgaaaccagcctggctaacatggcaaaaccctgtctctattaaaaaatacaaaaattagctgggcgcgggggtgggcgcctgtaatcccagctactcaggaggctgaggcaggaaaatcacttgaacctgggaggcagaggttgcagtgagccaagattgcaccactgatctccagcttgggtggcagagcaagactctgtctcaaaaacaaaaaaagagaaaattttaactttaatgtagttaaacttacctaaattttatttttatggtatacaattttatattttgtttagtaaaactttctctgcctctgaggtaatataggtattgttccatattataacctaaaaatgttaaataatctagaatctactgttgtacagttctaagaaagagataaatccctttattatacaaataaccaatttttttcagcatcatttattaagaagtctatctttcgtcattgttttgcaacgttaactctatactataaatcacgtttccatagatatgaaagtcttttcctggactctattatttcagactgttctcattggaacaacgtgacaatgcttaatcttttaattctgtatttcctttgtatacttttagccaatgttgtgcttatcagtacagatataaaattgttatatcatcctgtcaaatcaaacctcttatcattatgtattgactctcttcattcatactctttattcctactaatgcattttgtcctaactacataagtattattatgggtagtgttcaccagatacacctttatttatctctttacttttaatatttgtattcagagaaatctgatgtgcagaacaacactgttatgccatgaattagactgttgttgaatattcactggaagagtatttttgtacggccttgctctaaactttctaaatgaagtaattattgtcatgtcccatgcaactgtgtgcatagcactcaccactagcatagctattgactgggtataacatataagacctctcctatctttcctactgaatcttctaaattagttgattactaagttagaaacaatgtactaaacaatgaggtttttatttacaatagcaataacaatttcggtaaataaatagagaaaaacatcacttttgaataacacaattagtagatagagttggaggatggtaaataccagagacaacagtaatctagagcaatattaaataaaagttctgaagattattcagatataaccttacccccacttaatagttaggataccttttaaaaatgcttcaaagagcattatttgtacctccataagtaacaaaatattgaaatgagctattaaaagttataaatgaattcatgaaaacaatgcatttgaaaaaaatctatataataatactgcacgaaaaatgacagaaagacataaaactttacatcaggaatctgtctgaaaatatcaagatttcagtaatgtattttattcacagagaagcttgctctcctacgcaaaatttgtctaaaatgttaccacattagtgaatctaatgaattccaaagtcccaggttcctgtaggttttcagctttacagaaatgatcaaaattgagtgtctcaatgtattatttaattaaaaaaagtttgtctgaagtttacaagccaaaaagtaaaaattatatatgggtaatactttacagatttttttgaagggtagttgtggattttttaaaatgtcttatctaatatttagataagaacccaaataaagtatattgtcaatgtgaatatgtatacttatatatatgtatacacaaacatctctctctcatcacacactctctctctctatatatatatacacatacacatatatatacacggatatgtacacacatacacacatataaaaatatatatgttcaatggatacaaagttatagttaggaggaataagttctagtgtttaactgcacagtaaggtaactatagtctgaactaatgtgtatttcaaaatagctagaagagagattttgaatgttctcatcatagagaactgacaagtgtttgaggcaatggatatgctaattacactgatttgatcattacacaatgtatataggtaccaaaacatcacactgtaccaaatatgtacagttattatgtgtcaattaaaaacaaaataaaatgtgagtgtgtgtgtgtgtgtgtgtgtgagagatagagagagagagatgagtgtgtgttggaaagcttacaattttaaagtaaaaattcaactttggaaaaattcactagtgatgtcagtgttataatttaagtcttaaggagagattaagaagataagtatgcttaaaatgtgtatgcttaaagaaaatcttcatcattttcttaaatacttgatgcttcacattgataattccaactgaattaaattagaaattcatctgcattatcataagatatatcaacatttcatatgttaataagagatttaaagaattctcactctgaaatataatttaaagaaataaaattatctgaactcaggttattgtcaagactggttttatggttttatccagtcaagaaaaggcattcaggacatttgttattaactacttgtgcaaacaatgttaaacatcaatgaagactatcaagaatttggtgtcgttgtgggcagcagtaatcccaatattacttccaaaaatcttcttctccataaaagcaacaagaacactgcaaaaaaaaggtgaacttcaacttttttaggactctggagattaagcaaaaggtttcaattatataggtaatgtttattagaaaaataatcgctgaatcttggtaaaacatgaagttttgtgatgttttaacttgccccaatattgtctccctctctccaagcctgtgattgccttgaaaaccagcagttcaacgatcatagtaaaaaccagaagtgtagcaatgcctggagggagcagaatagatttagagctcctccaaaatctaattcccaagcaactgtcattatttgacttgcttctggaaaatcctatgtgcaaaaatatttggcttgttccctggaaaatcccacgtgcaaaacttgttacttgagctaagtcagagcttatccagtgcagaaagctgtttccctgtaggcagttactacaaagaattagcagcaattgttaaatattgtggttagctgaactggtgacagcagttaggaaaaaacaacaaggcaaccacaaaaaaggaaaagctaggaatgagttattcataggtggattagaaaagttctgtgataatcctgggaatctagaatgccacacttaacgcttacaagtttgtgtatgcccaagaaaaactagagaaggccctatgctgtcatgctgtcatctctagatgatgttgagcttctgtgcaagcaggaagtgaggcctaaagtggtgttgcaagcagcctgactgggaattgaaggtgtaccacaacgtgcaccctgagctcctcagcaaaagctgggagacttattggttccagcctgtaagaaaatctctatcaattttttagctaactaataagttaaccaataagaaagtttagtgtccacccataaaaagaatgctaattttacagaactaattcaggaaagtcattaaacaaataaacaacagcaacagcaacaacaaaaaccaatcataggaaaaggaggcagagagagttagcaaattatattatttaagatgtctagttttcaataaggaattatgagaaaaacaaataaagggccattcacagggagaaaaaaagcagtgaatagaaactgtccctaaggaagctcatacattggacttactaaataaagactttaagcaattttgaatatgttcaaagaaaattatggaagtaagtctcacaaaacaaagacttagaaataaagagacagaaaatatagaaaatcaccaactagaaattttggagttgagaaatactatcactaagcttgaaaattaactagaggtgccccaaaccagatttaaatggagagaaaaaagaatcagcaaacatgaagacagatcaattgaggttatttaacctgacaacagaagtaaaaagaataaaggaaaatgaacagagtgccccagaaacctaaaagataccatcaagtgtactagcatacttaccttttattaactatctatagtcctcatgttgtacatttgattcctagacttatttatcctgcatcattgcaattttgtaccctttgacctgcatcttcccatttccccaccctcacccctggtaaccaccatactactctgtttctttgtagtctttcttgtttttttttttaagattccatatataagtgagatcaggtgatatttgtctttttgcatttggcttatttcacttagcataatgtgctctaggtgattttcttatttttaaaagctgaataatattccattttctgtgtgtgtgtggggggagggggggtctctgtgtgtgtgtgtgtgtgtgtgtgtgtgtgtgtgtgccacaatttattttcccacttatccaatgggtaacaatactttgcttccatatcatggctattgtaaataatgctgcaataagcaggagagtgtaggtatcattatgaagtaatgactcccagattgctcggtcatattgtagttctatttttagtttcttaaggaacagctatactgttttccacaatggctacattaatctaaattcccaccaagagtatatcaggtttcccttttctccacatcctcaccaacacttatctcttgatatttttataagggccatcctaacaagtgtgaggtaatatctcgttgtggtgttgacttgcatttccctgatcattagtgatcttgagcaccttttcatatacctactagccattttacatctttggagaaatgtctattcaagtcctttgctcactttttaaattaggtttttcatttttattgctatcaagttggataattcccatatatattggatactaacacccaattagatatatggttcacaaatattttctcctaatccgtatgctgcttttacattttgttgactatttgctgtgcagaagctttttagtttgatttactcccacttgtttgcttctcttgcctacacttttggagttctatcaaaaaaaaaaaaaaaaacattgttaagaccaatgtcaaggagcatttcctcttttctctaggagtttttcagtttcaggtcttatgtttgggtctttaatttattttgagttgattttgtgtatagtatgagtccaatttcattcttttgcatatggatattcagttttccaaacaccatttatttccccattgtgtcttcttggctccactgttgaaaatgagttggctacatatgcttagttttatttctgggctttctattatgttctgttgctctatgttcctgttttcaagccagtaccatactgttttagttactatagatttatatatatatatatatacacacatacacacacatatacatatatatatacacacacacatatatatatattgtttcttcatttttcttttaaattacatagtaggaaaaataattacaagtaaaaataaatttatactgtatttttatatttaggtatatgttacctttattttccgtatgaatttgtgttactgccaagtattctttccttttcagcccacagaacttcctttaatatttttatgacaaggtctacaaatgagtaattctctaattttttatctggtattgtcttaaattttcctttcatttttatggcctatttttttctgaatagagtgcaccaatatacttaaaatggcagtcccacaaagagaggagaaagagaaaaaggaaaataatttttaaagatatactggccaaagactttccaaatttgaagaaacatgtgaaactacagagccaagaagctcaacaacttccagttaagataaatttaaaaagacacacagtaacacattgtaatcaaactgttgaaagccaaaacaaagaaagaatcttgaaatcagtagcaaagaagtgatttatcatatatgaaggatcttcaataacagtaataggcaatttctcatcaaaaaccatagaggcaggaatacaatgagatgacaaggtcaaagtcctggggcagagaaataaaaacaaacctgtcaaacaagaattcttcatccaggggaacagtattgaatcttagttgacatataattcaactgatggaaacgaaagtgtgtgtctgttggaagagtagtcttttagacctgagaatgctctgctactctgagatatagagtgccattgacatcagtctggaagccttatggtctgagtggactagataattaatctatttagtagattaattatgctttcctcacaaaccactactcagttaatgtctcctggacatggttcataagaaatctttgaggagtcatttgcctatatgcaagtcagcaaaatgtgagtttgaatctgttctgtctttccttgtcccttatgcatgtttcgtttgtagcattctacctctcctcatctttctacgtcttctcatcctgtaacctcttacacaggatttgattctgagcaggataacacactcaagtaactggcccatcattgtctctcagtggttcaaaagaaaaagaattgagtgaataaatcaagttcaccttcccaaaagatgttgcctacctttctgaaggaccaggaccctccactttcatagcttgagtgtaaatagcaatgaccccctagcggatgaccttcagaaagtatatcccacaagactgctgggaattgtatgcctgaggaagatgatcattaatccagaattattcatgttatattgaatgcaaaaagtgagatttctggatcaagtcagaatattatactttctagtgtgatgtgacaagaggcaggtggacaggactttacattcaaaagagcattttgacactaacaaagaaggacccagaggttctaaatctaagaacttatatacatatttttgagaaaggtagaaaaacctttgctctgtaggataaataaattctcttgagaagagagattctaggttcttggcttcttaacactttggaacagaaataagggtctccaggaataaaataagacaatccttctggatttacaacccttaaaatgtctccatggtcctgtgtttcatccctccatgtaatgtaaacacatacctcagggaggtgaatctctccagaatagcctgtcactatcttaccatcctttaacttccaaggtgattcctttaacccaattaccaggtttctttcttcaaaaaggcctaatcatgcagaaactttaaaatctgttttctacagtcccataggtgtacttccgtcattactagcagcctctgctgtgcagtgctgttcaaagattggcactgcccacatttgtatttcaatgtgaactgtatgacttgaaaaaaaaaaaaaaactcctgtagcacccatgtatatctctattcctgacttagcctagacactcagattctgagacattctttcatgatcatggatctatggctcattttctggctattgaaaatgactcttctttggggacagactatccataatggcccttgctatggtttcaatgtttctcccaaagttcatgttttggaaaattaatccccaatgcaacagtgttgagaggtaggacctttaagaggtgattaggtcttgagggctctgccctcatgaatgaattaatgtcattatcacaggagtgggttctttcttgtgggaatgggtttatcctaagtgagtttcagtcccctggccatccactctgttgccttctgccatgagatgacacatcaaaaaggccttcaccagatgacagcctcttgatattagattttccagcctccagaactctgagaaataaattttatttctttataaattacagtctttggtattctgttatagaccacaaaacaaaccaagatagatctgaacagtaaaaaccccagagtggtaaaattctgagatggctcttccttctagcaataccttcacacactcccccgccagcagaactacaccctacacatacatgcatacaaatttactcccaagaattaaatattttctataggttgagtgcacatagaaaacactttacaacaaagaaatgtgttttgtgcaaatatgtgcacattcagcaaatatttgagtgctacagaataagaagagccttgagaaaaatcactccaaagttttaatctgtgttgatattcccgtcattttaatttggtaagaaagaagctgataagtgaactccacaagttcataatggtctcagaagttatagagaataagcaagcatatgtataaattaaaaattatttttcctgtacttttaagataagtacttgagtgcttaacatgtgttacaaaaaccttggatggtctgacctttgctcccatttctagtttcactaccctgtgctttaaactccagccaaaccagcctgcctttatttattcaaggataacactctttcttctactttatgatgtttgcaatttctttacccctttcccaaaacatttttttacatttccccagcttggtataaataaatttctttgcatatattttgccttacacttaagttctatttacttaaaattgttaatcctgattgaaattatgcttggtttgtgtgactacttgattaattgtatctcctccaccagacatttgttccctgagaacagggaccatatgtttatgtcacctattttattcccagtatataggataacgtctgacatgtagggccttaataattttggaaaatagagtttgtaaataagtcagaaaagtatttacttagaaaaaacaaagttgtgagtccctgtttatcagcattcacgaaagccatttacaaggtctattgggagaaggtacaatgaaaagagggactgagaataaactatgatatttattctcaagaaaccaatgtctagtagaagagatacaattaatcaaataatcacacaaaccaagtacaatttcaatcagagagtaaaccttcaggttttttctggtcagagaaagatcctggccagagaagtatgctgctgcaaaggagtccgacaataaatacaattgctgggacaaaaaccataagactgtggtgttgtggagcaagtggatagtctgtttcaacagggatggagggcctaaggaaagatcaagcaaggcaaatactgaaaattatgcattggatttagcaaccagtggtcactagcagctatagtgaaagttgaaatgacagctaaaggagaagaagccatatataatcagcaaagctcagacccaatgctgaactacagactctaaaagaattttcacctcagaaattatcacttaaaataagcaattttgtctaatatcatttttagacaatatagcacagtatagatgtgaaccttatagaggcttcccaaaataattacctattagtaatccattcagttatctttattcctgttgcttggctttatttcatacttcctagtatgaaagcacaacacatagcagatttctttctaaaaagcatggcaacatatcctgggctatactctgtttgctaataatccatctcatagctcttgtgagtgcataatactcattgaaatcaataagaattacgggcacagaagtgctgcaaggctaagtttttaaactcaagaatatattgtccatacacagccaaatagcacttggatagtctgtgaatataattataatataacccattatgtcttctttcagagagaaagaaaaaaatgatgtaaatttaaacatagcatattctggaaacagtatgcttatggaacagccagagagattttcaaaacttgatcatctaaatgcagagaacagtttcaaggtatgagcaatgcattaagaggccacagatttgggccacatgaatgacctgggagacactttttaaaacagcacaaaaatagcacaaaagtagcacatttttctttgtaaaatatttcagtaaaataattatgcctacatttctcactaaacatttgctgtgcccaaatggatagatttcaaatagaaacaggctgggtgtggtggcttacaggtgtaatcccagcactttgggcggccgaggcagccagatcacctgaggtcaggagttcaaaaccagcctggccaacatggcaaaagcccgtctctactaaaaatacaaaaattagccatgcatggtggcaggcacctgtaatcctagctacttgggaggctgaggcatgagaatcgcttgaacactggaggtggaggttgcagtgagccgagatcatgccactatactccagcctggtgacagagagagagactccatctcaaaaaataattaaataaataaaaactaaacaaacttaccattgagtgaaatttacacattacaagaatttaaaacagacatatggaaaaggacaatatcgactgtgtcttttttctcagatttatggtgtacatacattctattctctgtcctcatacagtggtccatgagacatgggtcctcacagcacctcattattcaccagctgaagcctagtttttctagaccagcactggaagaaccaggttaaatacatttatgttgaaaatcaggctctatcctgccttttccccaccacaaaggtgaagagaatccctcagtatattttatgttatgcaatcaatgcaaaggaatgaactttgttctaggcataaaaataacttaatttgctgtatgaagtacaaccgaggatgcctcacttcatgctgtatctgcatgcatactttcaaaatgacattaaataatttaggtagacttgggcatatacatgtttagtttagatggaatatctaataaaactaaaaggagcttgatcatattggccactgataaatggagcctacagatgtcactgcaactagatatcactgggatttagagaacagatcaagagcttccctgtatcttttttgtttaaaaaaagatgaccctttattttctctatatataacactactgaaaagaggttcattgagactttctcatcaatcagaactatctaaaatgcaatcttacagctgctatatgatataccaccagtgtgaaataaataggaaaggaaagattaaaaaggcaatatttacatttagctaagattatgagtactctctgatatcatggataatgtaaataatattaaaatgaatattattgcagactaattcatttgtattgttatgatcaaatagtttttggagatacatacataatagccctgtctcagttagcagtgtagtgacatttattcaataccaataataaaccaggtgctgcaacagaagcagaccagatggtccaggagtttccacatgagagagcaaacttgggcaagtctttgaatgcattttatttcaatctttcctttattgcaatggaaagctgtcaacaggagtaagtctctatgctgcttaaggtagaatgagattaatggagcattatcaatatctccactaatttttattgcatatgttgccttgggcacaagttctatttttatggtaagaggaacatatatacagaatgttaacagattctgaaaaagcaacatcctgctgggtgaacacatgttagccattgccacagtagtgaactataaattaatattttaaagaactgccatttgtgtgtaaaaatatcgatctataattgtttcttagctacacacacatacacacacaaagcaattggatgttcttagcaagaatattcatatcagaagaattctaaatgcttcaaacgaggaaattattaaaagaaaataatataatgtttacataaaaattctatgtagttattaaaagaatggggtttataataagattccaaattggaaagatatacagagtgtattgtaaaatgacaaaaaatagtgaaagaaagtttaagagaatataaagcaaaggttaaacatttggaaatctataaagtctagcaagataacattaatgagaaaagtaggaatccaagctgattttccctagaaaagaatcttagacaaagcttacgtgctaatactttatttagagctgcaatcccgaaccagcaagcacagggaaaggaaagagaggcataaaaagtgaggcaaagtcaaggtttatctggccacaacttcaggaaaagacccaactggttgcttggccatagaggacatcacgtctttagggaagccaaccagaaactccatgcctctgtatatcagaggaagtaaaggaatggaatttatttgctaactctagatgtcttcttccctcccttactgattcacattaggattaactcaggaactaactccctcactttcaggttacatcacctggccccttaggtggcttctgagaaaaccaaatctcatgtcctgttgaaggacactttacatgagtaaagtaagaatagaatggagagcctctttaaatctgactaggttgatggccagagctattatggctcctggcaggcagaacggagcaatggaggccataccaggaagcccattactcaccccagtagcagccaagacacacagaagtgttagaatctgaggtagattcagctgcagtggtgacaccagcaaccaggatcctccatgagctagtgaatgggggcccagtagacagatgaagctgagtaaatcagagcaggctcatgaattgaacctggtatgttaggcaggacaaattacagctaacacatatccagtgatcatgaggagtgtggaaagtgtgaagaacataagacagcatgctgctacccagctctaggaaactactaccatgcaaggatattggtctatgtcacctgactttccaatttttcaaaaagactataccttcattttcccagtgagaataatcacctacaaactggatctctagagtttttttacataaaagagaatttctaaatattggcttatcaaaaaaacaaaacagagtgtagactaaaaagagatctgtttatgagttatactcaacccataggttactgttttacaaactctgatgtataaaacaaatgcgtttaagaactcaatccaaatctctatctatctatctatctatctatctatctatctatctatctatcatctatctatccacgttgctctccaggttcatacatgcaaaagaaatgatcagctactttgatctcataaacctagacaaacacataactctatcacataactttatcataactaacctctaattattcaattataccttcatttatccaacaagaataatcacctgcaaaaaaagtatactctattaatgtataaaatgttcccattaattagtaatataaatcaatatgtggacaagatatcagatttctgtcttcctagagaccaagaggccagtgaaagccaagaagaatgtccttaagtagaaattctcaaaaacatgtcacaaagaattttagtttcatttgaggtccagggattatggaaataaaagcaagactagtaaaggccagctgttttatggtgcgctgttcttcctaagacaaacaccagcttcatgtaagcctccaggcttaaggtgatacagaaagacctatgcttaccaacttgaaaaaataaaaatttcaattcagagatgataggaagaagtaacatacgagagaaatatacaggaaaataactctaaggaggcaaaggtgaataaaaatcattagtaagtgactcattttttgtaggaggagaaaaatagggttgaaaataaaggcttcatcttttgttcctcagatagagactaactgtacatctgattcttctgaggattgagaaagcaaattttactatctccctttttgtttccctgtgtaaagacaattaaatttcagtttatttctctctgtgtggggattgctcaaacattttttcaatattccaaattgtattgacatctctcatccaaggaaagcttttttccttaattctattctcttgtgttgatatattttttcaaagcgtttttaatgagatctgaagaaagagccaagtttaatctgcatataatctgtcatctgaaactatcggaaggacaacccttagttttgcaaattctttcatggaagattaattataagaggaatctacctgattaatttggtgaattggtgtagtccttgtagcaaaaccagacaagaagaaaacaagaaaataaaaacatagatgagtatcacttaggtacacagcagaaatattaaataaaatgctactagcaaattgaatctgctagactgtgaataataataatgatctcagaaatacaagattatttaacatcagataatctataaaaaatttaccatatttataaagaaaaacacatcttcccaatagttttcaattaaattctacattcattaataattaaagacttagcaaatatgaaacaaagagaaacctcctcagccaaataaaaattatctatccaaaaatgtatagcatatataattatatacaatgtactttatgtaatatattttccaaaagtcctatgagcgaacattgtaacttcatgattattgcattgtcttcatcattttagtgagaacacataatattgctggatcttattcttccttttgaaggttttgaagaaatatgttttcattcagctggacttctagataattaagatgatagagtagtttttcaactgctttaggaataagtgtgagtagccagcacttgaaaatcaaatctgccttttatcctgcccaagacaagttttccttttttgctgaagagttgtttccatcacgggaataatgttccttgatgctaacatgactccctactttgttttccagcctgaatttctaaattggcactagatccttggcttaccttctcggaggaggctggattcaaaggtgatcctaggtgctcttactaaatcagttagcatagagctagtggaaacatcaatggttttacataaaaaatttcaaagattgactgtattaaaagcattataatataacatagtacattgttttcaacctactctcacgaaataccagctgcccaaattaatatacttcctttctggtagttgactcttgtgtttttgtttgtttgtttttaagcacacaaagggaatgcatttgtgtatattctttaaagtgtcatactaacacacattttaacaagcaaaaaaaaaagaacaacaaaacttcagtgctatgtatgtatggtctttacattttatcctacgttcattttatgacataaaaactatcagacatattatctcactacacttcagaccaaatagtttgtttgtttgtttgtttgtttttttgtttttaaggcgaagtcttgctctgccgtcccggctggagtgcaatggggtgatctcggctcactgcaaccttcgcctcccgggttcaagtgattctcctgcctcagcctcctgattagctgggattacaggcgtgtgccaccacgcctggctatatatatatatatatatatatatatatatatatatatattttttttttttttttttttttttttttagtagagatggggtttcactgtgttggctgggatggtctcgatctcctgacctcatgatctgcccaccttggtctcccgaagtgctgggattacaggtgtgagccaccgcgcccagccaatagttatctttttaactaaattcctatgggcatcaaatgaacaggaagtagcgttcagataaatggcatattattgattgattttaaacacctttctacaaattttaagtgacaaagaagcacatgtatgtacacacatgtatgtatgcacgcatacacacgcacacatacacacacacactcatatattgtcttgaagagaatcaggcctgggttgtttccaagaaatcgcctgaaagtggtttcatggagaagaggagagaagggaagggaaggtaagggaagggaggggaggggaggagagggaagggaaggcttaagcaccaggggaacagtgtttcatataaactccagtgagaaatggcagaaaggcaagaatacaattagaagaaaaaagaccaccaaggtcaacagaatgaacagtttctgaagcatgaacaaaagtaaaataacctgtagtgattacctgaccgccagttcttgcaagggttctggacattttgagataggactggagctactaaatgtactgaagcggtttgaataaatactgaactagccagttttggaatgatgacttaagttctatgatgaagttcagtataaaatatggatgagagtgtcacaatgactggacttctcttcagaattgcactgcgaatgtatccgataaaatttccttgatgtaatttctaatttatgaccacgggcagtccttttatatttctgttcaatcctcctatttctgaaacatgcatatgaatcacatccctgtggttatagcattttactgaaatctggttgtattaaacattacccagcatataaaatataatttaatagctaaagcttaggcaatattttgctataaggcaaattgctttaggttgcactttgtagaaaacatttcacctacaaataatgatttaagaaatccaaatcagcctatcttctcatgaccccagcatttagattagtatttttcttattatccattgttactgacaccatgaaaccagtgttgccgacccatgtgacaccctgaaactcagtttctttagcttgcttactacactgcctgacttcataacagcacttatcactcagtatttctccatctccaaaatctataaacttatgtgattttaatcccattctcattacctaatacatttctactttatccacataaatatctatatatccttacttatctagcttaattctgactgttctttactcactacccagacaaatattcagtttagttgcatcattattaccttcactaactgtctgccttcctaaggatttttttccctctcttatcaccatcatcattcccaatgtttgctgggttgctaatagttgatcctgaatctttcctaccacctttttcggttggtgttaatgttactggcaaaaggcagaagaactgccctgctgtaaatttcgacatctaatttcaaccagagtttcattagcaattggtattcctttattcacttttgtattgcttttctgatgaattctccaataggcctatatctaatccttctcctccaacagccaaaatcccacttttattttctcaaaagcagaagttatcagaagacatcagccacgtgatgttacttcttttatctactctctccgtatttcaaaatatttgttacggtaatacccttatttctctctattagaatatgtatatcctatatttccaaagcttgcctgctgtttcttttagacttgctatagaacacacagttataacaactcttttggttgtttatactcatttgattgttgctgtctttttactttttcttttttttttttttttttttttgagatagagtttcactcttgttgcccaggctagagtgcagtggtgtgatctcggctccctgtgatctccacctcctgggttcaagtgattctctcgcctcagcctcctgagtagctgggattacaggtgcctggcaccatgcctggctaacttgtatttttagtagagacggggtttcactgtgttgcccaagttggtcttgaactcctgacctcaggtgatccagccaccctggcctcccaaagtgctgggattatggtgcgagccaccacacctggccttgccatctatttttaaccaaagaaagctattgcacctactgcaaaagtttaaacaaatcattgtttaacatttatgtactctcttttatttcaaacatcctacattgcttttatttcacagttccatacaatctcccctcaacactgttaaatcaagttcaggctaaaggtttctcagtacaccgtgaactaaaacctaaatggaattgtaaacagacggtagcctcctcttgtgtcaatcaccaagttttggctaaataaatgtggccaactgttgttagaatcatgttcaaataaggcaaatgccaaggtacaaccaatctggctgtttctgtaccaaacttccaatttctgtgttttacttttcctttttctgtccataaatcttctaccatgtgactgcgctggagtctctgagcctactctggttcggtaggctgcctgatttgtaaatcgttctttgctcaattaaacgcttctgaatgtagttttgctccggtttttcttttaacagcacctataacataaatttttacttctaccagactgggtaatcaaacttttcttcacttttagttaaaccattgattttttaaaaatcttatttgactattttgtgctgtttgtctggcaatattttcattttctttccttgaaactctgactcttctaccatactacttctctttcctctcatcatcttttgtgagcactccctgaggcacatctgctagtcttacgggtgagattttaaactcttttaaggtgatatcaattaattactcattaatcatgtactaaatgtatattagttcatagattttctcagatgaatctaatttagcaaggtttcctccttttagtgtggggttcttttcacactgtatggactagaaatgtaaatataaggaaataaagtctctactggtctccactgctgaggtctaagctacgcttcatgggacaaaccattaaaaattacaaacaaaactttagtgtttggaccaggatcaaccatatagatctatgtccatcactgttttctgatagaagatccaaccattaatgagaaacaagcattatggccacacttgaaaaggtcaataagatgcttcagaacacaaaggggaaatcattaatgacgttagatgaatcagtaaagaatccaagtcaatccccatttagagaacaatataaagactaaatgaatttcattataaaatgagcaagattgtaagtataaactaacagccataaataatacttcaaaatgcggctatgcttcaaagtatattacaaaatatatttctgaatagtgataagcccagattttctgaaaggatttttctgagttttcaaaaagtcctgggtaatgcagggagcgttctcactcccatgtaaacagaggagtaattatggaaatattatagagtaatcttagtggacaaaaaaaaagataacaagggccataattataacataggcttaacctcaaatattgaaacatcaccaaagaaagatgctctggctttgaacattgtttttataattaatttttttctttaataaaggagaaaattttattaaaaatcatgtctacaattacctaattttgttaacccatctgaaaaattatgaacacctagggttaccaagcaaaatacttttattatgtttttagcataatttattcattaactgaaattcaaatgtaaatcaaggttttgtatttttatttgctaactctatcttctctgtagagacctaatgatgaatgttattttatattcatattactgcttgttcacctttacacacccccatgaagaatataaattctagtagagaccacgtatttcacatttactactctatcttcagcatctaaaaaccacaaattctaggcccaaatttggaggtaggactatgatcaattttacagacacattgtcatctttatttttaataaagctaccaagcgtgaataaaaagtaaataccatcatcacactccaaaagctcaataagagctctttcacagagagtagattcttctaaaatagttgttttaaataaaagaatgaaaatgaactactcacattacttcatctcttcacttctaggctactccacatagcagtgaagtgttctttggttgacaatgttacctggtagctgacttaaccagtcaacacatctaaatttctcattcagtctctcccctctcccttactgttcaaaagaataatgacccaatgtgactgagaaatcacaaaattttggaacaaaaagggacagaaaatatcaggttaacctcctttattttacagattaaagaactaaagctcacatacctgcaagagtgtttccctgatccaaacctttcaatggttctgggtcacttataagataaaccttctaaagttttggcatgctacaaatgtcctccaagattctgccccagccttcagctccagacgtgtatctcctcataggaattaatactatctcctggcacctataaatgacgagtatccctgtgctcttagtgacccaaaggtgaccacttcctcccttgtacttacatccattcatacttctattatagcacttttaagattatggaatgtagaatggaatttatcagtttaaatgtctgtctcctcttactagtctgagtacaggaactacagcttattcctgctggaattactaatgtctattcaagtgcctggcatgtgccagggcacctggtggaagcccaatatgcatttgacaaatgaagaaacacatacataactaatggcacatattattatataattaatggcagaaatgaagactgtgctttattaccaatccacagaattaagctaagaatctatcaatatcaataaaaaagaaagtaataaattttgagataaaatttgtcttaaaaatcagtgtcagcaatatgtcaagcttacaaacatgctgagaaagcctgctctacaatgttcaaaaaaatgttgtttttcacttttctgtccactaattaagcttgattttttttccaggcatagttttgaacatgaatatctatttcttattcctttatgtttaatttctatagtacagtaagtccttatttaaattcttccatagttcttggaaactgtgactttaattgaaacaatgtatgatgacacccatttttttaaaatcatcaacattgtaagaaaacaatgttgaataaaacaacattatttgagggccactaaagtcacagtttccaagaacttgctgaaaacattagtgagaacttgctgtactatattttgtaatttttcattatacacaccactattttgataataatgtggattgagcagattatggaagagaataccttcaatcattttgcttctataacttaagttctcaactcctaacttaagaatggatttctagaatctaacttgtgtgaaaactaagacccaccattgtgtatgcaaggtaggaatagaaaaaaacccatacacaaaatgtaaaccaaaatttaaaaacagttataggtacaatttccatttataaacacatttgaaataaaactttaaaatttggtaaatgtatgttaattgatgcataccagcgtcatcattttttaattttttaaattcattgcgatctgacttataataatataaaatgatccatttatccataaagcctgtcattatgtgtagctgagttatttatgtgtacatcttttaacagaacttttaagaatagtaaagaaaaaacaatataaaattggtgattctttttataaatacaaacgtcaccatttatttgctatgttcaagtcctaattatgtacaaggcactgaactaaccacattatgtcaatttaaaccttgttacactccagaaaaatcagcaatatcattaccctctaatttgaccaaaaatttagtggatatactcaattataagagaagtacttttgttacataaatattacttagaagtgagaagtgagaaatttagtccttttactaggtgtgctctaaattattttattttgatcaccatacttagggaagaatccatcaatcatagcttggggtaattgtagcgataacctatatgcatttaaaagaaaaagtcaaggaaatataacaccaacttagtcactatttctgggatattatctaataattgttaactattggacataatttcaaataaacctttcaaagactgccttatcagagtaagcagctatcttgtagagatcatgtatatgtgtctacagaataaatgagtgaacgggaatggcctaatttcgtgggacaacactcatgaaataaattttccagtgataatatcacccatagattcatacacttgagtatttcagagtgttatcctctagaaaactgtttaagaggactcagagaagatgaagctactgatatctcaagataccagtgaagaacacaagggaatgaaattcatgaaatgtgatcagaaaccacttcataggttttatataattttaacataaacatatataacccatatattaattaatttgcagagatttggccatatcatctacactcttagaagattttgtcattaaactggccaattaagagaagattttctttgtaaaatgaaagattggcttatattttctggtgtttcttattcatgggcatgtatcacaacctaactactcttttgtaagctttaaggggtagaatcagactgaccagcatctgcctacctcaacagcctgccttttaattactgtctattaaaaatgtatattcactctccctcctctaaacttttcaatataattagtaaaacaaaattataccttggtagtgtctaatgctttctaatggcagtctcttggcagataagaggatgtgcatgtatattcagttgccatgtagcatctcagaactgggtatgattcagtgagtgcaaatgaatattatctaacacaattcactttaaaagagaaagattataagactaactaaggaagaaaaagaataagcttttctaatatatcatttatttaatatatagatatatatctaatgatctatctaatgatatctacctatctatatatagatatacttctaaaaggtatgtattttgatccttaaaagtcatgctgcaattgggtaacattcttaaaacttatctatcatattttataaaacaaaacatgtgtctaggtccgtcatagaagagatatttactgtatgggattggtacccttcctttatataatatgcaaccaaagaaagaagtgtttctttttgccaaagaaaaacagtatttaaaatacacaatatatttttcacccatgtttgagatatccgcaataaccataaaacagctggagtgttttcccaagcattatccatgtcttagccatattctttgctctcatgttattcctagcccccaaataaacccatcttctagacatgtcatcaatttaagtatctatcttgccaaataacaattccaacatttttaaaaactgttgcgttttacattgtgaagctaattatggcagaagtgagaaaaggagtaggcaaaattttactgatagcttataaatataataatcgctttctaaatatataaatttgagtttcagaaggactagggcttgtaatgattatgtggtcttgttgttctattgtgctaatttgaattgaaatggtgctgcaatgccaaaaccactgcttttaaagtaattttctacctgatttatttactcacattaataaaaaaaatattgtgctgtagtcattcacagaagctgaaacagcaaaatacaaactagtccaccatgatctaatttgtacttgccaccacaatatttcttccaggcacaatcaactactctgtcagcatcagtgaacttctctataatgtttaatgagaaaatgtgaagaaagaatatcaaaaacatttttatcagggctcaattttccaacccacttatagtttcaagattcctaggcaatagatgaggctcaggaaaaggtgaagaacgactaatgatcttggtttctcatctgcggggtaagaattaagtagacagagagagagggagattgtacaggacttagtaattttgtagctactcaaacaagggaaagagaaacgaaaagaattctaaacctgccaatgccactccctttacatattaacaggaaatagattacaaagagaaaggacaacctcagatgattttagcatcattttagcagcattcctaggctgataatatactagaaacaacatggtaaaacttaactaaaccataatacaattgtcactaaatagtaatagctaaaataaatagcatttatatagtactgtgcagtttccacacatatatcgccatgggtgcttctatcatcttcagtgaatagattttaaaaaaataaacctttccaaaatagtttgagaaagaaaatcaagaacacgcttgaaaggaacttaaaaagaagagatttatataaaagtttataaatgggtagaaagtaaagtcagtatacattttgaaaagtgacattttatggccttctgttacatttacagtgcatgtaaacattgtttcaaatatataattaaacatgacgaccaccaccagccctcagccctcagccgcagatatacttcacccactccacattctcacataagtaccactgttttaataacatgaggatttcttccatcctagtcaccaaagggcccaggggacactggagtggatagctttagtctcctccacttcaatgtaccccattgcatcccaccaaaaccatcctaagaatactcaatccaagtaaaatgagtatatattttatggtatatttatagtaaaatataccatgtataaatacaatatagtatatttttatgcaaatgcatattttttaaaagtcctccaatactatccccatcttctaatgagctggctatatctaacctgccatttagaagctctggatatatcaatacattaaataattttccagttaaagtaataacatcatttctgccatgagtcacacatttattcattgaacaaatatgtaaagggcctactttatgtcatgactcttctaagatttggtgatacatcagtggaaaaaagacaaaattcttaatctcttgaagcttacactctagtgaggacaaagacaaacaaataaattagtaaatgatatagaattatagcaaggtaagaagtatggagagaacaagatgggagtcagttacaattttaaatagggaacctaaggtacatctcaatgataaggtgacatttggaaaagagttgaaggtgagagagaggtcatgtcatgcatacatctggagtatggaaagagaaaagctagttccaaagccccgaggcaggatcatagccagcgtgttaagggaacagtaaggaaggtcaatgtgaggaagttaatggaataaacaaaatagagtagaaaacgcagtcagagattacaaggatcttagaagacatgttttgaagagcatgaaaaaaatagaggagtcagggataagccaattttttcatattgccatattttatagtaataagctagtttctgcttataaagaaatctgggacataggacagtaaaccatgtgtcctccggaaaactttagcatgtgtttctcacattaggttaaaacatgtatgtgtagtagctcgtatttatgcctttcctatagtgtttaacataaacatttaagtctatcctacaagcaacttatatgcaaaagtaagagagacagagatagaggcagagacagagagagcactaagaagaaatgtagtggctaagaaggctttactctgacttggtgctcccttctggctctcggatcttaaaatcacagtaaatatattgctgaacaatgaatgataagaaaatgcatcgaacacacataatacccagggtgggttaatttttaattgaccatttaaaataacaatattgcacaaaccagctggagtaaaataagggtaagtatgataaggaatctttaggcattaaaaataaactgtatcatatatgggaagaaatggcttaggtatgccaagaagcaggacctcaacacacagctgatatggggaaaaaatggcaatgatagtggaaccacttcctataatttactaaggcaaacgagataacaaaagcatctgatttagagtctttgcttactctaaataattgcacatcaattgagtccagggttcttgcattgagaaataagggagtactactttttaatcctgacaggaaaattaaaaggcccaagttattacataatgtaaataatgtattagagttagcaatgagaaagacttcctttatagcaaggcttatttcataattccagggtaaatctattgtttcgataagattttttttcaattgatacataaataaatgtatacatttaggtacactcttacttttacagaaatttaaatttatgttaacgtaccacttaaaattgcattaaataaaatagcataatatgtgtttttgtaatgtaagaaagatatcagtgtatgctaaaatatataaaatccgatgctaagcaaatggagtaaacaacaaaaaacaacatagccatataaagtttacaaaataattcacatgtagtttacaattgtgtttagaacgtgatctactgaaaatgatagaattatttatagcatctctttggggcctaggccaccttgtacatatagaaagccacagttcttgggtggctgacatactctgaaatgttctcagattttaaattgtagaaacaacacttcccataaacagagagctctctgggggcatctataggactaagtggtaattctcagggaagcaacgttttgggaacattccatcatactgtaccattaatgaattgcctgatttatgaccaatgtaaatttggagctagctaccttcccagaatgcttccaaacggcagcacagttgcaacagtaacaccatcaacacaggaaaagacagcagcctgaggaattcacaaatggacattttggccaaggcgtgaacatataatggatgcagagttccaaaggaggtgctagacttcaagcagcacataaaaactgaaatactacatatgagtaatgttacacttcaacctttgtcacacaaaagctctaaagggctccagatatggggacagcagatatgggcagcatccttgaagcaattattttagagagagctctgctgtgagtataacaaaaaaggaagactgggaagcagttccctaaccctgaactaagatttctctgcaagtacaaaaaaagcttgaatgagctacctgcagttgggggatgctttggcctggagcctaattcacatctgaaaaagctaaagaggccagtgagtaccgagtacaagcctgtgtttgagtttaaaagcaaccccttcacctagatattgaaaggggatgaattccagaagccaaccctaatatctgcagtagaatcttcagtgtggagccatttaaaaacaggctggcccaagagggcaacatgcccggataagagttcctggtagtaagaggtggagtttactgtgggagtccacgatgatggggaacaccaaacaccagccaattccacaacagagttgcaatcggagggacccaacaggcaagtttttcttcaaaaatccttctctcatgtctactgtccctctctatggatgtgattatgtggttcaagaattgttgaaccaatttcagattataacttttgtgcatgtctaacatttcctttgcagtcatagcaactattgtttttgggttttttttttttttttttttttttgagacagagtctcactcttttctccagactggaatgcagtggcgcgatctcagctcgttgcaacctctgcatcccaagttcaggcaattctcctgtctcagcctcctgagtagctagggttgtaggcacccgccaccacgcctggctaatttttgtatttttagtacagacggggtttcaccatattggtcaggctgatctcaaactcctgaccttacgtgatccacccacctcggcctcccaaagtgctgggtttacaggcttgagccaatgcgcccagccagcaactattgtttcttaatgcctcagcctaataatacttatagtaatctgttatacatgtgtgctttaaggattttaaaacctctccatttcttagccagaacctaaatattcaggttactttgctgttgttaattttttaaacatttcttattagcatccctagaagttttatttctattttaactttcttattattttggctaataaatataattacttttatatttcggagttgtgtttctgcttaatcttttttttgatgcttttgaagagggtgcaacaaagtaattgagggcaaatgctttcagtagtgtgctgttgtaaaagatttttaatttagtatttgaattatgtattaatatcatttcagtgtagctttctttcaggaaaatattaagagatagctaaaaataagaaatgtccttttttgggcaagcatggtggctcacacctataatcccagcactttgggaggccaaggtgggcagattacttgaggccaggagtttgagaccagcctggccaacatggcgaaaccccatctctactaaaactacaaaaattagtagttttagtagcacatgcctgtaatcccagctatgcgggaggctgaggcatgagaatcctttgaacctgggaggcagaggttggaggcggaggttgcagtgagccaagatcatgccactgcactagagcctaggtggtagagagactcttgtctccaaaaagaaagaaagaaatgtcctttttgccccatgttacacaaatttgttgtattaagacatattaatgtattacatttattacaatatcatttactatattctctctccaaagttttacagttaaagtagttttgctttaatttaaaggtattttctttttactgaattttctacttataacttcataggatattgagattacatttaaatgggcaaaatattttattataatatcatgtatcctcatatttgaagatgagtgtagaaaaaaaaatccccactacatcatgtcccatttagtgttccaaatttctttatttgctttgatacatctgactatagcattatagatttaaatattttaaaagcaaatagtggttaatttatatatcatactagctagatgaattactgactacgctacattttttcctatgtcagggaaaagttagaacattgtactagtacttaaaatagatataagcagatgatctccagtatattttcattatatccagtatatttcattattatcttataatacagtatgagctaagctaatgagaagaaatattgaaaccaccttgccaatatcagtaacattgacctaccttggcctcctaaatcagttttggactcaaccatcacatactatgaactaatttgagactctcaaaccttttatttcacagtatttcctagtgcctacgattgtaagacatatttaagggggaaatgggtgcctaaattctcaattcacattaatgcgtttaatgtgtaagaaagggtagtaggctactgctttgcaaagcagatttttatgctttggcccctagccatacctgaatttcttagaaggaaaatgtttcctcccttagaagtgcttcaagaaagtggaattcaggaaattgttttaaaagagtcacttaaaatatgaaatcagcagaaattggggatttagttgatagtagccaaaaacattgtaaagagcactggaggctgtgtaattttgaaaggattgtgtttgtaggcattgtgttcagcagtcaacatgagcaaaaacgataagaaaaaaagattcagcagaggctccattgccagggatgctagcagcctgccaaacacacagaggtagcaaccattctacctctttggctgtcttcagggtaacattacccttccctgctaaacaaaggaaaaggtgcccattgaaatctgcagcatgcagtcacacctgcttaagttgtgcttgcttttccttcatacaaaatatttgtgtaactgcaagcagagggttacatctccacctagcatataaaatggagaaacagcatatattataatttttcacaagacagacaataaggacaaaaaattttagttaagtatattttactatgttatttgtgattgtatattgaatcgtattgtcatattaaatttatttttacttcattatatatagataggctgcctggacaattcaaggaaatgtattcctcttgttcctagaagtacaggttgtctcctgtcttataagacagctatttggttagagcagcttctgattttctacataaggcttataatttaaatatttcaggaaagagagggagaaaaaatatatattatatttaattagtggattttctgaacacaaaatgagaagagaaagaaaatgactcttccttctggtttcgtaaagggacatactaactttgccgttttagtctattagctagaggaactgagcagcttcctaggatattctaagtaaaaaagaagtgatgggcataatccccattgaaaaatgccaggtggctgcctgagggtagaggagactctcagtatatataaagaatttccctcaaactagctctcaacccaattccctatggactcatgactcatgagtaagtcttaggaaaaaaagacactcactgaaaaaacttccaaggttgatgactagatagatagatagatgcatagatagatagatatgcagaaatttctgttattgtgaaatataaactaatacttgaaaaaaaaggaagacttgatttcagtcctcattggaatctcatgtgcacagagtaaggaacaagaaataacagggatgatggtttccaatgagaggtgaaaatattcaaaagatgtggctcaactgtggacactggatgccaccaggaggcggtgtaggaagcaacacgtgcatgatccaatctgaagggaacatcagcaggggaagaaatagatgctgggatattgagttactattttttcagtgtttgagccaacccaagcaacgtgctatgccctttacatcagttacctcaggtgatccctataattaaattagatattataattcccaatttacatatgatgaaactgatgatttaagagcaagtatttgaggaaactacccacttctggtatcactgtcctgtcacacatgaaaatatacaatgactccatctctgggaattctggaaatcaaaacattacattgcaaatcaatattagaagaccaagagcaggaaggagtgtcattactcaaaatttataaatagaacaatatatagtaactgttaatacacaaagctaagatggtggtagggagattgttagctattcatgatttaaaagaaaactataaggtttaagataagacacaatgaaattattaatagcactaaataagaaccatggaaggaggagtggagtttaggtatcataggcttatgtcatgattacacccaagaaagaaaataaagatttcaagaatgctgcccaaggtggaaggcacaagtcatgtcttgacattgtcaattggcattaacaattacattctggaggaatttcactgtctccctctgcttctctcacactacctctccattccctttttgtacagatttcagaagtagaaagcaaaggaaggcaaactctcaagcctcctgtgcttttactttcagttattttattactggcctcattgtatgtggaggctaatgcaaatccatcttggatgctaatctgccgtgttgactcttgattaacccctgttcagggaaagcctctcagagttctaccttgtctgttgttagggtaaatcctgcccttaggccaaacatccttgaccataaatcctgtccttaggcaaatttacatagcattcttgcttttcccttggaaatctgtcaacttcaatccgatctttgtatgttggttatgcgggaagagacaacttatatctttagtttacaggtctacaaatcaagatcaacagtactgtggtatataagacctggatctggcaggtaattgtgtggggatccaccatcatgtctcactgtcacccatgactagggcttctctttggaaatccatagtaaatgtttctttctgaggaactggatatgtcagcctcttcctttggcctcttagcctccttagactttggggataaatttgcacatatctagctattgcagaacagcataaaaggtttttgttttgttttgtttttactaccaagcatcataacaaattaactggatttttaaaaaactaacataaaatggttaagcaatgcatccacagctacacagttaataggtaacagagttgggatgtaaacacagtctgtctgacttgaggagccattttttaatgctttttattttaaaataattaaatattatattcacaagaatttgcaagatagtacagagaggaacctacacccttcacccagtttcttccaatggttctgtggtacataactacattacaatataaataccaggaagttgtcattggtgcaataaatgtgtatagcttcatgccattttatcttgtgtatagattcttgtaactaccatcaccacagctaaaatacagacctattccttatcacgaagatctccctcatattacccttctacagtcacaactacactctcctccaaccatttctaaaccctgataaccacttacttgttctctattctatagttttatttcaagaatcctatataaatggagtcatacagccgggcgcgttggctcacgcctgtaatcccagcactttgggaggccaaggagggtggatcacgaggtcaggagttcaagaccagcctggccaagatggtgaaacgccatctctactaaaaatacaaaaattagctgggcgtggtggtgggtgcttgtagtcccagctacttgggaggctgaggcagagaattgcttgaacccgagaggcagaggttgcagtgagccgagatcacgccactgcactctagcctgggcgacagagcgagactctatctcaaaaaaaaaaaaaaaagaaaggagtcatacaatatataacttcctgatattaactttttttaactttgtgtaatacctttgatccatccaaattgttgcatgtatcaagtttgttcctttttattgatgaatagtattgtatgggatggatattccagttcgtttaaccattcatttgttgaaggacattttgattgtttccagttttcactattacaaatacacttgctatgaacaatcatgtaaatgttttcatctggacatacattttcattgttctgtggtaaatatctagaattatgactgctgggtcatatggtaaatgtatatttagtttatttttgtttgtttttaagaaactgccattttctccccccaaaaggattaatgtttaaccactgtattttagttattttagtacttactatatttggataaacagtatccatgatggctgtggtagggatagagacaggagatagcgggaggtccagcgaaactccaccttcaagcctagggcagcctgaagactgaaaaaccagactgcgggtaccagatgaagtctgtcacctcctaactgattctgaataatgcccacctgcgcactaggggaaggagctggagccaggagaagcttaaactgttttcagaggggaggagccaggcctctccagctcctgtgtggtggcctgggattcaatctgtgaggcaggagacctgccaacaggagtctctcactttgctgaaagttcctctttccttttttcttttcacctaataagcctgtcctactcaccctgcaatgtgtccgcatgcctaaattttctgggccatatgacaagaacctgtttttttctagaacagtagccagcttgcaatattttcaatatggtccccaatgatccctgcctcctcccaatattcacagccttgtgtaatcccctcccacatttttctaggtttagaatgtgtggtcaatagtttaaaacagaagtgatggtagacttccaagattaggttgtaaaagactgtggtttcatctctctctctctctttctctctgtctgtctctcttcatatggcctgaaggaagtcatgttggaaggaaccctataggcgagctcagttctaaagaactgaagccttctgcaaaaaccacatgagcaaacttgaaagtgaatcgttcagccccagttaagccttcagagactacaactctagcaaacacttcaactgtaaccttttaagagaccctaagccaaactcaactagctaagacactgccagattccttaagaagctaagttttgtgttatttgttactcaagcatacacagcaaatatatattttgacacaaaagtgcagtgatgccaaaataaaaacttaaaatgtaagagtggctttggaaccacctaatgaatggagctgaataaactctaaagattttgagaagactgctagtgatatcttaaagagccttttacacactgttcatagaattttgactttgatgaataactcctgggcagatacaggacagagtcctaatcaagaaacttccaaatttttcctgactgaatttaaaacttcctaggaacaaagactcctttgtaacttccattgttctcctttcttattagaaatacctatagtggttattcatatgcttgtcccaccttcgtatgttggttatgtgggaacagataacttatctcttgagtttacaggtctataaatcaagataaacgtactggagctttacctacagaactgcacccaagaaaacttatcataactggtcctgattcatatagtgaaattctagattatgagctgatgctgtaataggatgaggctttgtggggtatcgggggtgggtggcgaggggccttgggaaagggtgagtgtgttttcagtgtgggagggatatgaatcatcagcagatagaggaaaaactgtagcatccaggccccaaaatggctcccagtgattgctgaatcctggtttcacactcttctcatggtccctcctatattgtattaggatcagtctatgtgaccaatagaatatgactgaagtaatagtatagtgtgtcactgctgagattcagttatagaaaattgtggcttccgttttgttccctctctctctcatcatttgctttaaagaaagacatgatgtaagtagcccacatggtgaaaaactgaatcctcctcttaacagccacatgagaaaccttagagtcagatccctagtcccaattaagtcttttttttttcttttttgaaactgcacctctagccaacacctcgattgaaacctcatgagacaactgagataaaatcattcagctaagccactccagcattcttgatccacagaaacttttggataataaatgtcctattttcaagccactatgatttggggtaatttgttatgcagcaataggaaactactactgtgattaataagacttaagaataaaggctgggtgcagtggctcacacctgtaatcccaggactttgggaggctgaggcgggcggctcctttgaggtcaggagtttgagacaagcctggtcaacatggagaaacctcatctctactaaaatacaaaaattagctgggcatggtggtgcgcacctctaatcccagctgctcaggaggctgaggcaggagaatcacttgaacccgggaggcagaggttgcagtgagccgagatcacgccactgcactccagcctgggcaacagagtgagactcggtctcaaaaaataataataagaagaagaataaagatatccacaaacacagaaacatgggtaagatttatctgacacagaaataactggagtttttcccaaaaaatgtggttttaagcacagtttagatgctcagaattattgtttcagaaaggcataagtgaactgtgattataatttgtagaacatatctctaacatattgaagtgtatccttttgaaacaggaaattttctctgacttgtttactcagccggtagttctcaacccctgagagggtgcaggggctgggatgagtgcttctgggcgccagcaggggcagaactctgtgtggccccgtggcagagttttggagggtacctgcgacccctggagctgaagagggtgtgtgatacagtgtggtctgttagctttgctgtctacggacggcttaagtatttaacagctcattgtgacagccctctgtatttcgagctcttgttcagcatccaagaagaatcaggccgcacaaacgaattgaagacggtaaatgtgggggattttattgccgatggaagtggctctcagcaggatgggaagctggaaagggaggggagtgggaaggtggtcttcccctggagttcagggcagccaaactcttctccacagtcccaccatcaagccgtccctctgaagtcaagctgcttctcaccaacatcaagctgcttctcttctctccttctctgccacatgctgccagtggagcctgggatttttataggtacaggatggggggtgaggtgggccagagtggttttgaaaaagacaacattcaagccagaaaacagggatgtaaagttctcactttgggccgtgggtccaggcttgatggtagggccctcgccagggatcgcccgcttctacccagtatttccctgccctctgtccatatcacttttggaggaaaatagcaaacaaaagaagctgtaagtgtgtctcctatactattcaggagagcacatattctgaccaggtaatatgaattcatttggccagtgtctaatcttatcaaggattgcatagaactgatgacattaaataattacaccagctcatctggttgtgataccacattcacaaagacaccatctaattataacctggcttaactcataaattttcctagagaaggcccagttcactagctacctgttatttgtttctaagctagctggtatttgtgacctgtatcataaacaagcattctgatttttatgtaagtgatatgtggtcatgttagcagaagccagttacggtaactcagatcaattctggatgccctgcagaaaaaaataagcttcttaatttttaagtcaaaagagcatgggaactgcactgagatcttaacaactagtgctctttcctctgtcccttcaacagcagtgagctggcctcaattccatctctgattttactcactttaaattcaatactactattactaaatctcactgtgttacccattcaaccaaatataacttagtaatagttttcaggcaattgagaacatacttccatttaacaatgacaagaacaacaaaatgctagatgaatgaatgaatgataggtcagttaacttttagaagctgtagttaaaagcaagtattttgaatgtattaacaaggcaatgtaacatgctgggagcgggggaatctcatgtcatgtttagtgtgtgtatttgctacaatttgtcagtcaagtataattttacaaagaccttgtatttagaatcaaatcgcaatgcttggaagtaattgagttgcattttgggatttgccttaagggagatagaaggtgagaggcttctagcttaagtacaattacagaaaagggccttgcatttttatgacttaggttattggccaatcaatgggtcattggatctttattattttaattaaaattggttcactttgatgacataaaacatattgattatgggtattctcctcagagtcttgaaagatttggtagaaaatagcagtctctacctttctcatgtacccatcaattctgttaactctcttagtctgatttctcttttcttctttgattttacttctacatcactttttgtttttattcatattttgcagtaatcttatggaaatgacacccacccctacacagcgtataaccaggagtcattactactctgtatttgataagtgtagaaagggccattgctcatgcaaatgtctacacattctctgcatagctacttactattagcttcaatattgtttaactcaaacactgtaattttgaccatagacccaaaattattctgttattttctttttcactcatgtgtttatgcatttattaaaaaatatttcagtacttactgtgtattaagttgggaaggaaggaaagaagggagagaaagaagaaaataaagaaagagagaaagaaggaaagaaagaaggaaagaaaaagaaagaacgaaagaaagaaagaaagaaagaaaaagaaagaaagaaagaaagaaaagagaggaagagagtaaggaagggagggatggaggaaggaagggagggaggaaggaaagggaagggaagaagggagaagggggagagagaaaaaaatgaaagaaaaggaaaagaaaagaaaagagaaaaggaaagaaaagtaaagagaaagaaaagaaaggtaggcactaaaacgttgcaggtattcataaagcagctgcttaaaaataaaactaattcttttctataaggttattctcttctagacaaagttcaactggtcaaatactcttgttttttaaagttgctttgtaataattgtcctaagcttgttttatttatataatttagtgtatttagagtgtggatacttagatatttgggtttcaaagttcacgtgctcaaattatcatctaagctctaagatacaaaaaccaaaaacaaacaaacaaacagaaaaccttaacaaaatgtttataatttccttaagctgacctttaagaacatccctgaaatgcatcttttggacaatattttgtttgtaatgtttctggacattaggaaaagttaatatagacgagggaaaataagtaaggaataaaactctacatgtctaaagaataatgccaagcaggagaaaggaagtttagcatttttaaactacctaagtatgttaggtaatgggttacttatgaaaattaagtatttgtacatttgtacatttttatagcagcccttcagaccaaaacatgttattgaatttatattccttcagattttagaaaactaattcatgtgtttctttttctactacgttcatcgttcaaaggcaaaagttatgattattcacactaaataggatttttaaaagactatcaataacttcttatttgcacaagatttaccaccaaatgatttacaagattcgtttctatttttcagaggtatttgtttgttttgaattttgaaaatggtaataagcactgataagacatcataagaaaagtgaggtttacaagtataagttacccagcctgtcaattattggcttggtatacatgcccaagatcaccacattaatatttagtggtatgaccattaattttatgtatcaactttattgaccacagggtgccagataaaatattctttctggttgtgtctttcagcctgtttctggatgagattagcatttgaattggtggattcagttacgtagcttacccttcacaatgtggttgggcatcatccaagtctttaatggtctgagttgaacaaaaagcaacaaaaggctgggtgcagtggctcaagcctgtaatctcagcattttgggaggctgagatgggaggatcacttgagcccaggagttcaggactagcttgtgcaacacagtgaggccctgtctctaaaaaaataaaaataaataaaaatgtaaaaagcaagaaaggggaaattcactacagttttcctacctcactgtttgagctgaggcatctcatatcttctcagacactgggagtaggatttactccattgactcccctggttctcaggtcctcaaactccaactgatttacaccaccagctcccatgtaagccaatttctcttaataaatcttcatatatataaacaatctcctactggttctctttctctggagaactctgactaatacaagtaggaagcgttcaacaaagatttatccagtggagattcaaactaatgcctgacacattttatactccacgcttttccaccacaccaggtagtgccaatttatagaaaatactttctccagaaggcttggtatttagaaatgtcatataatattatattgcttgtcatggtaacaacgtgaaatacaagaatatgatactaaaatatttgctttaaggtagaaattttctcttacaatttttcctcctacaagaagggcgtagatgagtcagacactgatccaattctcactggcccagttaacttgtctaatgtaattgagaagatgaaatgaaggaattcatctatacattaactaataggcttccttaagtactaagaaatgtctactccaaaaggaaggatgtggctttcttaaaatacgaaccaaacatagaaatctcagaaggtcctttataagataacttatatagcaattaaatggcattatacactaaaattcatagtccttacagttttttgaaagcagtctcaatttagtttgtaactgtgattttctttattttctaagtccaatctcatttttttctttggttttcatttttaattgacacataataattctacatatttatgtcgtacaaaataatatttcaatacatatatacaaagcataatgatgaaatcagaataattatatttatgacctcaaaaatttatcatttctttgcgctaggaacatttaaaatcctttcttctagctatttgaaaatatacattgacttattcttaactatagtcaccccacaatgctatagaaccctataacctattcctcctttattgcatctagctgtaattttgtatccattaaccaacgtctctatcctttcctccctcctaccaatcccagcttctaataatcacagttttcacggtttacttctataaggtcaagtttttagctcccacatgagtgagaatatgtgatattaatctttctgtgctagacttattttgcataacataatcccctccagactcacccatgtttccaagaatgacaggatttcattcattttattcaaatatatatatatatatatatatatatatatatgaatgaatagtattccatcgtgtatatatactatattatctttatccattaatctggtgataagcaattaggctgattccatatcttgactatagagaatagtgttataataaatatggggatacatatatctttctgatacacttactttatttcctttgggtaaatatcaagtaatgggattgctggatcatatggtattcaaatttttaatttttggaggaaacattatactatttttcaaaatagatgtcctaatttacattctcatcaacagtgtataagagctcccttttctccacatcctcaccaacatttctgatttttttttaataacagccattctaattggggaaaaattatacctctctggatttaatttgcattcccctgatgattagtgatattgaacatttttaaatatacttattagccactcgtatgtcttattttgagaaatgtctattcagatattttgctcattttaaaaatgaggttatttggatattttgctgttgacttctttgagttcttaatattaatcccttgtcaaatgagtagtatgcaaatattttctcccattctacaggttacttcttcattcttcactctgttgtttcctttgctgcacaggagctctttagctttatataatccattggtctatttttgcttttatagcctatgtttttgaactcttaaccacaaaaactttgcccaggccaatatctctagttttcttctagtagtgttatagacttgggtcttacatttaagttttcacccattttgagttgatttctgtatatagtgagagatagagatctagtttcattcttccacctacagatatctaggtttgtcagcaccatttattgaaaaggctgccattttcccaatgcctattctttgcacttttgtgaaaaatcaattggctatacatacgtggatttatttctgggttctctattctgttccatttgtctatgtgtctgtttttatatcagtatcacactgctttgattactatagatttgtagtatattttggagacaagcagtattatgcctctagctttattcatttttctcagaactgatttagttatttgaggtctttcgtggttccatacaaattttaggattttttttcctttttttttttttgaagcatgtcctaagtttggatggaaattgcattaaacctgtaggctactttgggtagtatggtcatttttataatattaattcttccagtccatgaacatgggatgtctttccattttatttgtgtccactctaatgtatttcatcaatattttataattttcattgtagagaattttcaactccttggttgaatttattcttaggtatttttttattatttttacagctattataaacataattgctttcttaatttatttttcactaagtttattattggtgtatagagagactaattatttttgctcatttattgtgtatcctgcaaatttaccaaatttatcaggtctaagattttttttggtggagtctagattttcctatatataagatcatgtcatctccatatagggataatttgacttcctcttttttgagttggatatacttttttaaagagatagggtctcactgtgtagcccaggctggtttcaaactcctgagctcaagtgatcctctcattctagcctcctgagtagctgggactacacaaatatgccactgcacccagctgcactttattcctttctcttgcctaattattctggctaggacttccagtgctatgttaaataagagtggtgaaagtgggcatcattgtcctatcccagtttttcaaggaaaagctttcagttttctccattcagtatattagctgtggttttgtcatatgtggcctttactgtgttgaggtacacttctatacttaatttgttaagaggtgtttttttttttttcatgaggtaatgttgaattttatcaaatgctttttctgccactattgaggtgatcattcaattgttgctgtgatgtatcacatttattgacttgcatatgttaaactatccttgcattcctagaaaaataatcccacgtaattgcaatgtataatccttctgatatgctgttggatttcatttgttagttttttgttgaggatatttgcgtctatgttcattcaaaatattggtctgtagatttcttttattgttgtgtccttgtctggttttggtatcagggtaatgcttcccttataaaatgagtaagaaagtttgtactcctttttacttttttgcaaaattgtgagaactgattttagttctttaaaaatttggtagaatttagcagtgaagtcatctggtcctaggctttgtgctgttgttattgggagattttttatttctgatttaacatccttactcattattggtctggttagattttcaaattcttcctggttcagtcttcgaaggtggatgtatccaaaaatttattcatttcctctaggttttccaatttattggcatatagttgttcacaatattctcttgtgatcctttatatttccgtggtatctgttgtaatgcctgcattatgatttttgatttatgtgggtcatctctcttttttctttgtttgtctcactaacaactgttcaattttgattatctttccaaaacactatcattatattgtttttattttattgatcttttgtattttttgtgcctgttttgtttatttttgctctgaattttattatttctttctatctactaagttgggtttggtttgttcttgcttttctaatttctcagaatgcatcattaggttgtttatttgaaatctttcttttttgatgtgtttttgccataaatttctatattactactgcttttgctgtatctcacaggttttggtatgctgtctttcaattttcatttctttgaagaaatttcttcatgttcttcttaattttttattaactaattgaccattcaggggcacgttgtttgatttgaatgcatttgtacagtttctgaagttcctcttgttattaatttctatgtttatttcattgttattttttaaaaatacctcacatgacttcgattatttttaaatttattaggatttgttttgtgacctaactttgtgctgatgagaacaatgtgtacttgtagttgttgcatcaaatcttctctacttgtatattaggtctatttggtctatattgcagttgaagtttgatgtttctttgattttttgtctaaatctgtccactctctgttcaatgttgagagtgggttgctgaagtccccgactatttgtaatggagtatatttcttctattcgttctaatagtatttgcttcatatatctgtgtgctctggtgttgggtgcatatatacttataattgtgatatcttcttgctgaatttatttatcattatataataactttgtctcttttaatgttttttgacttaaagtattttatctgatataagtatagctacttctgctcatttttggtttccattcacaaggaataactttttccattctttgactttcagtctgcatgtgtatttccaggtaaagtgagcttcttgtatgcagcatatagttaggtcaattttttaaatctatatagcccagtcagcaaaacttttaatttgataatttaaaccatttaccaaagattttattgaatgttgagaatttactcctgttcttttgttaattgtttactggttgtgttgtaaaccctttgttttcttctctgcctcttattgtttaacattgcagtatggaggtattctgtagtgagatcattttacttctttctctttcttacttgtgcatctgctgtaccagtgagttttatacttttgtgttttttcataatggcagatatcatcctttcacatccacgtgtcaggctctcttatgcaattcacgtggggctggtctcgtggtgatgaattttcttagtttttgcttgtctaaaaaagatcctatttcttttttatttctgaaggatagctttcctgagtataatattctcgtctcacaggttttttttatttctttcaactctttgaatatatcatcctattctctcttggcctgtaaggtttctgctgagaaatcttctgttagtctgatagggatttccttgtatgtgacttgttgcttttcccttgctgtttttagattctccccttgtctttggacaatttcagtatagtttgcctcagagggcacctgtttgggttgaatttatttgtaatttttttagcttcttaatctggatatccatatctcttctaagacttaggacatttttagctattatttcattaaataggtttctgccttttagcatcttttctcttgctgtaacttctataatgtaactatgtatttgcttaataatgtctcttatatcctatagagtttcttcattctttttcattctgtttttcttttcttttctcctcttttttgtctcattgggtaatttctctattcaccttcagaaattttttttctgcttaattcagttctactattgaagtttttctattgtattttttatttcacttattgaatttttcaatttcaagatttcaggttggatctttttaaacaatatctatctctttgctaaatgtctctttcagatcataagctattattttttcttggattgtctatttgtgttctcatgtctcactgagtttacttaagatcattattttaaatttgggtctgttactggagaattatgatgttgctttgaaaatgccatgtttctttgctctttcatgtttttcctgttcttaaattgatatttaagatcttgtaggacagtcccttcttccaattttatgtaatagttttaatagggaaagactttttcctgtagatattttcaataatgtgggttggatagagtgctttggttaaggttctaggtgggcactgttgtatattatccatatgatttctaaagctgtaatcaatgtcatcagtgtctgagagtgcatcagcggtctaggctgcaattatttgtgaaatctgtggcagagctttactggggacagggatgccaggttggttggtccttggtctccaggagagcccacagaggtgcacagtcacgttgcctgtggaggggtcaagattgcctgtggcggtgacaggctcctcatgggacagtcctcaagtttatggagagcgtgcacagtcttgtgatggccccattttggatgaagcagggtccctgatggtgatggaaagccctgggcaggtggctcttggattctggggaatgagtgtgtcaggtcactatgtcctgagggctgccttcccagtgtgctggatcatttatgccctgatgtatagagctctgcctgggctctggtaacaaagttacagctgcaccactatgttcatcttttgtcatgatgctgcagctttcctggtagatgaggtggaaggtcagcaagccccagggatatggaggtgcaggggctattgggccccagggaagaataaactcaggtggtggctcttctctaaaaatggggccatgctgtggcagcttgggtctttggaggtgaagaggacccaatgtgaattttctttctgggacaatgcagttgcatggactccaggcagctctctatacttgactcagctcctgcaatggctgtgaagctctcctgttagtaggagtgtgagtattcatcgtgggaatgtggactactgaggatctcttgcttttcttttttctgcagtggaaagctcctcttggcttgcagacaatcctggccagacacttcattttctctatatgcatatatgatactatataaccctagtatctatgcctcagagggtttttgatatttcgtaatagaaaaaaaaatcataagatttactgaatcgtaaagtgcttttttttcctttgatgaagtcatttgaaatattctaatatctagcagttgtccctctgaaacatttcatggggaagggggaatccttccagaatatggaggtttaagattgtaacctgatccaagtggagcttgacttcttggctcctgattttgatgctgttttccctcattatacactaagatagctttatacaatgtaattagtggttttagtcagcacattcatttcagggtaaagggaaaacaaaataaaatatctgggaatgggtatatattttaaattaataaagttactttattttatcctccctctttactagagaagctaaatgcaaaactaaatagactagcaattattatccaattatccacagacatgtgtatgctttagctgtatttttaagaataccaacaatgagaaagctgacagtttcacaattagctgacaaacaaagcccccattctctctctactcctcctccttactctctgattttacaagatcaaattagtattactgaataaactatctcaatgctatactgctactgctaaggattaaattctgtttcaccatctaaacagaaatttaatttcccagtctaaacagaagatacagatccaagaatatctaatgaaatacaacccacagtgtgttctaattacatacagttgaggttttcagagttaatcctaaagagagtaataacttcccccaaaatcagacactgtccaatgccttgatttcagtctagttcgactttgagcaggaaccccagacaatatgcacctaaactatggacccacaaaatctatgagataataaatttatgttgttttaagctgataaatttgtggtaacttgctatacatctatagaaaactaatacagtttagttcaatattgtaaggatttcagttctcttaagttaatcaacagagtcaatgcaatgtacataaaaatcccaggacctttctgtgcaaattttaaaaataattttaaaatttaagtaatttaaaactaataaatttaaaatttaagtaaattaaaactaatacaattttgattcaatattttaaagatttcagttctcttcaagttagtcaatagattcaatgcaatgtacataaaaatcccaggacttttctgtgcaaatttaaaaaataattttaaaatttaagtagaaaagatccagaaatgaccaagttaatactgaataggaagaacaaaggaggaagatatatactgatactagtgcaaggacaaacattacatggaatttaaaaatatatccaggagcagaaatagtgtaacatttatacaatcacttgatttattacaaagttgaccttgaagtaaaaagagaaaagatgattgatttgataattgttactaggtctataggatatccacatggggaaaattgtatcttaacttttaccttctgcaacatctgtcaacaatcaatttcaggccaggcgcggtggctcacgcctgtaatcccagcattttgggaggccgaggcgggcggctcacgaggtcaggagatcgagaccatcctggctagcatggtgaaaccccatctctactaaaaaatacaacaaaaattagccgggcgtggtggtgtgcgcctgtagtcccagctactggggaggctgaggcaggagaatggcgtgaacccgggaggcggagcttgtagtgagccgagatcgcgccactgcactccagcctgggtgacagagcaagactccacctcaaaaaaaaaaaaaaaaaaaaaaaaaaaaaaaatttcaggtgtatgatacatttaaatatgaaaggaaaaacaataaagtttctacacagtatcttcatgaccttaaagtttagcaattatattttaagcaggacacaaaaatcactaaccataaagggaacatctaattgatgtactagttttattaaaataaaaattatttttctaaaataagctaccaagtgaacagtaagccacagagtagaagaagatattcacattacactcatcagaccaatgaataacatttagaatatgtaaaagtcttataaatcaattttaaaaatcagataacttatttatgagtgtcttaaataggtactttacaaaatagaaatttacatgatcaataaacacataaaatggttctcaacttccatatttatcaagaaaatgcatattacagtgctccagcactgcatatagactagaatagttaaaattaaaaggactgatatcattgagtgttggccaaaatgtggaccaacttaaaaagcaatactatttcacttctggtggattaaacatatatataaaactttggaacttgccgtatcttctaaagctaaatatgttatacttgatgatgatctaagaactcttctcccaggtggaattgaaaatgtacttaaatgtgtgttaaagcacatgtataagaatgttcatagcagcattattaataattgttaaaaacttagaatgcttttccagtaaggaaaatggatgaatctttactaaacaaaatgtcatagttgaatttcacaaactattttgaataaaataaacctgttgtaaaaatgtacatatgttctctgttccatttatataaaactaaaaaataacaggcaaaattaatttgtggtgatagggaaaaatgactcctttttaaaaggttaatgactgggtaggcacacaaagtatatttcttgtggtactgataatattcaacttcttaatccatgaatgctttcatgggtgttttcactttatataaagtcatttatattttttattttacacttctttttacatatgttacacttcaacaacatgtttaccaaataaataatccaaaaatatatatatttggtcataaatcaggtatggttcttcaacaagaatctgtctccccctactaaacagcaggactcctgtgctccttagagttgaagatacacacatacacacagacaaacacattcacatacagccaaacacacacatgcctggaaaatattgctggattcaagatatgtgtgtgaaggatgattgaacattgatctttgagaaacttttacggttgttatgcaccccacatacataatatatgatttgtagttgcgtgtctgatataaaagatctaatttttataaaattgtgttacaagtatttgattgagactgacaacatgaagtaggaaatccttaaatggtgacctacatccctaaggcaggtgaaaagtatcatgagaatcaactgttattttgcaaggtgtagtaactcaattttaaaatggcccccacagatcccttcctcttattatttacaactatgcaaaactcccttctcttgagtataggcttgaactattaacttgtttcttatgaacagaatgaagcaaaagtgagaggtatttccgagattaccttccaaaagactgtgactttaatctccttcacaggctctttctcactttctcatttgattcctgcaattgaagccatctgctatgctgtgtcctgttctttggatcagcacatatgacaaggaagtgaaagtagtctctgtccaacaatcagtctaacagcctgagaagaactgaattctgtcaatgaccacgtaagcttcgaagcagacctttcgcttgttgagccttcagatagacagcagccctagctgacatcttaactgcagtcttgtgacaggtcctcagacaggataagccaaattatacccagactgctgatccacagaaaatgagaggtaataaatatcgttgttttaaaccactaaatttggtagtaatgttacatagtaaaaaataagaagtatacaatatatcaaattgtgctgcttctttatttcatgctttaaaattttatttccaatttttagtttttaaaggtattatctatggtattaaaaataactataaatttattattaaatgtattttattatagttttattaatattctattacatataagatataataccaacttatggatttataaaattatttatcctgatatataaaataaattgacatataaaataattattttattaatcatcattgttatttaaaataaccacatataatcatagcctaattatatctcaaagctacctaatgccttctttaagtgactagtttcacattccaaagaagagtcaactaattttaagtatatttgtagaattttcgtggatagttctaagtagtttggtcacatatttagttaaattggaagcaagtaaataagaaaatagatccgccatgaacatatccgatattggagtgtgaaaggcaaatacccagatagttatgataaaaatgaacaaagctattaatctgacaattaatagggccagatttagcaagatttcagattatgttttattttaatgtccatttatcattgtctataagatccaaagaatgctcatatacattgaataaattgtccatctgtcctattttttaaggatgatttgactaaaaacattttttctcacgtctattttctcatagtagcacttttgacacatccatttcccatttttggttttggaaaatgaggtcactctacctatggaaaagacaaaggaaattttaagtctctccccttgggttgtttgtagtctcattgagaagaagacaaagatgtgtatctttatcttcccttaatacctgtaaattaggaaaagtaagaatggaaaaacaaaggaacaaacggagacaatgagatacagaaaagctcaaagaaagataagtcagaactaaacacaagttttcttatgaataaagtatctcttctttatttacttttatcttgtttcctagatcagttgtcttacagaattagaccaaccaattacaaaaatgacaagatacaaacatatagcaagcatacaaattctcaggaaagctacacttgaaactagttatgtggcaatgaaatagacagattgaatatattttgaagctgccacaattatctaaatatttagtaatatttaatctgtaagatattttggtaggtttccttgaggaagcacaatttcttctttttagagggaatgtcacctgtcagtttttataaaatatattgcatttgggaaatctaaagtcagaactatccataatttttaaggaaaatgtaaaatcatcaaatcagtagcaattttatattttgtttctgaaattgttttcccaccctcttcaactttatgataatttatcgggttttcagagaaaaaatacacaggagatacaaagaaaaaatatttttccaggtttatctttccaacatgcttttgttcatttaggatttgtttagctgttgattttgaaagtttattttttcatacatactagctgcatatagttgataaaagcctcaaatacagccaggcatggtggctcacacctacaatcccaacactttaggaggtcaaggagagaggacggtttgagcccaagagttcgagaccagcctaggcaatgtagtgaggccatgtctccactaaaaattaaaaaaaaaacttaaaaagattagctgggcatggtgatccacacctgtattcttagctactcaggaagctaaggcaagaggatcacttcagcccaggagttcaagcctgccatgagcttatgatcacaccactgcaacagagcaaggtcatgtctgaaaaactaatgatcataataataacccaaaaaaagaatatgaaatatctaaatctatatccacaattataaaaaaggaaagagattttatattcaaccactgaatatgtatatggaaggcaggatggcttcctctctacccaccaatagaaaagtaatgtacaatattagcaaaggtttgtgccttcccaattttcttatagcattctgtggcttgctacttgaaacatcaggggaattgttgtatttgaaagaaataaaatcataattgttaagatcaagcaatggctttacatgatgacgtgtatattttgttattcgatcctccttggcccgaaatgctgactatttaatacaagagatatttctaagcaatttgaagcatgattggcttcaacatttgctttgtacttttctcagaacaccaagtacataatagagttttgtgatttttttttttaaaaggggtgtgaatatgtagtattacaattgcaataatgacctacaatagtggtgattcagaagttgccttttagggctacgtaagactgagttccaaccataaaaatggcagcaaataaaccaatcatttaaaagtgtcttataaccatttttttcaaagtatcagtaatttacaaaattgcacagcacattagtcaagtcttgtattaactaaatttaaaattctaaataatcatacaaagtccatatcaatgctttgatacttgacattatggtacagtgggtttatcatttattacaatgagttattttcccaaattcttgcatctgtggtttcttctaagaaaataaatttattctatgcattttcaaatcaaatcatttgctataaatgataaattttttttctaaattgtcatagaaactatgcttatttcaacatataaaataatcaaattcatgctacttgaaggaaaagacaagtccatatttaaaagatagatttatctattaattaattacattttatttcaaatccaaaatataaagcaggttcaccctatagtttttgctttttattcttttaattggggaagcaaaagtgatgaaatttaaatatccaactcctgcttccttggatcttactgaggcggggagaggggtacatcaggttataaatattaaataactcaagtctgaaagaagggatctttaatgagcaggaacccactgtacaagctgaaggtgatagtaattattttataatgttatagtgtcatcttacagataagttttagacacgtttattttatgagaaatctagaatttcagtataatagttatttgaaattatcaggttgtcacaaaaaaaattattgtaaactcaaatttcttgtcttaccagattccagaaatagttgtatagacagccaataaaagatttgccttcataatatttgtgaaatacacagtaaaaatagcatgcgatgactaacttagagagcaataatgagggtatgggtggcagacttaaatgggagtaaaaacagattggagaataatttgtataatctgatcccattttggaatactaataaatgtccaaatatatatatatatataatttttttcaaatatcttcacagaaaacacttgaaatagttatctctgggtgataagactacaaatgattttattcttacatttttaaaatataatttctaatgtttcaattataaacatgcattactggataatttttaagaaaaataattgttttatgtgaccatgaagtaagcatcctttgttttccaatgtgaaaaatactgtcagtaataccttggtaagatgaatatggtttgtatttatgaggaggttatagttaatggagaatcaacaaagaaactctaatgccattcagtaaatgaaatgacaaatgaaatacagggttatatatgacagcatctatcagaagtatataatatggtccaagagttaagcaatggcaaaggaaaagaaataagaactataatatatttataagagtattggaaacatggtagttttcaataatcaattaatcaattaattacaattttattttataattaattgattaagtacatttaattagtcaattgattttacaaataattacattttattttaatgctaaaatataattaattaattaaatttaattacattttattttaattctaaaatataatgtatgctagtcttctgcttttattcttttaactttggagattgaaaaaagctaaggtatgattatgcccaatcttctgctccccagtctggggtatattacccttaaaatcagtgggtagactgttcacttttgcaatggactagtactacaattgtctttcgatagcctctttcagaaactgtgttgaaaaagcctaatagattaggcactctcaacaacaacaacatcaacaaaaacaaaagcactttatcatcattcagaaataaaatgaggctataattacaacactagcagcatttcacagtttactttgaaattatcctttgaggtggacatatttcatatatgttttacatggaacattttaagcatttcccttatgagtttcaggtggcattgatactggtttgttgtttttttcgtattctctttcaactatgcgcattgtttgggacaagacatgttgctgtggcatatgttactaggctacttaactgttaaattgggcatttttccttgacacaaaatcctatacattatctttgcccaatgtgtttagtttaaattcctctgcccactattctaaaaaaaagaaactataaacactaaagtagaaaactctggccaatttattttatctataccatatagatggatctacatggtatagatatctatggtatagatataataatctagagctatatagattaatctatatctatagttatagatatccataagtgttaacaaatacattgcctacattgtgtaacttatatttttgtatttttattataatggtaattgatatatcagcatattttagcatttatagctgcttagtaggaatgtgggctataattgccactttctacctttctattttcttaggaaactccaggattctaaaagtaaagccctatggaaataaatcaataacatttcaaatgaagaaccaaaatcgggaaatgcaaatcacaactctaacatcaacattaacttatgtaaacggctcatttgaaattatcacactttttttctgtttataaaacacagttatcttaaccttaagcattgtatcatccacatgttttcatctttgggcttctgaatatgtactagccggacaaaacaaataatagtctttataatacctacagatccctgtaagaaacaaatagcctactgggttaccagatgcgctatagtactacaaaattaaaggaacagactacaaaattaaaggaacagatgctctttgttaaccttttttctaacaaaaaataaataaagttttaaaaatagagattgggagcaaactcagaaacctcacatctctaaatattggaaagtttgaaaaacagggataactgaaaatgttgcttaaaaacatcaagctaaaaatgaagagaaaatctttgataacaaagaagagagacatcaagaaccaaaggatgaattttgagtaaataaatatattgaatgatgtaaacaaagaacagtggtaagagtaatctaagcaacctcaaaagttttttaagtaatggaaaaacattgtttagtattatataaaatttgtcaatgctgtgatttacaaaagaaaagaaaccgtttagtcaaggagaaaataacaagtttttaggaaatagaaatataaggatttcaaataaaaataaggacaaaaacaatgttttgcatgtagtgacccatggattgccttacacataagaatgagaaactcaggtagagaagaagaaaaatgagcccttcaaactcattcatactgaaccagaacaaccacaaacaaacaaaaccttaaatattaattgtcttcttaaaagggttaaaaaaaaacaaaataaatgctcatacacaattgggtaaatgtaaaactggcaaaattgagtaaggtcaatgaaatgtatcactgttgattttctgattgtgatattgtgctatagttatgccagatgttacagttgaatgatacacagtatgtttctatattttttctaacaactctttgtgaatctcaaagtaactcaaaatagaaagttaaaaaattaaggaaaataaaggttgaccttttcaatcatctcagctattgttccaattacaaagttaagtaaatcttacaaatttccttcaaatggtcttacaacatatctttgaggatattaagaccttaggagaatataatcggaaatcatttaaaatcagaaaactgagaaattgagaaataatcaaaagccattagattcacaaacacagtgagactattatgtgactgtggccagaaaagaacaattaaacatccccccacccccagcccccccacctcctcacgtgagctacttaactgggcaatgatatggctatagaaagaaaccatgaatttgaataccagaggttgccaaataaaacgaaaaggggtaagacctaaataattgtcttaaatattaacctaagcaaaaaacctatgtaaaatcaaattaaaatattaaaataacgttagaaaactccaaatacatgggaatactaaaaatctaatataaccaaatataaatctaagaccattccactcctaaaacaaaatacaggagaatactttcaaaaccttggagctgccagtttttctgttttaattattattatttttaatttaggacaagactgctatgatttgaatatctgtctcctccaaaactcaagttgaaatttaatccccaatgtggcagcagtaagaggtggggccttaagatgatgagtatgctcagcccccctgccatgtgattccctgtgccacttcagaactctgcagaaagccctcatctgcaagaagacccttaccagatgtggacctttgaccttggacttagcctccataactgtaaaaaataaatttcttttctttataaattacccagtttgaggtatcctgttacctgaaacaacagaaaatagattaatacaaagagagaaaaaaacagcattaaccgttaaaaataaaactaaactggatttcaccaaaatcagcttttcacttattaaaagacaccattaagaaaatggagaagcaagccactgacacagattggagacgaaaatgatatattgacagtacgcatattcagcaaaggactgctatcaagaacatacgaagaactgccaaaagtaaaaatatgaaaaattattgataaaaaaataagcaatgaaaaaatgctcaacatcctatatgaccaggaatatgcatattaaaaccataaggagatactattttacacttataagagtgagtaaaatcaaaaggactgataacactaaatgttgacatgtggaccagtcagaacccttatgtattgctcatgggagtgtaaaatcgtgcaaatattttggagaggagtttcttaaattaagcatatatttagccctcaccctggcaattcattactaacaataaaatttaagcaggagaaataaaaattcccttgaattccatgaaataatatgtgtaagtaggtacatagcattgttattcataatagtccataaaatgagaaaagtctaaacatcctttaatagaagaatggataaatattcttgaggcatgttaatacaattgaacagtgtaaacttaaaataaaattctaagccccctaactgatagaatggatctccctttcagccaatgatgttctaaagtaaatgtgaaaaactagttcaggccatcatgggaaggaggggtcagacatatctcattatgccctcctccctttggaattcaggcacaattgatcagtgttaacattaaaaaagagatcttaagactgaccaaacagactctttgtggcaatcagatacatcacaaaatgacatataccaggccctgtaagaaattgaagtattttaccctgaaatatatttcttcgatatatctttaaacagccctgtaaagctgcctcttgtggggaaaatcaacattctgtagagaattctcttccctttccaggtcttttcctgatccaggagagattagctaagtctggtacctttttaagtctgataacaaacatttgccctctattctatctgaagcctgctacctggaaacttcatatgcataataagaaatttggtctcccaaaccccttatcttaacccagacattcctttttttctattgattctaggtctttagataaattctttcaaccaattgccgaacagaaaatacttgaatccatctatgatctggaagccccggctttgagttgtcctgcctctcaggaccaaaccaatgtacatcttacatgtattgattgatgttttacatctccctaaaatgtataaaaccaagttatagtctgaccaccttgggtacatgttttcagagtctcctgaggctgagtcatgatcgtgtccttaaccttggcaaaataaacttgtaaattgattgagactcgctcccttgaagggaagaacccagtaaccacctgttgaccaaagagcccttgggtcctgaataaccagcagcaatacccaggtagtatgccatggaccttgggtgagactttgagacatgctggcttcaggtactagctcagtcacagtggattaaagcaccaagtgtgctctcgaggtccccaatacaagcctacactcttggacagcatttctggacctgccctggaccagaggggagcccactgccctaaagggtgagtcccagaccttgtagcatttaccacaagctgactaaagagcccttgggtcttaaatgaacattggcagtggcctggcagaactctccacaagctgatggtggtgatggacctggggagaggctcctctgcctatggaaagaggtagggaagaatgggaaggactttgtcttgtggtttgagtgccagcttagccacagtagaatagaacatcaggtagatttctaacgttttttacttcaatccctggcttccagacagcatctccatctgggcctgcgcagaactttccacccggaagggaaggacataaacatggctgcctttgccactggctgactgtagagccctaggtccttgagggaacataggcagtagccaggtagtagttacagtgggctttgagcaagacccagtgctgtgctgatttcaggtctagcctagggcagttccagtgatgtggccacagtggggccctgtgtcatcccacttccagctccaagtggctcagctcagagagaaacaacatttgagagaaagtaagaaaagagaaaaacaatctgcctggtaattcggagaattcttctggatcttatccaagacaacaaaggcggcacatttatgaggctgcaataaccctagtgtaactgggcttagggtccccgttaaagcagatacagcttaaatcacaatgtcgaagtcatttttaatatctgaaaagccttcccaagaaagatgggtacacacaaggcagactgtgaagactaaaacaaatacctaactcttaaatgcccagctacagatgaacatttacaagcattgagaccagccaagaaaacttcaccaaacacagtaaataagacaccagagaccaatcctggagaaagagagatatgtgaccttttgttacgggatctttggggtgttgcttttctggcctgaaacctctgcctggtggcgcctttgcccaagttttgcttgggcgcactgggctcattcttcccaccctgcctggcaggctgtgctcagctcacgctaccagcctagatcccatgcctgccaagggtgagtcagcaatagagcaatgaggggtgggtgagtgagtgtggggtccggccactgctcagtcagacatgccagctgctgcagtggggcagacagctacaggtgctggctctctgcaaggcatagttgaaccaggcacactgcaagcagcttccctggctggccctggaagcacattggtgcccagaagctcagagacacaaggaactacagaaacccaaagagggagtcacagccctgactctgggagctcccaggtctgggatccctgaggggccacagctcttcttctcttctcctgcaacatggcaaacaagggacatgtttcagccctgtttgtgttagctcttttagttctgccattcagtggctcccaagttcttgtcctgcaacaggaggaaatgaggtaggcagacaagtggagggtaagcaagatgaaggggaattttattgagcaatataacagctcacagaagtcccacagagggtagctcctttctgcaggcagggtatcctgatgagtgttcagctccgagcacagaagagaccaaggagtgggaagctcctctccaggcaggtcatgccatcattttgtacctctcagcaaagagaaggccctggagtgggttgctgttctctacagctgatagtcctgacttctctgcaagtttctgaagctctcagcaaagaggaggccataaagtgggcagctcctctcaggttctggtcatactgacatctcccactctcagcagagaaggtaactactctctgcagctggtcatcccattgtctgctcacctctggctgagactttggcttttatgggcctcaaatgggaggaagtgtgcactgatttggctcatgggcaaccattggtgggcccagaaaaggcaccacaagttcccactctagtctgtgggactggcagcccaggccccagctttcaggccctctatggcccaaaggtggggcctcaccagggatgtacccccttccacccagcaatctgtccacctcctgctgtcattcatggtgcctgggcttggccctgactttcctccaagatcagagtgggcaccacactgagagcagggaaaagccaggcagcaggagcaggcacttctgatcctgagagggcaggggggccttcctgggaccccaagagtgcagggatgtctaagtctgcagccatgatttgggcagccacaactgcgcccagggttggggggtggggctcctgctggctccatggagctggaggttggagtctgcagccacagtttggctggctgcagcagtaccctgggagctcctgccccatcttgcaagggccagggctcctgcttgtccccagctcccagctgctccatggagaatgcagccctggccatgcctccttgctgcagctggcatgatggcaacagcaggcaatctggagcagccactgccattactttcagaaaattaaaaatagctattttgagaaagttcaatgaatttcaagatgatagagaaggaatccagaattctatcagatgattttaacagagactgaaattaaaaaaaaaagcagaaattctagagttgaaaaaatgcaattgacatactgaacaatgcatcatagtctcctaatagcagaattgatcaagcagaagaattagtgagttttgggatgggagcagtggctcatgtctgcaatcccagcactttgggaggccaaggcaggtggatcacgaggtcaagagatcaagaccatcctggctaacacggtgaaaccccgtctctactaaaaaacacaaaaaattagccagatgtagtggtgggtgcctgtagtcccagttactcgggaggctgaagcaggagaatcacttgaacccgggaggaggttgcagtgagccaagactgtgccagtgcactccagcctggtgacacagcaagactccatctcaaaaaaaaaaaaaaaaaaaaaattactgagcttgaagataggctgtttgaaaatacacaaccagaggagataaatgaaaaaaatgtattaaaaattgaagcatacctattaggcctagaaagtagcctccaaaggccaaatctaagagttatcgagctaaaagaagaagtagagaatggaaggaactttgtcttgtggtttgagtgccagcttagccacagtaaaatagaacatgtggtagatttctaagggttttgactctaatccctggttcacagctagcattgctggacctgcctggggtttaggggaatttgctatcctgaagagaaggacacaaacatgactggcttcactactttctataggattagaaagttaattcaaaaggataatttcagagaacttccaaaatctacgatatcaatatttaagtacaatagggttatagaacaccatgcagctgcaactgaaagtggaatacctcaacacatttaataatcaaactcccaaaggttgaaaataaaaaaaggatcataaatgcagcaagagaaaagaaataaataacatataagagagctacattacatctggcagcaggcttttcagtggaaaccttatgggcagggcaaagtggcatgacatatttaaagtgttgaaggaaaaaatcttttaccctacaatagtattactggtgaaaatatcctcaagcctaaaggagaaataaatactttcacagacaaacaaaagctgaggaatttcatcaacaccagacccatcctgcaagaaattctacagggagttcttcaatctaaaaggaaaggacattaatgagcaataagaaatcatcttaagatacaaaactcaccagtaatagtaagcacacagaaaaacacagaatattataacactgtaatttgagggtataaactcctattttatgtattaggtaatagaaaaactcaatgatgaaccaatcaaaaataataaaggattacatcttttcaagacatagtacaagaatacataaaaacataaaaagttaaaaggcagtgagataaagtgtagcatttctattagtttttttctcatttgtttgtttatgccatcaactttaagttgtcattagtttaaaataatagattataagatagtatttgcatgcttcatagtaacctcaaatcaaaatatacaacagatacacaaaacataaaaagcaataaattcatcacaccactaatgaaaattgccttcactaaaaggaagacaggaaggaagaaaagaagaaagagaaaatcataaaaaaaaaacagaaaaaaaatagcaggagtaagtccttatttatcaataataacattacatgtaaatggattaaactctccaataaaaaagacatggagtagaagaatagattttaaaaaacccacaatgatctgttgcctataaaaaacatacttcccctataaagataaacacagacagaaataagaaataaaaaaagatacttcatgccaatggaaaccaaaaaaaagagtaagagttgctatacttatatgagacaaagtagacttcaagatgaaaactgtaagaagaaacaaagaaagtgattatataatgataaagaggtcaattcagcaagaggatatagcaattgtaagtttatatgtaccaaacactggagcactgagatataaattgcaaatattcttagccctaaagagagagacagacctcaatacaataatagctggacacttcaacacctcacttttagtattggacagatcttccaggcagaaaatcaacaaagaaaactggaggactcacattatctgatttcaaattatattaacactacaaagctatagtaaccaaaatagcaaggtgctggcattaaaacagacacatagaccaatggaacataatagagaacccagaaacaaatccataaaactatagtgaactcattttcaagaaagttgccaagaatatacactggggaaaagacagtctcttcaataaatggtgctgagaaaactgtatctctacatgcagaagaataaaactagacccctatctctcaccatatacaaaaatctaagactagaaactataaaactactaaaagaaaacatcggggaaactctccagaacatgagtgtgggcaaagatttcttgagtagtaccctacaagcacaagaaaccaaagcaaaaaagaacaaatgagatcagatcaagttaaaaaatcttctgcacagcaaagaaactatccacaaagtgaagagacaaccacagaatgcgataaaatatttgcaaactacccccctgagaaaggattaataaccagaatatataagtagctcaaacaactctataggaaaaaatctaatcatctgatcaaaaagtgggcaaaagatctgaataaacatttctcaaaagaagacatacaaatgtcaatggcaaacaggaatatgaaaaggtgctgaacatcatcaatcatcagagaactgcaaatcaaaactataatgagataacatctcaccccagttaaaatggcttttatctaaaagacaagcaataacaaatgctaatgaggatgtggagaaaagggaacttttgtacactgttggtggggatgtaaattagtacaaccaccatgaaaaatagtttggagtttcctcaaacctcaaaatactaaaaataaggcggagcttgcagtgagccgagatagcaccactgcactccagcttgggggacagagcgagactccatctcaaaacaaacaaagaaacaaacaaacaaaaactaaaaatagaactaacatacaatccagcaatcccactgcaaggtatatacccaaaggaatggaaatcaggatgttaaagtgttaacttcactttatagtaggcagcattatttatagtaggcaagatttggaagcaacttcagtgtccatcatcaaatgagtggataaagaaaatgtagtacatatacacaatggagtactattcagtcataaaaatgaataagatcctgtcatttgcaacaacatggatggaactgggaggtcattatgttaagtgaaatgagtcagaaatagaaagaaatgagtcaggaatagaaagataaacttcacatgttctcacttatttatgagagctaaaaattaaatcaattgaattcgtggagatagagggtagaagaatagttaccagaagctgggaagggtagttggggacttagggggaagtgaggatagttaatgggtacaaaaaatagaaagaatgagtgaataagacctagtatttgatagcatgacagagtaactataatcaataataatgtacttgtccattttaaaataactacaagagtacacaatttgtttatgacaccaaggataaatgcttgagaaggcagatatcccatttactatgatgtggttattaggcattacatgcctatatcaaagtatctcatgtgccctatatataatcacacctactatgtactctctacaattaaaaataataatttttttgaacggcaggagcaaaatttcttatagcatctggatacactgcagctatagtaaccttgttgttttatcattatcagtggtgtcttttgctacccaattcaatattctatagctactcaactactctttgtctatgcttctattgtttcttctcttgacatgacaaatgcttctggaattaatttatgcttcttcctagctttttctgtctaataatgtcaccgtactactgctttttctctatcttttagcttctgtacttctcaaatattactgctatttatatgtggccattttctagagggtaacatagaccatcaaaggatctgattgaattgactagttaccatatgaagtggagaatgttagtactgtatgttctatacctctcatattgccctgccttgtagaccattgattattccagatgattgactgaatgagaggtgattcctgctccaataatccctggctctgcttgcagaaccacatggaactaaacacagtgatccatgcaccaggaacctcttagaaggaaactgaaaatgtcatgcacatagaggctctccagaaagagtattgtagtaagcagccatcttgtgtggcctgccctaaaacattcatttattagtgtctcttccatggacatctcttttcttacactgatcagtctttgtattcatgaagcaataccaaatgattaagattatacctttgaaattaaaaaaaaaaatctgatacttgacaatgcctctcatattcttttactttctgatttttcttagacgtttggtgattttgctttgttaggatggaattttagtcattttatcagtttccaaaaattcccccttgaaaattagattggagttacatttttataagttattcatggctaaattggcatcaaaatattgaatatttctaccaaggcaattatagtagagtaaaatccactgagccaacctcttgtaatccagaaattccaatatttccacaagaccaaattgaaacataatagaaaatatcaatagtaatatggctcatataataatattacagctatataataaatgtttcatggtatttcattatatcaaaatatttttagaatataagaagtgctaattactctatttaacatgatagctcagaaattagaaatatcaacattgttcaaataataagataataactattaagtatttaatttgtgccagggttccaagagcttaacttgcattggagcatttaatcctcagtgggagatttatcatccccattttgcaaatgaggaaacacttacagagagtttaagcaacttgcctaacataatacaactactaagtggtggaaccaggatttaaactccaggcagtttgatctagagaccatactcttaaccattattaagatcagtctatgaaatatgaaaaccatcaatttaatctcacagagtcacttctttgagacatatgtcaagttttaatatatattaagggcaactttgaaaagaaggcagtgttgatgagagtaaaaaagacaatgatatatatattatttacattgcccaaatgtttctatgatggttaaacaaagtatcagatacagccttttagcttgacaacgtatgttttgttttctttttctttttttcttttagctgactcttgctcctctcaggaagagaacatattttcaagtttatttgcctaggcatcaaatgtttaaatattttagtcaatttctaattaaaataattacttttaatcaacattttcttatatttctttctcatttttaatttcagagccagacaattatgcatttctttagtcaacaactagctgctaattatttactatgtgtcaagtcttataatgctgaagtgaagaaaagagatttaaagtcatggatgtggtttcctttggaccttaaattctagcacaaaatatgataaacattgtaatcaatgctatcatgtacaggtatgtggtgttatgtgaatatatgggaatacctaattcgtaaactgggtttagaaaattcttgcagaagaaagtggcatccaaacaaagaaccaagaacgaataaaaattattatagataaagtgaagcgggtctagtggaatgacaaaattactgagtgtcaagaggtggaaggacttggtgaataatttgaaaaggaaccatcggaggatgatggccacatttctggctccagccatcaggtaaatattaacattcctttaaatctgcatttttgttttaaatcgttttcatatttattatctttatttaatctgagaacaactttttgggagatagagaggtatgcattttctagctgaaaatacaaactgtttacataatttgcctaaagtctcagttgaagagggtaagggagggtagttagtggattgcacacagaatgaagttgttttcaccataatttctactcatttagaacatactttttattctgctgtctaaagagcaacatgtcttctttcagacaagattattatctggattcaaatcaatgatacatttttccctttgtcatctgatgtagacatttctaactggctctcctgacaggagcaatccatcatcatagctggtggaacaattttgatcaactatgtcaacacccctatcattaccaccaagtgcaaatgcacattaatattctatgtaatggccaagcagatgcagaaagacaatacatctcttcaaaaggctcctgcaggcctcttctttgttttctcaccctccctctttttttcaagctttgatcatatgttctaattagatctcaaggttcattttactataccacaagcttctgtatggccactggaatccttctaactccatttacctacactatccaattataaacttagatggaagttaaacagcctgtgagaactcagaaggatatctcattgaaatggtagaagagttcactgctgtatctcagtagcaggcaggcacctcaaactggttaaactgtgtgcaccacagtactggtgctatgaaggtttctttcacaatagttttgcattttttaggtgttcaagatatgtctttgtggtgtatgcatgtgtgtttctgtgtgtgtgcacgttgtgtgtctgtgtgtttcttttgctttttggatgggtgggaagttaataagtgtcatgaattattaaaaaggaacttgaccttatagtgattccaacagaaaggaacaaaatctggagatatcagagagtcccttgtgcatattccagggactatgcgggcaactatctctgatggttgcaagaggaaaaaagaaggatttcagcatagatgacaaattatcactcaaatgatgatagtctgtggttataggccttgcctcccacttggattttggtattacccactaaaagtgctcatcttggaagaggatgtggagcctcagatgccttctctgctttccctatatggtccaggaaagcctattccctgagacttttctcaacaatcttacctcccaagacagacaacactactaaatacactccctgaaggatgaaggcatcttgttcgaggaaaattacctagtgaccatcaagcaggccatccagaggcaaaactccttatctgaggaatttagaagtaatttgacttccctattatcaaaagcatgcatctggtaccaagctcttttcccaaaactttgtaagtaactagaatttctatagatctctggaatgtatgcatattgaaactcattgtgcaacccttgctgacatcaaggcaccaaaatatctataaatgtaatcattcctcatgacctacatggctaatacggttcaaaatacccttaagctcccactttaaagtccataaaaacccctaaggaaaatccaccgcttcacactcagtcctcccttgctgaggtgcctcgctgtactcttctgcagcatgctttctatctaataaaaccttccttttcaaacctatactgttgtcaataaattcttcttgccaacctgagagtcaaccactttctgatgctggggctctgacaccctgccgggcatctttttgactcatcctgggactttactgggatttctcccttcttttttctctctgcttccctcaacagtctggtactttactcttagaaaccaatgatctttggctgaggccactcttcagtgggatcctgaagccctagagaaggagtgtctgtctgtctctgcccttggggccgagaaactggccagggttcttttccatttttgaattaccagtgaaccagcttaagtactctttggcaattgagggtttctggctgagtgcactccttggtattatccaaaggccaagacaaaaaagcaaatttactattgcccccttccaagggtggcaagtccaccttcactttaacactgtaaaccgtgccttggaaatgagcagcagcaaaatcaactctgcacagacacaatctgctggttgtggaccccattttgaattgaactttgtcacagacatcacatcgcaagtcacggacaagttctccttcacattaggtttgagctgatcactcaaacaagggcaggcctagactgctcatccaggcaagggtaggccctctatccatggtaggcacccccagatagagtgagcaaagggaaaagggaggtcaaaatccctcgcaggcacttcaggaatcttatagtgccgtatctaaacccaacatgggttcaactcattcttcagttctatcctatttgcccttgggttgcattcttataaagtggtcccattttgacccacaaactctttaaacttttatattcagagaccccatatgttcaggtcttttgggctttatctgatacgtaaaattacataaaaattgcataatcttccaaagaacttcttctctacccgattctgatgtcttagatgatccttccatttgcctctcacactctcctcatcctgctcccactttacctacaccctttccatctgcttcatcccccaatcatcaccctctccccataaacagatactttatcctcctcatatacttgcacaggagttacataagccactagtacagagtcctcagaaaacctccaaaatgttttccttgtccataaggtggcaaatgaagatttgggaaaaattcgaattcatgcacatttccaatattggatcttttgcaaattccatcccagttgcgttcatttagccaggagcactctaagttaattcaagaatttcaggccttaactatttcctttgttttaacgtggcaagatatatttgtggtattaactagttgatgttcccgcgaagaaaaatcttgcctttagtttgagcttaggtggatgaaactcatgctcgtaatcctaatgataatatagccagggaagaagctgtccctgacacagaacccaactggcaacaccaggccaccaatgttggcccagacagaggcaggggcaggtgagattatataataacttgtttgttggaaggaatgaaaaagaccgtaagaaaacctgttaatttttctaaattatgagaagtcagttaggagccatctgagaatcctgcccttttacaagctagactgctggacactatgcaaaaatatgcaaatttagacccccaaagccctgcaggccaatccattctggctgtacactttctaagtcaggcatccaaagacgtcagacaaaaactccaaaaattagaggaagacccacaaactccttttcctactttattaaatgcagcctttccagttttcaataattggaaggaaatatcaaaaataaaaaaggtgcttggggcgcggtggctcatgcctgtaatcccagcactttgggaggccgaggcgggtggataacctgagtttgggagttcgagaccagcctggccaacatggagaaaccccgtctctactaaaaaatacaaaaattagccggtcatggtggcacatgcctgtaatcccagctactcaggaggctgaggcaggagaattgcttgaacccgggaggcagaggttgtagtgagctgaaattgtgccatagcattccagcctgggcaacaagagtgagacattgtctcaaaaaaaaaaagcgtaaattggaggagaaaaaatgccgtcgccaactaattacatggcgacagcactggcacattctttttcattaactaataaacccagggctcatccctatgctactaacagaatggggacctgttattgctgcagaaatccaggacactagagtagaaaaggttcctaacctccaggttacaagccaaccctggaagcctgtcctcactagaaataagagggtcatcggaagagcgagtgaccctctctccctcatgaggtggggcacctcttccttctgggctgtcacagctacagccttatcaatctacctaacaagggagtcctgcagaatggggacgagggcaatgccaaggacaagctcttctaactctattcctggattataatcaagcctctgaaattcatcctctagatgactgatggggccttgaggccatccagcccctatcttttccatctctatggataagtctagagtaaatctgattgtggctaaacaagagataatgttcttcatagatacaggggccagttattcatctttaaacatttactatggcccaatgtgccagtcctccatttttctcacaggtattgatggaaaaccccaaggaggctgttttacactgccactcccttgtaaaatggaaggctattcctttcctcattccttttagtcgtgccaagctgccttgttccattattaggccatgacttaacacaaaattacatgctaatttacaacgaagccctcaccttccagctgtattaactcacacttcactaaaagagcaactgcagtctacagaaactcaaactctaaaacaagtgccatttgaagttggaatacttctcttcctggtcaatcaatatcagctgctcttgtattcattcagcttcagattcccaataagttcttcagactccctgatgcctcttgaaaccagaagcatgaaaagagttacagcccctaataacaaaatttttaacccatggattattgcacccatgcaactgaccttgcaactctcattttagctgtaaaggaatcagatggctcctatcagctagcacaaaccttagaattattaatgaagctgttattctgattcatcctattgtcccaaacacttataccctttttggacagactctctccaccacagcttagtttactgtacttgatcttaaggatgactttttctgcattcctgtacaatcagatagccaatttttgtttgcttttgaatggcaaataacttaacttgaacaattctgccccagggaatggcaaaacacttaacttgaacaattctgccccagggaatcagagatagcctccaccttttcggacaggccctagctagaaacctgtctaccctgcagcttctccaagacagcaatctactcccttatgtggatgaccctactaatctgtagtcctaacaaggctgttttagacaaaaatacagtgttagtatcaaacaaacttgctgactgtggatacaaagtatctccttctaaggtacaaatattcacagaaagcgttcacttttggggccttattttaacccttggtacaaagagcctctctagcgctcctgaagatcttatcttaaacatgacaactccaggaactaaacaacagcttctgtcctttttgggtatggctgtgttttacagaatatgtattccttcctttggattaaaaggaaaacctttatatgaagccctccagggaagtgaggaacaacctctatcgtggactaataatgtgaagcatgctctaaacactttaaaaacaggctgtaatctcagtcccagccttagccctacctgatctgactaagcctttctttttttacgtacacaaatgaagggggatagttttgagagtgagcctaagatctatggccctctaagcaccccacagcatatttttcaaaagctttagacctagtatcctaggaatccctccccacctcccagcttaagagccttagcagtggtagccctcttagtctaagaaaccttaaaaatatattaaccctcctgggatcttatggctttgcttcactgctaattaccccctagctaaaaaaggagtctgtgcgttcatcaataaaacatgttccacttctcttttctgtacaggaatgcggaaaaagagaagtgaaaactaatgtccaaaaaaattttcaaacaagccacatggctatacacactttcctaaagtaaccactactgggccaaaacctctactgattggtttctaaaaatcacatggcttctcctattacttggacctttattccttgttactcttcttttaatctttggtctctgcctttttaatgctctcattaagtttatatcatccaggttacgattccacctacagatgactatgcaatcccaatatcggcctgcaacagcaacttccatttacatggggcctcttaatggaatcgtttcttctccccatgaacaagtttttcatgatcctcattcccttcatgacaacagagagaaaaggaaaaatacaacttatccactcactatcccctttcagcaggaagtaaccagacagacctggggcccctcttcactgtgctattttctgtttcttgagactgtaataggcagcaggtagacatgagcatgggggaacacaaagggtcaaagatttgaccaagatattttcaggaagaaaataaggagaggaaagatcacctggagactatcaagcaggccatccagaggcaaaacttcttatctgaggaatttagaagtaattcaacctccctattatcaaaagtacataacttcaccctgcactcttcaactactcagtgattcccacacctcagtctacttcaaaccctagatacctagctccagattctttagagaagaggatttgaggtttcctctcatctcctcctgtggctatcttaagattattaaacactttctctgctgcaatctccagtgcctcactatattgactattacataactgactgcaaagcatgtctgtatttgtgtaaaatattatcagaattgtgggaaaatagacaagttctatgatagagtctatttctaacccatgttgactccaagtctctatattgggcccacctgcaaaatcagagtgtaaacgaaagagttgagctgcaattagaaaccttaatgaaaagcaacttttcaggctttgcttttttccttggctattgttggggcttaggaactgataccccaaaatacatgcttcgatatgcagaactgaagaaacctcaaggtctctctgacctctcacttccccattgtctctcccaaagcacaggatgagttgttgcctgaagtccctttatctgcctaaagtactgatccaccaggagaacaactgtttattcttctccttactattatctcattatctattacagaaaagaaggccaaaaatgtaaccacacttgaatagaccctttcacaagataatgtctgtctctcaggctcattcaaattccatggagaaatatcttaaagttaatcatctctgccctccaatccattcattctccctagttgtcatttattgcctgtcaacagaattcctcttttcctccctcctataacctgttttgccaagacctaagttcccattctttctgtacccacaaaagatgatatataagcttctaaaccctatttgggggataggtaatcactccgtgattctcactgtgtacacattaataaatctgtatgccctttctccaattaatttgccatttgtcagttgatttttcagtaaaccttcagaggacaaaagggaagttttccctttggtccctacactattaattcctatgtcttacctactcaaatttcttcaagctttaaacagagtcaaagcaggaaaaagcagaacaggtaaatgacaggaagtttctacttacagaacacttgtaaaagtgtatgcaatgtcctataaaccatcatttttttcttaatcgtatctttataattggatttaattatattttcaaaattttaaggatagctcatatatattgaaattaatctctcacacttccatattcagaaactctagatctgacatagagatcatttcaccttcctgattaatataggcagtacgtggtgcacaatgaagacagactttgcggccaagacaaaagtacctgagtcttcaccctgttggaacagtgtatatcagagtgactttgggagagtaattttaagttatttgttttctttcctatccataaaatggttttccaagtcccttcctcaagggttgctttaaggtaaaatgagagaatgtatgtgaagttcctgtcaggtagtgatctctcaacaaaacttccttccctcaggctagatttcattattagcagctcaagggtataacttttacctttacttgatcttctcagcttctgttgggaattttattttaaactgaagggcattttctctttgcttcacttcttaagtaaattcagtacatttaaattatttcccttgatcttcctacctcatcttcttttacagagaaactaatttgaccttccctccaagctacttgtcacttgtctctttttctagtccttatgttatattcctattcttagccaatgatttcaaatgcaattctttaagtaatatttttcaaattgcctttaattaataaaatatgttgtattaaacacattgtattacaattgtatttaattaatataacgtgttttgcttgtctttctgttagtatgaacttatggttgaaggcattctcaggggttaacaagaattctggacagaaatatggctataagtaagtattaatcaggctgcactttgacccacttccttgtaactgaaagtcactagatcctgaatatttgtatccccattcccactgttcttatagatagaatctctgacatcagaatcataaggcttttctttaagaattgcttaaagatgttcttcggatccccaattccagtgaaacagctgatgacaaccattttgaagacccccacagaggaacagaatcaacatgagatggtttcttcctctccccatcctatgacttccccctgtactcttccaccaattaacaatctccacactttgacccactccaaaacccttaaaaacccagccccaaactacctggggagatggatttgaggttccttcccatcttctccttcgatggcccaaccattaaacctctttctctgctgtaacctcgtgtctcagcatattgactttttgcacatattgggcaaaaaaaacctattatggttacttgattgtgataacatcaaaagtacactgaatttggagtcaggagacctgaattctaatcctagctttgacattaattagctacgtggatataggtaactcacttcacttctgaaggcctcaaagccctccaaggattttgagataggcaatttttccctcaacttagcattatcatttcatggttttatgatgcaacttttacagcatcacaatgttccattaataaaattatattggtttttccatatttttaaatctaaaccttcaaataactatttgttttcatttttttctggtgtgttgcctttgtctttcccctttattctttcatgttttgcttacctaaggaaaagcttacaagaaggagctgtgtcaacagtagttggtatggatccacactaacttttatttggggttttaactaagagaacttaatgtatgacttattgtaaaattataaaaatcaaatcaagttttataacaacagccatagaatggtctttttttttgcaaaaccaaagatacatatacataaatgaatatgatttatgtagaaaatgatattaaaggatacatacaaaattattgagaagcaattagccctggaagagaaaaatctgagctagaggggtagtgaggctaaaatttgtactataaactgtcctatattatttaatttggtataacaagagtgtattattcttataataggaatattactttaaacatttttattaactgatatttattttatgtatataaggttttttttcaatgtggctttgtaatctaccacatactggacttaaagttataaacaggagagatgactgaagtggaggaaggttcattagcctcacacaggaaatgccttgaagtagaccgtgggtgaatctgtttaagctgtgacccaagcagaaatactttcttctcaaagtgatttgaaactattattctcattgaatctatgataagaaaactaattatgataacagacatacggttggaagaggaaacacaggtagagctgtctttacattagagaaagaactgagagagctaggcaaaagccatcattgggggtaacagaacacagcagggggaagcattctgcagagcatattggaacaaagcaagtctctccaaaaaaatctaaagaaaatattttcagaaagtgcacaaggcaaagactaatggctccctgcagatattcataaggatataagaaagaagaggctttccaagaaaatataacatatttcaacaacaacaaaagactgggctagatttgagacacactaagagtcattaacaactagaagttcttatcataacactatctatactgtttacaattgtgtcactttatgcttatataaagtataaagagaccactttacagaatatgggttcagtcattgtcagggtatcagagtatcttttgttttcctttattatattgtaaggacaacataaagtaacccaaagagaaaggagagaacagcttaacctctctaaacactgcacattttggaagtctaatcccctctccctgtcccaaatcctctcattatatctaagcccagtggaagtatgctggtcctcacaggctggcagttttctcaacctgcaattagagtgtttagctctttttgccagctacagctttagtcatcaattccaggaaaccctgacaccaattcactgaatatctaaacatacattacctacttgatcatctatattcccagatgcaatgaacatattttcttgttatctttttaagtcttctaagttatattgtgcacaatttaaatacacttgccttagtttctgagacagccgtttctcggttttctatctttcccagttatttcttgccaatctcctttgttagctcctcctcttcaacatgaattctaaatgtgtttgcttctatatcatattttctgctctaatataccctgtctatatgttattacatcctaagaaaaaaacaattcctatcataggtcaaacttatgctctaaattccaaaatcatatacccaatggctgatataatataactatgaaatgagcaaattcaatatctaaaggccactaaattggaatgagacttctacccgaaacagattcctccaagtcttccttaaatccataagttactttcacacacacacaatgccccaaaacaagaaaccccaaagccacatttgtttcccaatttccttcaatcccacattcattcccagcaatttcagtcaattttacctctaaaatatgttttgaatttgtttacctcttctgcaattctctagtgcattactaatataaatacaatgcaagcaacatatgtaatttttaacttgctagtagtcatattaaaaataatttgtgtaagtcaaagtgataatattttggatatatttggttaaaatatattattgacattaatttgacatgtaaaatataaatatatttgagatattttatatcatttttccttgataaatgttcaaaatttgttgtgtgtcgtacatttacatggcacatctcatttcacatagccgaagttcaagtgcttgataagtcacatgtaactactatatcggacagtgcagctctagtatatggcaacattacctgttgcctggagaaatacaacagactcatatctggtatcctcacatctattcttgcccatcctccatttccaataacatacttcctatggattggtgagaactgaaaacgacataatcctctgtcccacagggacaggaactgggcagaccttcctgctcctgtgttaataatactaagagcaagcaaaacaatacttagctgctttctccaggaaatacctgctcctagaagagaaaactgaaacagttaaactgaccaattatcaagactagtaagctcattaagatttactaccaaaccttcaattcattttgtccactcatccaaatctacttatcaccacaatccaaccagttctctctcttgcaagatacactttaaaatcactcagcacaggctttaaaatgcttctctaattttcccaccttgagttatccacatattggccaacaaacctattatggttacttggttgtgataacaccaaaagtacactgaatttggagtcaggagacctgaattctaatcccagctttgacattaattagctacatggatgtaggtaactcacttcaaggtggtattctcctttatcacactaagtcttagtggtagtactgcttgattaacatacttttggaaagtcaacattcaacaaaatcaagaggaaacttcttaaaatgcaaattggatcatgcccctcccctgttaaagctattacaatagttatcaatgctttggaacaaaattcaaacagcctagcatgtatgaaaatgtcaaaataacttattgtctgtcttcctttctaaactcttaccactctactcctccattcagtaacttttagaaacagtgcctccttcctgttctttaggtataacaagcaattccaaattttagcatctttgcaattactcttctctgcctgaaacattccttcagtgttttaaaattgctgccacactcttatccttactaactaactaaaattcgatctcctcagagtgtaaaagactgctttgactgaaagtgatttatctcttaggccaattttcttttcatcatatcatcctgcttccttcctatcactcatcataactactttatccatatctttctttactccctgtctctttctacaaaaatgtaaactccatgaaaatggaaatcttatctgtcttatctatctccatatggctaagtgttcgatagatttattggcccgtagtacgtactcaataaaacaacaaaataagtgaataaaaagacaataaatggataaaagaaaaagaaagaaaggaaggagggagagagggagggagggaggaaaagaagggaaaagagagagaggaagggggggagagaaagagagggaggaaggaaggaaggaaggaaagaaggaaggaaggaaagaaggaaggaaggaaagaaggaaggaaggaaggggctctgaaaacgtgccataagtaaggcaagtgtgataatcccctcccttgtatattagaacaccatgtaacaatgcatcaaagggagaaacccaggactccagagctactataacacgtagctgagaccaggatcaaggtcttctgatttctaatcctgtgctcaccacagcctaacacactgtctttcagccttctctgattgatgtggttcttttgaagctaaatgtaaggcttcagatttaataaataaggcatttgaaggagaaaattattctctatgcattaattggtgagttcatatgtttttgcatttacatctcctacttgcattttgattagcaattacttctgtcaatttaacaccaacattttccgtaatcagagacatgttataccttggaacagactcaatgagtccctgaaactggtgagacagcacttcaatcccttcaccttggctgctctagtagtgaacatgcctgactaccagtctgatttcctaaatctcctctgagattttagatggttagaaatacttttgacatatgcttggcttcagctcattgcaaatacaaaaacgcttgttccaaatacaagcctcatttttttctattattattgttagtatcattattagtattacctgtatcactcttctgaagtcacttttaaagagattccatatcctgagaaagagaaatccctgaaaattacatttgatcagtaaatttagtgaggcataaatggtataattagtatttgattgaaatttctatcctcctttagtagtaaatatattgtaagagattgtttgtcatctattcgataatttcttatcccttctctcttgcttaaagaatctcaatttttaaatattaggcggcttaaggcaggtgactgaggaactgaaagggatgactatgctgccatcccaaccatacaggatgaattttgaacactctatactaagcctagtaattccgttcctctcgccatttagcaaggtcatgtttctttgacatgcatgaagactcttaaaaattttaactctgcttatgtttctactcctcctccacctgtacactggcgtccaggtacccttcacctaattgtagttctttctcctgtcttgacctccgtatccttgcaaatgtgctgagccataattccaactatccaactcttgactcattcatcaaagcccaactggaatgtcaacaaatggctacatctttgcataattttctccatggcagaatttaaagtctctgtattttaaaacatgattccatgtgcttccattatattacttatcacaatgtattcctgtcatttgcttatgtacctctttattctatgagaatgccaattacttgatagcaaagatcatgactcaaccatgtttgcgttcttaaaacctagcacagtgattaaaagatagaaaatactcagccatttttcaagtgattgactgtatcctgtacaggatagaaaattacttctcaatatgatgtcttcttcattgtatgtttcccatgttcatgataatctcacattccacataccctcctcaagacttttttctgttttatactttctagctattattatttcaaagggttttatttagaagagggtatcaaaaagattatgtatagcttaatatcttaaattggcagcagctatatttataaaagacattaaagtatggcaatttaatattctattcactaaaatatttgactaattatacctctaaatctttacctgtcattaaacaaatgattatctgaagtgatttaagactctttggattggtttattttactaattaataagcaaaagactgtttaaattgacttatggtcacataattgttaaaaaataactgttattgttgaaaatgatgatgatgatgatgataataatgatgatgatgactatgataataagagcacgatgacagaagtgggtcactttgtattttctaaagatggatacaatattattcctcatctcacatgctccttttgacctttacactctttccattgaaagatggggttcgtgtctcctctcctttgaatccgggaggcttttaacttgcttgtaaccaagactatgacagaagtgacactctatgatttccaaagttaggatacaaaaggcaatatggcgtgtgctttgttaactgtaacttattcttggatccctgaaatgtcacacaaaaagcccgactatccagtggctaccatgctgtgagaaagccaagccccataagaggctaaatgtcaccttcctcagtcttctactccttagtccagatgtcagacatgcacaagaaggagtctgtaccctttctaaattcctgacccatagaatgtgagagcatgatacattgatggttgttttataccattatgtgtggagtaatttgttatgcagcaataataactggaacaaagagtgtgacaaggaatgtttatgtgttcatcagtcctatttcttcttaggcacagaggaagagggcattcaccagctcctttgcagtttattcaggtccttttgatggattttgtccaatgagatgtagaggaaagtacattgcattgaggtctggccaccaaacttcctattcaattatctactctctctcccatttctgcagtgacatggaggccagcttatacagatggcaaaatcacaagattgaaagatactgaatcattgagtcactaccttgtagagacctattcaggaaaacaggctggcatcagaccaacgtaaggttgataaataaaccatcattgcaataagctactgagatctgggggttgtattacagcaagtagtatttgttattctaactactacaaaaactaatactcactaagcagttacaatgccctagaaattttactaaatggcttgcatacattaacccttttaaactctgatgaaccatccttacgtaggtatctttgttatccccattttacaaatgcaaatctgaagttaaaagactacatgacttacatagggttacaaagatattccaaagaatgggaatttccttgaagacggaggcaaacctaaaataagtttgtactctaagagttaaataagcaaaatccactggaagagattagctatttgtaaatgcattgtcaatgtgagtttttggtaaatgggagtcgtgaatttaatcccaaaccattaattttagagacaaaagaagatatataaaaatccctggttttattttaattttatattttttagtaaacagaccactatggaattgttaaaatgtattttacagccatttttaaggttacaaataatttttgttatgggatctttctatattttatgactttaattaaatttctgatttctgttccaaacattgcaatataagacagtataaaacacactttaatcattaaatttatagataattttgtgactttttagagcttataacaccaagggactgataatagaggataatgtgcataaaatacactccggcacattccacaaactctatccttaggatctttttttcccataacccagccactaatacatacactaagaaagtctcatccgggctgttctacaattgccatcatctttaaagagtaatcttgtcacctgaactaggtgaaatgaagaacttttaaaacaaccacacggatccgactttgcagaagcttctacgaagacaaatagcatcaaacagacatgtactgtgcattcataattacattagtggccacaaaatacaatgcttagtacacatccttggaactcttaaaaccatcttaaataagagatcaagcaaatttaattctttgtgaaaatatatctcaaggtagtttctactgtccttaatttttgtagtataaaatttaacaaagtaacatcgcatgttcttgtccttaattccttggggtctaatgattacattttgaacaaatgtccaatttggaaaccaaatcaaccactttatttaatgcagaacactataacattttttgggggggggggcagggtctcactttgtcacccaggctgcagtgcagtggcagaaactgtagcctcgatcccccagggtcaagccatcctcctgcctcagccccacaagtagatgggagtataggcatgcaccaccatgcccggataatttttctgttttttacagagacgggggtttcaccatgttgcccaggcttgtctcaaactcctgagctcaaccattccacctgcctcagccttccaaagtgctgggattatagatataagccactgtacccagacagactttgttttaaaggtctgaatcttccttatttcatatagcctacattcttttgtgggaacaaagaaaacagataaataaatgaataaatatgtaatacgtcaatcatcatgacaaacgctacgcaagcataaaattgagcaagaagatgaagagtagctgcggtgggagatgctatttttagatgtggctctatataggatctgtgtagggtgttggataaggcaaggatgaagctgacctgaagaggcctcctgtgcagagtcttggaagagagcatcacagttagagagcacagtaagtggacagatgccagaagcatgggcctgtctgaggaattaggggaacagccagcaggccaatgtgtctgaatctcagggagcagggaagagtagtagtaggataagtgctctttaacaaattgcccaaaaagtgattcttgagatttatgtgtttataactgttccatcaacaaagggaagtctatggagtctaaaggctcccatggtataaaaacattgagctgttgtattctcctatggtaagagaaaatgttcttcaggcattcaggtgcctgaagaccctgaatctcttgctgtgactttccctaccagtataggacctcaagtgcctctattcacttagagaacttttgctatcagactccagaatatttttcccgttgaaactccattatttagtttacagatactggagttataaaattcccagtctccctccattagctacatcaaagtctgttttctaaaattcatcattttataagttgtattcccatattattttctccagaaggctgattcaactctccaaaagttgtttttgaaatgtagatatgcagagaaactttatgtttgaagaggttagcattccttaagagtttttaggataaaaacaagtttttgtaccaaaataataaaacttactagattgaatacttaatataaatctaacttatttaatacttatacaagtttataatagtatgacatttaataattcacttaacaaaaagcaaaccaaaaactctaagattctgcaagtaaccgtcttccccatattacccttccattcacaatgttagccatttcccctgaacacctggagatgttttcaaagggagatgcttggctccttatattcagctactttgagtcaaaagctctgagctgcacttgtgtagagctctctgagtgcaggactagactgcatcaaagtcctattggaccatggactcccctgccagtccagtggtgttgaccctttggtgaaagagcacttcccagaacgacttcaagctgaacatctttctctcagaatgagcaactgagatcactaactagcgcggcttttgtagcttaacacgtttcctgaatatctttttcttactctagtcacctctgctcccttagtcaaaagtttcttcaaatgggatacacaagaggagggccattaaatgtgctgagagcataagacttcttgctgaccagtgccagcaggcgttccaaggtttccctaccttatactctgttttcagaagaagcagcaagagtactgttacagacttctttccactaaggtttgatttaaatttgcatataaaactaaggttactttgctattggccttttacgaagttcccttaggaatccccctggtaggtggtttctttacaaactggtcctgacactagaaaagagtcatattacttccagaagggacaaagtgttttaactggcattccatgagtcctgtgaggttgaagagcagagtaacttagatgaacttaggaaatctgcctaacactgaaaaatgaaaagctatgaagtctttgtacattaaataaattggaaatggtgcctgaataaattctccacagtcaacaaagtatcagaaaagcatgaaggggagaagcgcacatttgatagccgttaggactatggagagaaagtgttccctggggttagaaaaactggcttgacagggaactatgatcattagtgccaagcaccgggaactgtcgccctgtgggtggagacaatgcaccacagggcctcaagcagtaccatcaggacccagaaactagtgagcttaccaatttattctccaaattgggcacttaaaaggcagtataatccagtactgtcctgtgcaagccaagccatacatatatatactcatcctgtcactatattttaaactcacttagcatatacttattttatgtaaactcatttgtaatcccaataatcttcagacacaattaatactacactgcccccaacccccttatccacaggggttatgttctaatacctccagtgaatgccagaaacctcggatagtaatgaatctgattgccatcagtccgaacacatttccatttctgtcttccacccacaaatttaatgccttttccatcttaactaagcacttatcataccctgtggctgtgacttttgagtctgaagagtgatagcaaaactaataccagtttctttttccttctttacaaccctacagatagaagattcattcttactgtagatcttagtaaccttggcatatgattttttttctttccttaataagtcaagaactttcaccttttcacttaaaggaagcactttacagcttctttggcatatcaggattgcctgcatcactacgtgcactttggggtcatcatgaagtaaaataagggttacttgaacacaagaactgcaatactatatgactaatgggaggggagcacagacaacatggatctgatggacaaagggatgatttacatcccaggcaggacagaatggaacagcatgaggtttcatcacactactcagaagagtgcacgatttaaaacttataaattgtttaactctggaatttcttatttaatattatcagacagtggttgaccacagataagtgaaaccatgaaaatcaaaaccatgaataaggggatgtctacttctctataacatgaaacaacaacaacaaaatgacatgacagaatacagctgatgaatttcaacattctataaaccttaaaaattgagtttcaaaacataccataatcaaaggcgaggctaaaatttaattttacgtgttgaacaaataatgcaaaaatatcaaaaggaatgtaaaaactcccttgcaacctttggagaagggtgggttctggtaattaaacaactttatttgaaaagcatcagggcatgaatataaaatttggaaattaaaacaaaaaaacaagagtttgatccagaaaagaaagggtgagaaaaagagtacctggatgaatggcaagccatgagggtgaaaagaagagtagaggagggtggagagtacagcctgggaccctagactgtgaatagaaagggttagcagaagtcattctaggtggtcgtgtagctccaggaacctcgaagaaaagacaattctaatattcaaatatttgggatgattagatgtataaaggaaaactaataaaaaggtgagtggattcttggaaaagccaggcaggattttcgtaaaggctaaaacaaaatctctaaggcaaggttagtaaactttttctgtaaagggtcaggtagtaaatattttaagctttgtgagccattatagtctcctcataactcctcaaccttgccattgtagcacagagtcatagatataaaccaatggctgagtcacgtttcaatatgatttatggacagtaaaattagaattttataccattttcatgagtcacaatatcatattcttcttttgaattttttcaaccatttaaaaacattaaaaccattcttaggccacaggccatacaaaacatatagtggatcaaacgtgacccaaaggccaaaatatgccacctgctgatctaaaatagtaaataatgattcacatatatgagaaataaaaaataaaagagaacctccatacattagaaatgtttggcaaacagtcacttataaagtagaaaggtattattaattttataatatttgagatatcagcatttttaatagtccatgcaagtttttctaattagccctaatttgtaatttggtatgattttatctatttaaaattagctattttctgaggtgttggctatggagttgattattttttaatgaactttattaatatctaatttacatgcaactttaaatgcagtttgatgagttttggcaaacgtatcctccaatgtaaccacctcaaatgatcggttttcataaaagagtctgctgagaatttaagacagtgataaatcaatctgtaagtcaatctgggaataactgacatcttaatattgaatctccaacttcaggaatatgatcaatcccttcagatatttaggtgtttttaatttttttaatgttgtattataattttcagagtatagatattatatttgttttgttaaaattattaccgcttattttataattttggatgctgtgatatagtctactttataaataatattttctaattgttagttgctactacattgaaatacatattttgagtttcattgtatcattgtatttctctattgtccatgtcttatttaatttgcattttttttccttctttttggagatggaattttgctctgtcacccagtctggagtgcaatggcatgatctcagctcactgcaacctctgcctcccaggttcaagcaattctcctgcctcaacctcctgagaaactgggactacaggcacgcaccatcatgcccagctaattttttgtattttagtagagatgaggcttcatcatgttggccaggctgttcttgaactcctgagctcaggcaatccgcccaccttggcctcccaaacaggcgtgagccactgaacttggccctaatttgcatttgaagcatggacagtctcatttttttcatcatcttgggaaacactgttcagtcctttacttttacatacaatgatacttaaaagtagaaattcagtagtgttcttccattttcccctgcagggaagaaactgatgacatcatgtaaagtaaaaatataaatggtaacatgtacagctgagacttgaactcaggtcttctgattttacacaatattctttcattattggaccatttccaaacttaattccagagaattgtaattggataagataacattctacattggttagtgactatctgaaactgtaaaagtctttccctttagcagtttgagtatgaaacttcaaatagccagaagctcagcctggaagacacataaagaaaagatgtctacaaggccaccaagaaaaaaaaaatgttaaggaagaaaatgacagaaatttatagaagttgtgacactgcaggtaatctcaattgagaaagttatatttaattccaggaaaagccataaatctgttcattcctgtaggtgaaatagaatcagacccaaagattggattgttatataagctgatattttatattggactgtgtcccaattctagaagccatgtaaatgattcatgtaaaaacaattaatgtaaactgggccatgtaaatttatcttatttttctttgtttcctcaaaaattaaccttcatcaagtcagatatgcaaaatatgttcctattccctgatatatagagttagaaaactgacacagaaaatgcaaacttgagttatggacctgaaaatctacacacttggctttggaaagtatctctatatttttgaagcgcctttgataaggcacatatgaaaattcacaaacaaaacatgtgaaatctacattctgaatgcccgttataggaaaaattttacctgaatcttgtttctttttgtgaggatacttcactgcgggccacttatactaccctctctctcaattcaattatgtactcttttaaaatttcctccatttgtggttaaatgtcttttaccaaaaaaagatgaacattgagagttcagttctcatttatgttttaaggggtctataaaaattatgtgcagaattataatactaccttaaattaatataggttcaaaagcataatttgcatttaacagtctatcatttagatacctgatgttaataagcataagtatcctcttatttaaacattgccttataaaagaagagatttcttgatttaggactttgcccttcatgttgctctacaagcatgcttatgtagttaatattcgtcaagatatgcaaaaatattaattagcttcagtaggtctagtaagtactaactctatgtggtaataatagtagtagtagctatcttcttattatagcctattgtttattaagcatttcatttctattaactcatgtaagcataataatcttttgaagtaggtttaataccatgtctatcttacaaaggatgaaattgaggctaagtaagatttgtttcttgctttagttttaaccattatattatgcactcttaatagttgtataatttacacatgtatattaaatatcaaacagatcaaaatatttaatactgcttattctctgagtgtgctaagtatgatagtctataacctcacttgtctacacactgagtccagtggaaatagcaatactaaatgtcacagtatttagtgacattctaaatatcttagaattttaaacaactgctagcataattattgatcaaaacaaatagtaaagacataatcatatttttataaaaccctataaaatgccaagttctgatcttgagttagtattttattgtttcaaaggcactgaagagtattcataaaaatttagacataaaatgggattctgatacacttacaaatatcctcaatagcatagcctatccctccctgagcttgtataattacacatttattgctttaatgttgacactttttagataccttgaagaaaggatcaaatactttgcagttctaaggccagaatattggccaacattaaatttgaccttgtaaaaagaagattataccagatcaagtttattctcttctgtgaaaaagggacagtctttaagaaaaaaacggatagattttcatttacttgcacctaagtgagaatttatttttatgctataacccagttagcgattaagtccataagtttatggatcattttccaaggaatccctgtagaagtcgtgtagaggttcccctagaggctgcttagggaactgggggtatagagatagagacgatgaccctctgggtattcctccctggtttcaagtacagcagctctgattttatttgctttatctttttgaccataaagtgtacttaaagaaataatatatctgccttaaaactcagaaaacactctttcaaaccatgtacttagagacatgttctcagttgcatggaacatcagatactaaaggttcttaacactaatgctcttaactgaatctctctagcagtgattacagtcagataaaggaccaatataatttaatgttttattagttatttagttgaagaagctaagactctacatttcatgtttctgattgatactaacttgataaattcaacaaccaaaccagaaaacaatctgataaatcatatgaagaatcatatacagtgtaataggattaggacttaaaaacaagaacagaacaaatcaaaataaaggatgcatacataggcatacaagataaaaaaaaggaaaaggaagtcaacctctatccaataaatataatgtttaaatggaaaaaaatataggctaatagcagttggctatattggtagaaataacataagaacaagtcttctaatttatttgacattggacaggcactaatttgaatgtattcttgatagtctcttttgagaagtttgttgaaaattaaataaagactagtgaagaacacaaaatactaaatttttcttatgagaaaaagttaacagaaatggaagtatttatcttgaaaaagagatgactatgggagaaaattactgctctcaaaggctattaataattacaataaattgttctcctgccctacagaggaccactgtatatgaggaatatgtaaaaataatggcaagataatttgatttgctataagtaagctatcttgataatgaggaaatgtaaaaatactggaacatctaactgggagaagctataagatgtttttttccatccctagatagctttagtaagaagaaaaatgcattccgtaccctggttcccctgtgctatctcactggtttatattctcaaatatccactcaggaatagtgaaaatggagaggtttcactctggcaagactatatcctgaagttcatgtgccttctttacacttttaatgtttcttttatggattcatctacctctcagctttgggttattactagtccactaatccacagaggtaaggcctaaaaattttgcaacaagaaaattggtaaagtttcttgctgcccagacatagtcattggtacagggccacattttctaatcacttagaaatagttgtaggttgctcacaagtatttatcctgaggtttctctttgatatggtaattggtttgctttcaggttttcccaagcctcagtgtactagattctttgtcttgacacctttagactttgtcttacaagctcttccacagcatcctgctgccctgccagactccgtaatatttattggcccttttctttacaaggtccacaaatgacttatggactgctcagtatagccagtgacattcaggcctatcagatattaatactactgatgctccactcatatattctcagcacttctatatccatcttacagacttactaacagttaagtccagaggcttaaaaattgaattctattcatacttaaaaattatattcaccagtcccactgaatcttcctacagcaagcacctgctaccctgcctgagaattactttctttggccacaaaagcttgattggccctgaacatgaggttcaggtgacacctctgagggtagcttttcacccaggatgaataggtggctaaatatccagtttgttcatgtcaggtaagataattctgaagtgctgaggtgcattctgcagtactacccagagtttaacagcaggatcaagccccaagccccagttgcctgcagtgacccataattacaccttcttggttttcttcccctctctgcctcactttgtctcactttctcttaaatagactattgataacacaaatccttacttcagagtctgtcttcaggtgaatccacttaaggtatctccatatctttacatatgcattttccaaagaatgtgcattttttggtaacatttaaaagaacattttacattaataattgagggaaaacaatcctggtttctgtatatacagtgtgcctgcaacaaattgtgctctcacgcctgggaaggtggaatatatgtccccaaacagacaactcccagactgggacccttgaagtgtttgttgttgccagcaactccaagtgagatttcttgcagaacactctgtgattttatgatctaggatgagagggtttggccataaaataccacgttttcctatcaattccactacagtgataagaaagattctttcctttttgttcaacaaaaataaaaaagcaaattactttatgtatttttctttggcttctgatcatgctaagagacacctcaacaaatcctgcacccaacaaatcctatcttttctgcacacgcagcagtaaaatgcactcatttgtgtaagttataaccaaatacataagtaaaagtgttgtttgtgacagtagatctgactttggggatacatatgaacttctaaagttttaatagatttcagcattgacattacagcatagaaataaagcatttcttgcagtcatcccaggcattccagatggtgaagaacattgcaataattcaatggaaggaaaagcaaacttacccgaatcatcatgactgaacatctgatatcatgaattgtatcatagatcttctttgagatgtccacaaattgattatcatccaacacattcaatgagcttttgcttaaggcttccaaggcaacattcacttgtgttacaaattcaggaattactgttaaaataaagaataaggagaagattgtcctctttgtatttttggatttatacagtagtttccaggaaatgtagaatttggttttaaacaaatatttgattaatagatctttaattgtattttttaaatatagagatacacaaattttagcaggattatcttgaatctctgaaaagtaaaacgaatcaaagacaattaaaggcattttttttttctaaaccccaggcttctggagagaaaggcattattatataaatgttttaaaagattatctttctcctttatatcatctttgtttttacaaaaccttgggaccatacaatcatttctcatcctattcaatataaaccacaagacattacaaaaaggaattggtgtgtaaaacagttggaattgtaaacacaaagatatttaaagaaagaaagcaattgagttgctaaacagaagaaaatttagctaaaagtagtaattctgccttatagaaataataaaaatattgtaaacttccttttagtaagatgttttctctataataaaaaaaattagtgaaaaggaattggcattctcatatgaaaactatctttaaaataacaaaacactgactgactatagggatgcttctatcagtaagccaatccatggattatctttttaaattaaggcttcaaaatagtttcaaataaaaacgcttcttcaattttacttttaaggttaatgatattaacagttattatctcttcactaggctcaaggtacttttctaagtgttcaatgtgattcaaatcttaaccccagtattaactgagtattaatagtttaacaactaggacacagagaaatcaagactcttccacagattcattctgttaatgtgtaattagagatgtgaactcagagtcccaaaatgcagtttttgggactttacactttacactcaaactaatctactatatcatagtgaggaagcctcttgcccatatgaagatgtcgggtaaaaagattaatttttagaagaaataattataaacctggaagatagaaatattttgactggtataaaaatatcaataaatgttatttttctacatttaagttgtatctgcttgtatggcataccatctcttgcaattctgcctgccatgttattgatatgaggaaattttgatgatatacatgggcactctttttatctggtcctttctttcctctagctgccaaaatgtatcacttataccctacttctgagccaccatatctgctgacattatccactgtgctcctattctctgtctattctctaggcacattgtctaataaaaggtggctactagctgcatatagctattaaaaattaaattcattagcctcaaattttaaattcaattccttagtcatactcatcccatttcaactgcttaacacatacatgtgactagtgattaccattttgaagagtggatatatggctatcatcagggtaacttttgggataacagaaacttctattgggtcataccactttgcactgagaaaccttcaaatcacagtctccctttcagcggacggaataataaagcaagagggagagcaaactcataccactttgcctaggagaaacaatctcaaaccacaattctcttatatatggatgtgactctcaaagtatatctctaatctagacctttctccttaatttcagaactgtatatccaactgacaatggcaaaattctgcctgaatcttttataacatctcaaacatattctatctaaatctaaatacatttctttctacccaggaaacctaattttcctttaccatattctatgttggtgctgagtcattcatgaaaaaaacccaggtgttttatctgacctcctatacttctttattccttacatccaaatacctactaagtgccatctgctctactatgtaaatatatcccaaatccattgagaatttttagccccactgtctctattcatcatcatctactatttccatccacagcatagttcttcccatgtctaaattctgctcattctcaggttcattttaagtataatcttatgaatggcacctgctcttagcattaagtattatagtatctctcaaatgatggacactcaataagttgttttatgaacacatcatgttaatacagtgtttacaagttttcaattgttccttgaagcttttctttgtttatatcctaagtgcataggttggcatgcagtaaataaatgatcgaatgaattaagtgattaaatgaatgaatgaattaattaattaatatgtaaaatcaagcaaagagtaggtacaatgaaacatgtccagcttgcatttaaatgtgattttggttttgttaacaactgaaaagctccaaaaatatatttatgcaggcttataggaacattcaaatctgcttaatgagttaatcattacttttgtagtgttaaaagaggagggaacatctaagaaaatgtgtccagttatttcacatttccttcaggttctggagtagacagcaaaccaaccgtcaaaactactactctaaagaacaggacaaaatggcttctagcctctgtgatatgctctattcactccaaagacatagttaagtaaaaagagatatgtcctcaaaacctgtagggacctgtcggctacataactttattcatagtcatccccactaaaaaatgctttttctcatataccaaacaagtgtgcaatacagtaataatttaattctgtctattaatactttcaatctgctattattgatacagttcccaccatcttcctatgtagattttggcaaaaaaagaaaaatttaaagtcatgtaaagatctgtttttcactgccctgtgaagtaactgcaagaaagatttaaggaatcttacaaaaaaatacaacacagccttttcattagtgcaaaatgatttcattttaactcctctaagggccttttactaataaattaatattagcttcaattaaaataaaatctttcagaagcaaatgtttaatttctgaagtacagatggaaactactactttctcactctaacaacataaatgaactattcaaagctgatatgtaattcatttctcatttcattagcttaaacatcagctgtgggtgtactttacttacactatggacatatggttgcttggatcaaactaggagtaaatttttttaatgctttcaagaaaatacaaaatgagtataaataagtaatcagtttatggtaatttaggaagaatagcaaattgacaagcctgtctttactccataatctacctaggttttcagaaaatgaggtttagacattaatatacaatcatgctatagaattattgatcaaagagagggataccttaaacacatccattctaatcaatggaaatgccaggtaggataagctgttctgaactttggagtgtagatttatcaaacaaaggcggccttttggtcaacaccccggcgacttcaaagtatcttgtctattttacacagccaaattcagaaccagttctgaactcttttgcagcctatactttctctgcctactttattcagaatagacagaataatagctaccattctcactcatcttggcactgtgctaagcattttagatgcatgtctcataatcctcacggaagccctgtaaggcaggaactattactatcctgatttacctatgaggaaactgaggtcacatagttaataagagattggctggtaattgagaatatagagccagctctctgaaccctaaatctgcactgctttcttttgataagtaaagtccatggggtttctgaattgctgctctcctgggggaattcatgataattttctgacaatgcagttaacagacctacacagccaagttctcctaggccttgagcttctgtctggtagtagcccaaaaatatttcatcccttcttaatccttgataaatttattatgtgcatttgaaagtaggtgaggatacattattatggaattaaataggtcagaaaagaattcagactcattacaataatgatctaaaaatgatatcaccaaattgttttctaccattaataaagcccagattaaaatatttctaattataccattacctttgaaaattactggtggtaaagaaatttgcctttgaaagctcacataatgctaagtcatcatttctttaggttatgttaagtaactgggagagaattaataatactagaaagtggcattaagcatataaatgacttctacaaataccactttatactcttctttttttcatttattcaataaatgctaattattgtggttcatatatatttaatatttagggagccaatattatgtatcaagaatatgtttggtacctcatagatcatatatcatacaaatcaatgactagtaaggatttcaccatttttcaaatgatatgtcccaaagtactgacctactctgatcctttatcacacatcacatggttaacaagagcagcacttttgacctctgtgttatactctactctatctttcaagaatatctggaatatcttcaaaaagtaaaaaataaaatactagagagaaaggacttagatatagcttcatgaagctgatacattatgttttccccctctggcagagtaggttttctacatatgaaacgctaatcatttaattagcctgagtgtccacctttgagtctctccagtgacttagaaactcatcttctttccctgtagcttaatttaaaaaatcttcatatgtctacataatgggttaatattaataaataatatttctgatttaattatattaaaagtgtatccaatgaatttttaatatgatgaagattaagctctttcatgcttttcctcacatcattttctaatttgtttacatcacagtaatcatttacacaaatgtgactacttaaatattcaaagttggacctgaaccaagtaatgttctatgatgacctttgttcttttatgtactactttataaattttatttattttaaattgttaataaattttatttttttaaattgcttggttttctttgcatttctcagtaagaattctcaaatgtttaaattatcaatactatttttatttatgttatgttaattaactgggagagaattaatagtagaaagtggcattaagcatatgaataagaagttcgtgcaactgttttggttcatgcaaatagaatcatactgcatatactttttgtatcaactttcactaaacattaaatttttttctatgtaagttgtatatggaattattcattctcattgctgtatagcatgtcattatactaaaatgtatttatccagtctatggttgatgggcatttgcataatgtttagtttgggactataatatatatggtgctatgaatatcctagtagatgttttttggtgaatatatgtgtacatttttagggaatatacatatcagtagacttgctgggccatagtatatccatatatttcacattagtaaacatcaacaatatcctaagtggttggaaaaatttttacccctatcaacaatgcctaaatattctagttgctctgtatcttccctaatatttggcacataccatcttttactttttagctttctgcagagtatattctcttgttcccttttaatatctcttccagggatctggtttctgctagttaagactagggattactttgattttttaaaaaatctactcctgcatcttgagtttagactgttaaatcttcctcttttagaatcactcaccatcctattgctcaagatcaaatcttaatttcttcactttctaccattcagaaaaacagttacaacagggaaaaagttaaagaaaaatagaaaggtaaaagggctccaaggtctgtagtgttagcaaaatgctgctcagtactcagagggtatcctgaactagaggaacagggaaagaagtctagagtaaaaaggtgcagaggtttaaaaggtacagaggtttatagggtgggatcacatctagtaggagaaatgtatcttcctttgaccagtggtgttgaatgaaggtggtccttcacatattgctggggattccttggctgaaaataaatagaattgatcttacctctacaaacttcaactctctttgcacagttgtctataattatgtgtcagagtagaaccatttttccaaccttgtctatctggtatctttctgcccattcttcagattcagattattgtttatttatttacttttataaatttattttttattgatacataatagatgtacatatttgagggtacatatgataacttaataccttcatgtaatttgaaatcagattcagtttaaacataagcttctctgcgaaacttccctcaatcagcacccccacacttgcctccaagtatattaggaaatcctgtctcttggacacgctaatgcctgaaatatacgtttattaaagcacctgtgtcttagccaggcatggtggcatgtgcctgtagtttctactacttggaaggctgaagcaagaggatcacttgagccaaggagttcaaggcttcattgagctatgatcacaccactgcagttcagcctgggtaacagaatgagagccccttgcctctgccctacctttttgtaaagctcctatgtctcttactttactgtatgtgttttcttgtactcagccacttctaaaatcctgacagaaagctctcaaagtataaactctgtcaggtcactttgtttcctcaggaaagtagtaggtagtagagtaagaattcaaaattaggcactcagactcagagcctgtgcccatagccactatgttctattgcttggatgtaagaataaccaccctgagacatacccacaaaacattgcaggacacttaggataaagagaagagctacatctttaagagagaaaagattatcagcaaaatattaaaatcagattggcattagacttttcatgagaaaggctagataccaaaggaaaaaacataaaataatgccttaattctaagaaaaatttattttaaacttgaaattcaatatccaaccaatccatcagttaagtgaatgatggcattatttcagacattcaagtacacagaatatttaatttctattaactgtcaggaagacacttggcacacatactcttaaaacaagaggtgaatccaaaagatcaaaacgtggggctgaggaaatagtggagttggaaaagcagtataaggaatacccagagagtattgagacaatatgtaaacatgtgatatatttgagagccagggttctcactatgtaaacagggaggtactgctaaggaatgacaaactgctgtggtaagacaaagatgaaccccatgggactggactgaactgaagatgttggcttgaactcataattttatatgcagatataaacataaattgtatatacagatatatatgtgtattatttttgtgcaagaatgaaggagaaataagaaaacacatcttaatttgcctatcttcacacacatttttaaaaaagattcacattaaggataaaggaataagaagacttgttatatacaaggaatcttaagagtaaggtagaagggatatgagaagatagatttgtctcagagtagtttttgtacatttttgacttctgtaaactttttaagattctacaataaaaaaaataaaattcaatcaacaagggtagggagttggggagaggaaacctaacaccaaatgcaaatagcaataaattaatgaatgaatatgtttaaaatttttaacgtgtgcaccactgagttgctcatacttcactattttctaaagttgtgttgtttaatacagtggccaccagatatacgctgctatttaaccttatattaaaatactataaatgaatacaattaaacatttatttccttagtcactctagcccaccacatatggctaccatattagatagtgtagatatagctcagttctatcatcacaaaaagttctattggacagcactatttcaaatatttgcaaatcaattatttgtgaagcacctgtcctctgcagggcactggtttaatgttggatgagtgatatcggtatcatctttgattctgtgtatatctcactactatgagttaaaaaaccctaaagaaaccctctctggcacctcaaaatgccctgggctattgcaaaattgtattttagctcctatctaatgatacaattcttagctttattggtcaacatgtatcttccttggtataaatatagatgactacttaacaacaaaaaacatagttttccttgtagtttgagaaattatagattatctctttgccatattaattgtgttaatcccttgaagtttatgggattctacagctgatgaaattgtactaattgcaatatatgttaacagtgtctggaatttcagttccaatttgttactttcattctaacaaaactgttaattaattttaaggagttgtaatactacagtaaaagattatggattcaatctcattgatagttgtgattttattttccgcattagctgtatttcccatggaagcataagagcttcctatatgcaaggggtacaaggttaagatttttaaagaacaggccaggcgtggtggctcatgcctgtaatcccagcactttggaaacaaacaagaaagatttttaaagaataaatttatttttcctgtatttgatattcatttattttgaatcctcctactattacacccaatatattaacttcggggagcccaaattaatacggcttaaacatataagcatgtttaactcatgtaacatacttttctagaaatctgaatagaaattgattgtaaactttttggctgtgagagtttggtgaactgaattattacttttaataatatttgttgaatgaatgaagaaaactcctgttttaaatgcagtaggggagcttactatttaaggcaactgaagtaacttctatcataaatatttacctcctaatttctttttctttttaaagctgaatttccacatgttggtttacagacactattttaaacaagtctatacaagaaaatgaagttttataaccatgctaagcatgtttaaagtagttatagaaatccaaaaactttctgaatctatgtaaactatgattatgaaacatcagaaaacaaaataagctaaagttcccttctataaaatgaaaaagttggtttagttcttctcctctagcatagttactctctgattccataagtttcttcacaatcatacatgcattgtatttattttctctggctatatctggttacaagcagaaattcatttgaaaagaataaatggaagaatgagagggtgggtagatgactggatggctaggtgggtggataaaaggaaagaaggatagtagtaggagaagttgggtggatagatgcatagataatacgatgtgtgaataaagagaagtagagatttatttttataactctcctacatctcccccaaaagtgaattaaaagcagcttttaaaaaagagtcaagtgtgcaataagctttaaaacaaggccaacaggagccacataatcaaagttagggagcagaaatataattacattaaaaatcctagagttaaggtacagcaattaagtataaaattgattgtttgaggtccaggcaaaaatgaagcaatgggttatatggttcatattacctactaaaaggaacctaagcactttgaaattttcaaatgaaaatgataatttctattttcatcaggatatacttgaaaagacttttccttctcaatgctgtatactaagaggaataaatgtatcatgtatttatttatgttattggttattaaataataaaatgaacaatagtctttacaaatgatgttaagaaaatgcaaaagcattcttcataagactatttattttttacaatatcagattatcgtctgcagagagttaaagtactagagttttgatttgcacctacctgatatgacatacagaaataggtcttgatttgaattctagagagaaagtcaatgcataaatgaataaatgatctcaacatggcttttgacagaagtgagtcacaaattattcgaaattgatgtcaacagtgagttacttcttgtaggatggtcattcaggtttatcaggcaaaagaacttccaacacttgttttagaaacaaaaatgctaatgatgtaaattgatattctcttgtgaaaatgaaagtgacttgtatcagctgcattttattcctgagacagaaagcctcagatcaggattacaaaatatgataacctatatgacagtgtccatcataatatctgatcgtttggaaataagagaagacaaacatctgatcacttactaagtaccagttattttgctagtgatttacacgtgtgaaagcagtaatgtgtggtatgttgaggcttgacatcaaacttcctgattgggggtctcttccctgattgcattttctcattgcattttatatgcattgtgttttctctgaagttttacaaggctgtagtcctgtgcaaacagtaaattcattgctcggtaaactttattataacacagtagttttcaaactttaccatgcatcagaatcaccagaaaggcccattaaggccccacccatggagttcctggttcaataggtctaaagtgctgcagaagaatctaaattttaacaagttttcaactgatgtggatactgctagtccagggatcatctttgagaatcacttttagcagatacaattggttggctccccgaatactcactaccaacattgttgctaaaagaaccatgaatttgttcaaacgtccagttacatctgagaagagggaaggtgatgcagttctcggtcagttagagtaggttagtattctctgtgctcttcccatattgtattaaagaaggaattttattgtaatagttgttattgtttgtcaccctatttgatgttccacaaagggaagatacttagaagatatgtgtgcataaattatatatatgtgtatttatatattaatatatatctgtctgtatatatgtatgtgtatgtgtgtgtatttggcatatatatacacaccaaattatatgtgtgaacacataaattatatatatgtgtatgcatatatatgtgtgtctatatatgtgtgtgtttctgtgtgtataccaaacacttttgtgtacatatatgtatatatgtattataatatatctcatattgtatatcaatatattataatatacctcaatatatcatttgatgtggaacacatacagatatatatacacatacacacatgtatacacacaccaaatttggtatataaaacatgcatatacagatacacacacacacacacacatatatatatacatacacatatatatcatttatgtgtaaacacatatgtttcgtatcatcagtttctcccaccaaatttactcttctctctcctcatgtatctcccactctccatgttcaatcaatcaatcactatgtcctgctgattcggcctctcaaatatgtttctggcacatagtagatgctcagtaattatgcactgagtgaatatgcctacctagcacaagttctatcaattcaatgatctaacttctatgcatcataactcacccagttttacaagtaaaacatataatgattgtcttttaattaatgcacctactaactttatcattaaggtcaaaggagttatcattaagttatcattgaatcagttgctgtgaatttcgtgtaggtctctctcaatggaaaagtttgcttctcaaaccttttctgttcctattcactaaagttctgccactgcaattcttggctgtgcctcaatagtgcacacacagtacatttagtatattactgatggacaaagctctgaagttaagaggattaataaggataaaacccaaaatacctaaagctaatatcaattcactgagtcagcaagaatgctctgaaaaccttttattttgaggcatgaaaacctctcacatatcattttattatttctacctctggaattctccaaatcatcatgaggctgcctgcaaatgtagagagaaagtatatataagcaattttgttatttttaattctaataatcttaaatctacctacttctttctcctcaaaagacctcattaccttgcctattatcctcaagatgcctagagatgcctagagagacagatatgagctaagatctcattttttcaggctacctccttctatccttctatgcattgtgtttttcttttactgcaggaagaaatcatttcaatagatatttacttattgatatgtataagttttgatgatcacaaaactaaggttcagtcagattaagtattaatgtctaaaactgcatagctagcaaaaaatgaatcacaaaatacttctaaaaatgaagaattgtcctataaagcttttaaaaggttaacaatctctttgaggtaaaacaagaacataacaaactactggtggctgaaaatgtagattttaattatgtatttataatatgatttcaatatattacctgttatatatttgcctgtgtttcctactaactgtagaatacaaggcagaataacaaaactgccaaaagagaatcatataaagcttcagagacattaaaatgagaaaaagtagagttgagattgtaatatctatcaatgtagtaaaacagggaaaaaaaagctaaaagttagattacaacaagttgtaatttaaactttaagccaaagaatctattcttaatttgatagatatttaatggcctttagaaaattccagtagtattctaacatgactagtagtgagaaagtaaatctgctacttgatctgccttaaaatttcctgtacaatgtaattcattactttttctgtgaattaatcagcattattttttcttttttctttcttttttttttttttctgagatgaactcttattctgtcgcccaggctggagtgcagtggtgcgatctcggctcactgcaacctccgcctccagggttcaaacaattctcctgcgtcagcctcccgagtagctgggattacaggcgcctgccaccacgcccggctaattttttgtgtttttagtagagacggggtttcaacatattggccaggctggtcttgaactcctgacctcgtgatctgcccacctctgcctcccaaagtgttgaaattacaggcgttagccaccgtgcccggtcatcagcattcttgacaagaaaaaaatcaagcacctttctaatagactttcatgagattatgacctcttctaggagattagactggcctcaagtaaccatcatgctaatagcccaatgattgttaacgagaatctttggaatagttgcatataatctaatagtgattgtctaatcatcatgttttaaatgaatcatctctatcaagaggacatatttaaatttactttttctaaagcctatttccttgcagcatgttggaaatagagttttatcatccggtcataattaatttgtctgagaagttgttttaacagtggttttcaactctgttccaatgagagtgtctcaggaagcactgtgggtagagagagaagaaggagggggtgaggagaagccctactgaaaatagtgtgagttcccacactcaatcgctgttacaaagacagcagcactttttcatctgttctatatatttaagttcagtttcactggaataaaaggttgtgtaatactaaaaagactggaaatcattgctctacattatgaatatagaagtcttgtataaaatagaaaagctgaaacaggaagacaagttaggaggttttagagtaggctagaagaaaagagttcataaagatctgaatgaggatgttggcagtggaaatgaacaggttgggacatttggtactgagatagaaacttcacgattttattgctgattagatgcagggaggtaatgcaaaggaagaattccaagatgactaaggtattgactaatcctgatgtctagaagaaagtgggcaaactattatcagtaataaaagagccaaaaggaaaggaagtctcgatgggttaataagagtctattcacgttgagtttcaggtaagtttcaagtccagatacctattagacagtcaggacagagagagagagagagagagagagagagggatttggtaaacatttgcattgggatgacagttgaagccatggcaataggccaaatcatgcttgatattaggctaatttccctatagtttgaaagaggaacttggtagtcataattaaatgtgtctctgttgatagcttcacagacttttaagacaagaggggattcatccttttggtgacacctgtcatgttacaggaatacctgtattgtatgtgaaaggactgtggaactcaaaattactgttcaaatgtaagatggaaatatttattgacattattattacattgtaatagagacttaacctaagacttgtcttttttttagaatttgttaatgaaactgcatttatctaatgcactataagagcaatatcttactgaaacattctaagcgtaggttaagaaatgcataatcgttggcttggtaatctctttctgggcaataacagcagaaccaacctccagcaaagaaagcttagtagcagagatcctatctacattcagaatgggactcagtgtatttccctgataagaaaatggagaaagtggcaccagaattgaaagtttgtaattgtaggacatggtaggtgattgcacatgtagggggctgggacagagggaataccttcagagattacttgcaataaggtagtgtcagtttataaagccaagacaaaacagaaatcaggacaccataccaggaagaaggaatcaaaaccagactcagctgaccctaaggctacaaggccacaaatgtcgaactttttcctcagtgactgctgctgtcaactacaaaataggctccctcctggtaaagatagcaggtcacatatcttagttaccgctcaggaaataacctgtcagcacatcatctctgaacacaaaggacaagataattgtcccacgttctgtcaggcagaagtcccagtcatctgcagaagtggtaatatggaacatggtgtatttgtattaacattaactcttttgtctctggcttcagtaggaaaaattttggagatggcaataacactttttagtattggatgatttccttagtctttcttaatgcaggggatgcatacctaacttttgtagttaataattaaggtatatctatgttgaatgattaagcaaaatcaaaaccaagactgatttttatttttttacactttctatttttacttcaaccagaatggaagaagtacacataattctggataaattccaaatccactgagagtatatttggtttatgtggtagggaaattagcctattattaaaacagatttttaaagatttataggaagaggcaagtagatgaaattgccctgtcagaatatttcatgactttgatgggataaaagtaaaactatatgatttctattgtactttctcagctgttactcaaattgattataactataaaggaatttcattttctgattcatcaccatattaaaatgactatgaagtcttctaaacaaaagcacgaaattctgtctcctcttctagtattcaattcacatagcaagatctctttaaaatggtcatcatattttgtatttatccctaagtgtgttttaaaaatagccaaggttagaataacaaaataaactcacacacacatgtgtgtgcatgcgtgtgtgtatatatatacacacacacacagatctatatatctatatatctatatctatacacacacacacacgcatgcacaaaaatcatgcctgttgattgattctggaaactagaagaaattgtatactgtttataatccaagggaggattatctgtatggatttcaagaagattttacttcactaaatgttgtgacattttacaaaatgttggttgtgtcatgctttaccccctggctttaacacatccacaaggctttgaaagcttgattagcaaacataaataataaaaagaaaagtagaactacttagggggcaatattaaaagatggatgtgctaaatacaaagcagataaataatcagacatgttatttttgccccactgaaaatccatgccaaaaatagtaacgactgtttttctttttcttgtccactttcttttgaacattgatacttcacattttgttaattctgaacaagactatgaaaatgttacatcattttactgaattgaaaacattaatgaaatataatgtgtgagcagatagattctatgagtttatgtgtgaacttacactagaaagagaagaatggcagtagatgtggggggttggaaggaatccagtcctatacacacataagagataaaaataaatttatttattttaaattcatccttgaaataggttaatcattgaaaaagacggatctacagattccacataaccaccccctggttccatccttgcaagccgggcataaatgctgagacagaataataaataaaataacaatttaaaataatttctgggaaaattatgggactatatacatggaaagaaacttcctgaaaactggtttaagaatacatttaatcatatattttcaaaaagtaattatatatattaaaaggtaaattttacatctgtaccaaaagtaccctgtcttttgccctctcttctgagagaaacattgcatttttctgcaatatctcttcctcgtgtcctctatcctacatttatagagtctcaaatatgctcagcctcaaaattaagatgctttgagcttccagaaaacactacacagataaaggtggctttcaaaagagatgtttcttattgtctacgtaatcatgcagagttaagcagtcactgcaacctttcatcattttctacaataaggccaactttccagataaccacttagtgaaacaagaatcctgtatttctatggtggagctactgcgggtctcatccaacctcctgccatgtttgggccactgactgtttgggcacttacgtccagcttgcgaggatggagccatggggtaagttaagtagaatttgaaagcagatgagtataataggagtacttactctggctttcagaatttaggcagagagaaacagggactgccataactcagtgaattttccctataactagactccataatttgtaataaactgcatatttaattaaccagttaggaggctatttttcctgtctggttcattgtttgtgtatgtgcaaccacagcagaaatcatgaaagcagcagcagcactgggagaacccagcctctaaaatgtgttagagtatttatctctgcaagatagaggtagttgataaaatagcaaggttaaagggcagacacttgcagatcaagcctttaaacaaactttcattttgaacacataccataacttagatgggttcattaaggagacacaaggcatttggaagtaataaagttagtaatggtttcaaaccaacactgtagggaaactaaacttattagaagaaaataatgaaataatcataaaatagctgacccattacttagcaatgtacccaatacattgtaatgtgcattatatatatatgtaatatataccatatacacacatacatatatatacacacataaaaaatacattgctaaagatgagataagagagttacagtggttatatcttacatttctcttccccagtatccatcaccctttcttccagccctgaattttctctcaggaaatcaccatttccctttcgtggatattttattgggagacggtacctgcctttcactctttaagccaaagagatcatgtcttctccttccccatagtatctatagacagagagttggcaagtgatctagtcagccaaaaagattgtctttcctcggattttgaatcttgagctagtgaagcaacaaggtaaagaagaatacaggatcttccattattctctagtgttacatattgttcagagaaacatttacaacatatgaaacctacgaaaggaaaataaatcttggagcccccaaatcactaatctaaagggaaaagtcaagttgggaactgcttagggccaacctgcctcccattctacttgaagtcatccctctgctcattgagataaatgcgtatctgattgcctcctttggagaggctaatcagaaactcaaaagaatgcaaccatctgtctcttatctgcctatgacctagaagccccctccctgctgcgagtcttctggcctttgcttcaagttgtcccgcctttctagacggaaccaatgttcatcttacacatgctgattgatgtctcgtatctcactaaaatatataaaaccaacctgtgttctcaccatcttagatgcatgtcattaggacctcctgaggctgtgtcacaggcgtgggtcctcgaccttggcaaaataaactttctaaattaactgagacctgtctcagattttctgagttcacaaacctaaaaatgctggattaaatatagttaaaaaattgtaccatgggggtagaagaataatttttttaaatcctcagaaattacaaaaaatataatcccagaagagaaagtaagtgctagagtggtgtttgccctggagaactctgcctaaagtagcaggttaattccaatgaaccatgcataaaagagaggatgaaaagtctgcaccatgagtgggaaggaaaattgtatctgaactatttagccttcactgcataaagcttgaactttcaaagcatcacactcattggatgaagtaaatctatactatccattcagagagaaatagttgggatatgtaaactggaagacagatttgaagaaactacacagaatgaaacacaaagaataacaggaatggaaaacaaaaagagaaggtaataaagaagacggaataaaaatcagattgaatatatgcttactaaaaggcccacagtaatttccagacttaagaaatttgaacaactaagaatagaaaaataaaaataatatacatccagaaatagtaaaatacaatgaggaaattttttttctttttttgagatggagtctcgctctgttgcccaggctggagcacaatggcatgatctcggttcactgcaacctctgcctcccaggtataagcaattctcctgcctcagcctcccgagtagctgggactacaggtgcctgccaccatgcctggctaattttttatatttttagtagagacgggttttcaccatgttggccaggctggtcttgaactcctgacctcgtgattcacctgcctcagcctccctaagagatgggattacaggtgtgagccaccacacctggcctacaatgaggaaaaattttttaaaatcaccattagaatatcacagatataatttttactgatgaatgctaaaattactgggcaaagcattaggagaaatagtacacttgcaaggcatgaaaatacttgccaaaccatatttattaaatatcctggtgcttgtattgaaaattctttgatacttctggcaccaggaggattatttattttcttccacttgagtataaactggacctggtaactcaattctaaacaacagagcacggaaagggagtagtagctttatactgaagaaacatggcaagtactgtcttaaacaagtgattgaagttaatatcactagttatataagtcatgttgatatggattcctgatactagatgatgagaaagatacttcatctgtgtggtattcttccctaaaatctgtaattccagtgaaatcatgaacactttagatacatacaaattgaaggtaattctacaaaatgcttgcccagtgctctttaaaagtatcaaggtaaggtatatatgagaaaaaaaaaattaaagtctataacctaagcttctactttaagaaactagaaaaagagcaaataaaattcaaactaagcagaagaaaataaattatacaaattagagcaaaaatcaatgaatttggaagcagaaaatcagtaaagaaagtcaacaaaatcaaaagctagttatctgaaaagatcaataaaatttacaagcccgtagccaggttaactaaaaaaaaagagagaagatacaaattactaatatcagtaatgaaaagggactatgacaactgatatcatgaacattaaaaagataataacaaaataccatgaacaaccctatactcacaaatatgatagcctaagtaaaataaataattccttgaaagatacaatatactgaaactcatatacacagacatagataacatgaataggcttatagctattgaggagattggatcaataattaataaacttccaaaacagaaagaaccaggaccagatagactcactggttaattctaccaaacactgaaggaggaaattataccaattctttccatctcttccagaaggtggaagcagagtgaatactttccaactcattctatgaggccataattcccctattaccaaaaccaaagacattgaaagaaaggaaaattacagatcaatatttcttacgaacataaatgccaagatttttaagaaaatgttaacaaaactaattgaattatgtataaaaggaattatatactaattcttttagtatataaataattttattataaatagtcataaataaatctacaaagaatcaagtagatttatcccaggtatgtaaacctgattcagccttcaaaaatcaattactataatccatcatatcattaggctaaagaagaaaaatcacataataatattaaaaggaaaagcatttgacaaaatcctacacccactcatagtaagaactctcagcaaagtaggaatagaagggacctttctcaacttaataaaaaacatccacaaaatgcctacagttaacatcatacttaatggagacaaactagatctcttcccactaagatcaggaagaaggcaagatgtccactctcaccactagtgaatgtaataaacaataaaaggaaataaaaaccattcagacttggaaggaagattaaaaatctctttgtagatgacacgattgtctatatagaaaatagcaaagaatcaatttaaaaagtcctggaactaattaatgacagcaagcttgtaggatacaactcaagtcttttgatttcttatacaccagcaatgaaaaactaaaatttgaaattaaaaacacaatgccattaacatgagcaccaaaaaagagatacttagtataaatctaaaaataatatctacgagatccatgtgaagaaaattacagaactctgatgaaagaattcaaagaagatctacataaatggagagtgagttccggtgcctagataggactcagtatggtctagatgtcagtctttccctacttgatgtacaatcaagttaatatttaatacaatccctatcaaaattccagccaggcattttgggtatttactaattgaccctaaacttaacagggaaaagcaaaagacccagaatacttgatacaatattgaaagacaaaattagaggactgacactacctgacttcaagacctactataaagctacagtaatcatgacagcattgtgtttgtaaaagaatatacataaagtaaaagaaactgtgaaaagttgtcacatttcgaaagacactatgaagacgtgataactaaatgcaatgtgatattctggaacagaaaacagacattagtagtgaaatttgaacaaagtctacagttgccttgcaccaatgctaattaattagttttgacaaatataccatgataatgtaagatgttaactttaagggaaactggtagaaaggtatgtgggcactttactatctgtactatcattgaatctcttctgtaaacacaaaattattttaaaataaatagtttaaaaaaagattctaagccaaatatctctcatgtaaaaacatacaaaagtcctaataaaattttagcaaggcaaaattcatcattacaaaagaaagatactattccatgcccaaattagatccatttcaggaatacaagtttattttaacattaagtaatctattaattttctaattcatcttatttacagattaaaagggaaattagatataagcttctcaacagatagaaatcaagtaggaatttgtgacataatttcttactcaaactaggaataaaagggaacacctttaatttgacatagcacattcacaaaaatttaccgcaaacgtgatattcaaatgtaaaatgttacaagccttattttaaaataggataatagcaacaaggataaacactaacaacacttctctttagcgttgccttggttattgtaaccagcacattaattaaaagcataaagatgaaaaaagaaataaaaaaatgtacaaactacaacaaacccagagcaaaggttaagaataaacagtgtattctggaagaaaaaaaagaaacaatagttatgaaaattttctttaccagttatcatggcattttaaatttagaataattaagatgcacagtaaaataatagagacagacatatagtctattggaacaaaagacaaatttttacacagacaatgcatttatacttgattatgtatctggctctgcacatcattatgggtaaaaaaacttttttatttaaacaattattattaaaaagtttttatataattggttaggcatatgaagtgaataaaaataaaagtcttatctcaatatacaaaaaaatacaaatggttaagatcttaaatgagaaaggcaaatttatttatttatttagagacggagtctcactctgtcacccaggctgtagtgtagtggcgcgatctcagctcactgcaacctcctgtccccgggttcaagcgatttgccaccacgcctggctaattttttgtatttttagtagagacagggtttcaccgtgttagccaggatggtcttgatctcctgacctcgtgatccgcccacctcggcctcccaaagtgctgggatatatagatgtgagccactgtgcccggtaaaacttgaaaactttaaagggcaatttttaagtcctcagtagagcaaaggatataaaaccacaaaccttgaaattttctttaacaataacatcataaagagaatgaaaaggaaatgtaaactaagaaaagatgaaatatatacaacccatagtatccagaaaaataaaaacaaccccaaagaaaaatggatcaatgttgtaccagtatttcaaagaagtgaaataaagagataggacaaacatattggggggaagaagctcaatctcatagggaatcaaggaatgcaaattgaaaacatgatatcatttagatatatctcatttacacattggccaacaattcaaaaaatctaagtctatagaaggttgttaaacatctgaactcctccttcactcctcgctgaagtagaaaatcagaaaaccttttggaaaacaatttggtatgacctcgtaaatctgaacagccacagaacctatggccctgtccttcagtcccaagcatgtatcctagaaagcttttgcaacagatgcaccagaattaaattgttcatagtagctttgtacataacagaagaaagagaaaaagaggaaagagaaaaagaggatgagaatgaacaaagatttgcactaataatccatacgctcatcagtagtacaataaatatatttcgatacatttatataatggggtaaagcatctgtatcttgaaaacaaaatgtggagaaagcaagttgaagaggattaaaaaaataaaatttgatcctacaatacaacaatataatactcaagagtatccgcccacaccactcacatataaaccatacacacacacctaagtattatgttgtattgactgtgtaacaaaagtataggaacaggtataaaaatgagcaatacaaatttcagaacagtgattaagtaagagtggggagacaggaccatgaggtaaggttaagtacatagatatttacttgatttattattagtagtaatattttaagtacatatatgttatatttactcttgtgtttgatatatatttcctagttttcaaaggttcaaaacaaaaaatttcagtcatatgaacttttgtggttctggctcctctcccttctgcctctccctggtggcacacgcaacttctcatgcctgcctttcacatgcaggctcatcctcagcccctctctaacccccactatataaaagccctgatttcggctagccaagttaatttctcttgcttccacccaagaatctcttctgaaatgcaacataaacataatctttccaacttagaatgacaaaaactatctccctaggtatttaagttattagttgtattacttttgtttcattaattgtagttttattgattttagatcatatgcacacacatatcatgtttgagcttcttttgctgatttctataaaagaatttgtacaaaacagtgttgataataatgtatccaacacatagggacacatgaaaaactgaaaagaataaggaaaaaaaggtgaagcagtcaaccctattttctcaagtggactctgcatttggctcattattcaatctttaatcctgtgttaccttccttccaccatcctgattcaaaatccccttaagcaaaatataattagcacaaggagtcaactgaaagtaaacatatatgattttaaattctgatggtaccttatacttttctaggtgctttcatggtgaagtcttcctgttcatgaagtagacagtttaggtgttgcctgttttacaaataaggaagtcaaggtccaggcaggttaaaagattcatctgaggttatagagcaattatcaatgacaactctgatactgatgctacagattcagagaggattgtcttattcttaaaaagggaaaatgtatataaagcccttgttacaatggtggacacatagttaagtacttaataaaggcaaattctctctctcttatcccttgcactttgcctcacttatcaattccatgcagctgattattctggtctataaatctaaagtctcagcaagaatgttgagtgaacagtatccaaagtcacatagcggcttttcctatcctgacccaactaaatgtattttgcaaatatgtcacttattaattattactacacaaagattatcacataatcccacattccaagcaaataataaaaaactgtcacatacctaaagggttagaaaaaaatccagattttaagcaatacatagacgcagtgtccagatacttaactaaattttttgaaggttccatgtggaagcacagatagtggacagaccacaaaactggccatcagccacctggattttgtgttctgtagtttgactttcagcaaatcacataacttccctgagtctcagcctcctcatctaaagacagacagtttaactaggtattcaataaggtccttccctgttctgagtcttcttttatttttttaactgccacaaatttatagtatcttagtgttactgccaatatagaaagccaaatgacagcttcaacgctggtgtttctcaataatgcactttatgctatagcacagaagggcttagtgaatcgatgatggtgccaaaattagaatttatggctgtgcctaatctattgttttgctagtaagccatactgcctgatactgcctccacttaacaataaaacaagatttaaagggcaaaactgtatgatttcatactggcatatgcaagggtaaaattgaaagacggtactataaaatcatctcaccataacgaccatcgagtacttacgctctgcaaaaaatgtgtacttgtctgcccttgccagacagatagcaatatttggttcaaaggattatagtggagttaagaaaaaaagaattaaagactggttttcgtatgtctgaaagctttgcatacaaaagtacatcatggaacgacactcactagaaaaagaacaattatacttctaaaagtaagagatttaataagcaatgagcttaaaactaggctgaaagaaaagttaattgaagtctaatttatctctttctggaccctaaattactaacaacaaaaaaattagctaacagttactgaacctgcgtgtcaggcacaacggcaagcattttttatgtgttaattcacttaatcctcacaagagccctctgaattagatactgttaatattcccagtttatagatgaagacacagagatttgaagttatataactagtacagagcagaacaggaagcaagaatagtttctgttaaacatgtgaccttcttcctgtatgtaaaatggccatgttagtaatttttacatgtgattttcatatattcataaaggagtgcatgttgaagtctgcactctttaatgatgtaaaataaaaattattaagaactaaaaataagttttatcattatagtatctggaaaatgttacatatcatttgcatgtgtgacattaactattttaaataaaggtatattgaaacttaaaaaattagacttgttccacaaacatgaacaagtcagtttttagtcatgattctaaagatgcttttatgtgatattgtaaattgatattagaatatgtaagtggctccagtcatctttaacacttctaattattcagagagatgacataatatcttctgacaaattctgatttgctattttcccactagctgtttttttaaattgacaaactccaaattttaatttgatttaggatgagaataaataaaaatggttgattctcatttgcaaactgtgacactcattatgaatttcataaaaatcaaaagtattgcattttattgatctaaagacttaagtttcatttttagtttatttcctgataattcattttttgacattatctaaaacatatcctttgcaaatacacaaatggagaacattagtttcttaaataaggtttactaactgagactgaacttgcttgtcaaatgtgccaagaaatgcaggctgctgctcagctccattaagcagccactctgctggtttaaatattttccagagtgggcagtagttcctgaggcatacctggaagagaggttgacagggttgccatactgccaccctaatttgcaagaccaaagtctcatttgagcagggttttcactgaagcatcatgtctaaaacacatctttgtttatactgtaggtggcaggatttttatgctttaaacattttgctataaccctgcattttttgcaaatgaaaatttaagatgccatcagataacattttatgaaaatatttatatggttccagaaaaaatagccaggccttgaaggtgggtgcctttcattcttggtattgttcataaattaatatacattgtttgatataatcatatttcacattaggtttaactttttctctttgttctgcaaattcgatatttttctaaattttgagattcaataaattaaaagcactaaatattgaaacttaaaaacagaattcactcctgtttaagatttgaaaatgggtatatctgcattgaatccaatatgccaaatgactttatttcagacttttgagtaaggaatataaatttctgaaagagggcatcatttttagccattaatatctgaaaaagatagcaatttataaacaaaaacaaaaacttatcaattctttgcaagcttatgaaattctgaatcaatctttttattttggcttccagtagtacaaaatgtttccattcacatttgatatacttacatatatttaaaatcatcactattttttcataatatatgaaaacatttttatcatgtctttttaaaagcaaattatgtcagtgaagacaattttcttggctaacccttgtacaggctaatttgcttatattataaacatctataaaaattcatgttttattatatatttcaaagctctaaaatgaaattaatcagggtgacttgaagttcatcaggacaccttggcttcttcttaaattgaagttgacatatgctcttccttaatatctgtttcttactctacttaagggaaatggcaaattatctaaaagttaactcaaattgcttaatatgctatttcagcctttgcatttcttctacttggcccatactctcaactaattcaaaaagagttctctatacaaattcctacatttaccaacagtaaaatggctatcactcacgtctacttaagatgaacaactaatgatctattttgtacaaatgtgtttatgcaggcattttagaggaaattttatctccttaggtaaagtttatgaacctttctcagtaaaaacatgagacctagaactatatatactctgctcttatttgaaatgcttcatgagttttttcaccaaaagtttacctcagtgtttgaaatcattatgtgccatcataacagttacacacacagacatacacacaaatagacgcttctaataacaccttttttttcgtctctggagctcaaaattctgtcattaaggctagattccgggccgggtgcagtggctcacgcctgtaatctcagcactttgggaggccaaggcgggcagatcacgaggtcaggagatcgagaccatcctggctaacactgtgaaaccccatctaccaaaaatacaaaataatagccgggcatggtggcgggcacctgtagtcccagctgggaggctgaggcaggggaatggtgtgaacccgggaggcggagcttgcagtgagctgagatcgcgccactgcactccagcctaggcggcagagcgagactccgtctcaaaaaaaaaaaaaaaaaaaaaaaaaaagggttagattccaaccttatatagatagggaaatagggaaatgagggacaaaaaataatatccttggccaagtgcagtggctcacgcctgtaatcccaacactttgggaggccaaggtgggcggatcaggaagtcaggagttcgagaccagcctagccaacatggtgaaaccccgtctctaccaaagatacaaaaaataaataaataaataaataaataaataaataaataaataaataaataaaataaaaataaaaataaattagctaggcgtggtggtgagagcctgtaatcccagctacttgggaggctgaggcaggagaatcacttgaacctgggaggttgcagtgagctgagattgcaccactgcactccagcctgggcgacagggtgagactccatctcaaaaaaaaagaaaaaaaaaggcaaaaaataatattctcaatggccttttttagaataatttttacatttttttcttgcaaacatcagatattaagcctttggtgctatctttcatgactttaccactttctactctgcaacatatttacatagtaaactgtgattttgacatagagatattcgtcacctttaacagaaaagaagaaatctgaagcccacagaggttgatttatccgatatcatatggacaaagcctagctctcctaattctaaatttagttcagtaccccacgatccatttctgtaccctaaactatttctataaattgcctttatttgggcaataatagatgataatttgtctggaaaactgggtacattccatcaagtgtgtctttaaatttggcctatattccttggaaatccatgctatgctaaattcagtttctagaatgttttattctgtgttttcatcatgcctgaagagggtaacataaaaaagcaaatatttatttcccattattctaggccatattccagttgagcaataatatttgtttatacataactttttttttttttttttttaggcggagtctggctctgtctcccaggctggagtgcagtggtgcgaactcagctcactgcaagctccgcctcccaggttcatgccattctgcctcagcctcccaagtagctgggactacaggcacccacaacaacgcctggctaattttttgtatttttagtagagacggggtttcaccatgttagccagccaggatggtctcgatttcctgacctcatgatccacccgccttggcctcccaaagtgctgggattacaggtgtgagtatatataactcttacttttggaagttgaattaattcactttttcctagactgttgtcctaaatgcaataatgctccacattctatcaaagtgtaggtacagtgtatcccagaatcactagaaaaaggtaactatatgcccaccttatgtagaatacttgaggcatatatatccaaagaatatatgttctacagattgtggagagcacgtcactaattaggaaccaagtatccaaacacatagatagctaccttcaaaattatcttggttaaaagaatgacagaaatcagaaagtttgttgctcttatggtcattttaggttttcagtatttttttcctatggcaagttgcactagctaaaagtagcataaagagagttagagagaatcacacccaggtgtaaggcaaagctgaatagctgagcttctgaagtctttgtggctaaacttttcatttttaagacatagtagtcagtacaggaatcagaaggtggaaccatctgcagctatcagcttatacagagtacatgacagtgatccaaacagccacaagaataagcagtcctaacagtagcatggtgctttacttcacttagtacagtgacagggccttgacccgcaagctccagcagaaccccaccacgtgtgtgatgtgtattcaacctgcaatggtaacatacagcaatacattaggcacacagtaatgccagaagttttaatattagactcagaaagataccacaactaaaaatttctacatggggctcctatatgcatagaactcttgtatatggaaaaggaatatgggaaaataattttttttacgttgctccctgatagttactctcctggggaatttcagggtcctgatttttaacttctcctatctcctgacccttacgtagatgataagactttttaaaagccatgttctatcttctaaatgttgggttttggtagatgacttgctacttgaataatagaaggtaaagtatagctacatatagtttaatgttgtaattatgtaaaacttacaactaaacaaagctgctacgtatcactattaagggtgtgcctaagagcttttgtagttataataattagccacatataggctattttagtaattgttataattattttcatctaattaattgaaatagatttttctcattttttagtactctagtatctaaaaagtgtctgcttaatattcatgacacactctcctgactcacttgcttgtgtggctggtctccttacccacctcccagtgccattcagttaaaggcaaagtttccgaatcctaaaattttctacatctcactatgtagttaggccttgggtagctatcaagtacatgcctaacttgcctgcaacaatctttcttagaaatttttgagcagtgtttttagctgcttcatgattcctttcccaatctacaaatgtgtgtttttgtgtgtgtatgtgtgtgttgtgttgtgtgtgtgtataaatacattgagggggagtatatatgaaggctgtcaaaataatcagagggttataaaccttagaaactctgagtccatggattgcagattgttttttttttttagacagagtctcactctgtcaccaggttggagtacaatggcatgatatcaacttaccgcaatctccacctcctgggttcaagagattcccctgcctcagcctcccgagtagctgggactacaggcatgcatcatcaggcccggataattttctgtattttagtaaagacagggtttcaccatattggccaggatgatctcaatctcctgacctcgtgatacacccacctcggcctcccaaagtgctgggattacaggcgtgagctacaatgcccggtgggattgcagattctttaaaccaccaccaattgtcagacagaagaaagaaggggaaagaactaatgttacaggtgggaagaggtgaggagggagctcaaacacattgcctgctgaaattcttagacacaagccttgaccatgataaactttaaaatgaaatcacacaaatcataacttcaccattaccggacgaaggaaaaggaagagagtctagattgagaagagagagagtgtatcttcccccttccttatttaaaataataaaacctatcatttacggagcacttcctatgggctggacattcccgtaaaactctgcatggcatatagcctttagttctgacaaaaagtcctatgatgtgggtattattatctttgaagctcaaataagattaaaaccagtaccaagatagatagctagtaagtgatcagtctggatgattcttttgcctaagatttgcttctgtttcacagtgtttgggggaggattaaatgagagtttccaatgaacttaccaactcttcaccatggtttgtccactttgccaatatcatcttccttttattcaagtaggctgcaattgcattaactttgttttcagactctaaagctgggagataaaacactgtgttcccaaggcgtttgctgctgttgatcctctgcctagagttctcttctcccagcttgtacagtgtctggctccttctcctcttaactctcatcctaaatgtcatccactctgagaggccttctctgaccacgtagctatagttcctactactgtttgcatgagtagcaacttctttacttgattacttattatttgtctttctctcaagccttgggctgtgagggtaggtgtatatctccagcaattgccatgacaatgacataaagacactcaacacacaagtgaatgaatatatgcagtaaagcgtaagagcctgattcagagcctggtacacatttcactcattacatcttaaactcctccattctctaatagctacaagaaggcaaatgggtcagaaaaataatgaatactgaaatatttcccttgtctacaaggtgaatttggtaaaatgggaggccctcagatttctttgctctattttaattcctgaatttgagacatacaaactatctcatcctccctggcccagaaactttaggtctaacagacaattgaagcaaaaataaatatactcatacatacatacataggattaccagtgtatgcaggctgcttagccttcaccagtcataggaaacatctcagcaggggcccctgtttcatcatagctcacatgttcttccccgggagctgcacaggtaacatgaatgagtgaagctggcccagggacagcattgagcacaagactagatgtcctagataaagaaggcagctccaccccagctttagctaattcataagtgatgatgccatgatgaaataaggcccaaggttgccaaatgtatctttttttaaaaaggctagaaattagatttgtatataaaatctttctaattataggtagcaaaaattaatttaaaaattttaaaatatcatgtgtggaaaacatctgtgtgattatgctctcattgaccatcagttcctaattatcatgatccaatatcattcttttttccttttcttcttctcttccctcaaggggacattcttgaagtatggcagagaaaactctaagttcaaatatactttgacaagatctcaatttcctccaattagaatatagaatcttcaataagtttttcaacttctctgagcttcaatatcttataaaatttgagatattattggttgaataaaatagagtagaacttcttcacaggtactaacatttcaataataatttatataaaaacaattaatttagtgttcaaactgtcttttacaagattgaacacaatacttataaatttcaagccaatctttagcatcacttggataaaagtcagaagaataaaaaacagtaaaaatccagttttaaaaaaatcatatcataattaagcatctgcttttgcactcagttgtgtctgtcagtgcaaaaataagtcccctttaaaatagaaggaaagtgacagttcttagaaagaaacttacgatgtgtggtgggttactttttcactttttcatggacttaccctttcatctccaagaagatatggaaaaaactgaaggaggcaaaggttacatttttcaagggtaatagtacaccgtggttctttctttattaataaattttactgagatagcttattgctcctttttttttctctactagaagtaagtaattttcctccttaactacaaatgatttttaagtaaataccagttttactaaggtttccagattcccagttctaacgccacaatccctgatgacttaatgtatcttctatcctggccccacttcattattaataatgacagctgactgatattaggtcaaaatatggaccagagatgtaagacagattttgtatatcctgcctctagtatctacaacaaccatgaaagaaaggtcttatacccattttatgaacaatgaaagtctcaaaggagttgaatgacaagtattaaagggctctgtgtttgaaccaatccagaggcaaggggctctaaaaatctgacttctcttgtgtgtgtgtgtgtgtgtgtgtgtaaataagtgctatggtttgaacactgatcgtaacttggttttgtttatatacacttgctaattatttctggtatttcagatttataccacaaagactattttcaacttgcttatttctcaggccagatgttacagagaaggatgaggctgataaaaggcaatatgttaaaaatttcttattaaatgagattctgacctaaggagaaattattctgtaatatttcatcctcaaaacaaaggtaacaagtttattctcttaggaactggaaaagctgaagcccatatttcctacaacatgataaaactctaaaacatgaaggcaaataaacaatactatcttaagccagtctgaaaagattttaaagtcagtcacacctttattcccttcatcttaacatcataacttgtaggaaatcctcacttaacattattgataggttcttgaaaaccgcaactttaacacaaccaattttaacgaaggttaattgatataaacaagagttaagctcccatggcatgtttctggtcacaaaaatatcaacaaacttctaaataagacaaagagactttcaatattgagtattgaaataaatgtgagctatacttaccattaagaaagacaaacaaaaacaaataaaataatggtttacccaatttttggtgaatcagtgagtgacagtggtggtaaaggtagtgggttaaatctaagaataaatattcgcaaaagtgaaaattgtaaagagcagctcttctatcatgcagttctaaaacaatcatgaacagggtgggctccctgagcacttttgcactgcatcattttatgtagtgaatttgtgggattattgtctactttatgaacttttattttacagtaatatatattaattaactcattaattttttaattccagttctgggtcacaggtggctggagcctatccccgaaactcagtgcacaagaagggaaccagccctgaacaggacaccattccatcacacacagcaagtactaaacacacacccacactcactctgattgggacaatgtagacaagccagttaacctaatgtgcacatcttggggatttgggagcaaaccagagtaccaagaaaaaacccctatagacaccagagaatgtgcgaattccacacagacagtggcccaggtgggaattgattttctccccctatcattgtttataacaacaggagttgaacaaaatgatattattcaaggacctgctatatttaacttctaatacttatttaaaatttcaattatccagttgacagataattatgttttaaaacaagtaatataaatttaacttgttgtctagaccaaaacctatgaacttttctcaataactgattacggcagaataaaatttagacaaaacgtttacttaaaaagaattgaatagcagactaattagtgatcttaaaagcacccataagatagatgaaagttcataaaatgcacacatattcaaaaacaaattagttcagtttcgcattacattcaaaatataatttttttagacattcatgcttatatcaaatgtaagtgaaattttgttaacatagtctaatgatcagttagacaataagataaaatacaaattttaagtttggaaacttaatgcaagtttaatacattaaaatacagagaaaatggtgatgtttctaagaatacttcttcgttcagtatctgatggccagcacatgcctttgaataattttttttccacaaactaaatttatggttagtcaagttttgccatttctacataattcctcatttatttgggtttgtttatgatacagttttcgtagaaatacttataaaaagaaattttaagccgggcgtggtggctcacacctgtaatcccagcactttgggaggccgaggtgggtgaatcacaaggtcaggagttcaagaccagcctggccaacatagtgaaaccccgtctttactaaaaatacaaaagattagctggacgtggtggtaggcacctataatcccagctactcgggaggctgaggcaggagaattatttgaacccaggaggtggaggttgtagtgagctgagatcactccactgtactccagcctgggtgacagtgcaagactctgtctcaaaaaattaaaaaaaatttaaaatgagaaaagaaattttataatttatattatcaaattagtgtgatttaatgtcagtaacacaaacagtaaaggaatgcatggtgatttatttctatggtgttttgtaggaaaggacatttgaattttctgtcaaggttatgaaaatgatctctgaaagctctcaatgattttcgttaactaaatcaataacagtaatatttaattacattcactaatggattctccttttattttatagagtcggatatttattaaataagtgcatgccagcaactatatggacaaaagacaaagcaaaatatgaaaaaggtggaaagcattatggtatgtggttgaaaacattgcttgaaagttttaaaataaccttcagagccccatctccttgtacaggctcttatttattttgcccatgaagctttattttcaaaatgaagcttgctttgcagctggcccagtgggatagcagggtttttatcttgccctttgtccctagatcaaccaagtcatctatgaatagttagtggaatcagctgagtaagatcatttgcaggtggagttgctgggagatatatatatatatatgtgtgtgtgtgtgtgtgtgtgtgtgtgtgtatgtgtgcacgcgaatttggataagtgagattttcttctaaatataatgcatactctataatcccagtggtcaatagtaatctctccacctatgtgaaggtctttgagacaagtgcacctatctttctttgtattctgtcgttgtgatccatagataccaattactctggtcttccctcattttgatctgattgctcccagttctctgtgcacgccaagcttcctctccaatatccatatgccacatgtttttcctcatccatgctattgccaaaatccatgccctctaagtgaaactttatttccatgtttctaggtcatccctattctccaacaactagattaaccacctcttctaaaaattcttccatgcttagatgaaactgatctcaccctctctgagtggttcccaagtcttagtatgcacatgtaaatgctcttcaaagctaattatgctgcagttaccaggctctgtccctagatatttggtaaaataattctgatgcatgcaatccagaaatatcttttgagaaccttcttgcataaaacttctctgagccacagtggtatttcaacttcacatcactgcaccttaaaggtagaagtattttttttttttggttcagtaccctttccctattactttaagagcactcgttcacgcattgcaagcccttgagttactcctgagagaaagaaaggagctagcaaatacttaagaaatcgagttattaaatgagtcaattttaggtttgaatataaatccacttttataaagtatgaacttggtcaagttgcttagctcttctgagccttggatatcacaactataaatgggaataataataaaaatgggaataattacttgatcataatcaaatgggaaaaaaaatcaagtgtttagtgttttattctcccttattcatgttttcaaaagagaacttcaccttgagaaaaacactcttggagtaacatgtcccatagagctacttactgattcaatatttactctccctttacattaacggaatcccaataattgagggaagcaatatgcccagttaaaatctacacaccaagcctacttttcagctagggataaccatgcgatgttggtcagtaagatgtacgtagaagtccttgggtagaaatgcagagaaaagctcttcatataagataggggatgggatgtagggataaactaaacttgtttgcaacactttgccttttgcttttctagaacatagaatatgaacataattgtttaagcagctatatcttaacttccagggaaaatctaaaagaatcacaaaatcctttgccctgatattttaatgccaccaaccatacacctataaatttcttgtcattagacaaaaataaaacaattacattggttaatctactgtttggaatgtctgttactagcattcaaatgcgatttgtaactggataaaagaaaacaaacaaacataaaacaccaaaaaacatctttcacttcttactcccactcttcaaaggaagagagtatttatttgtgagactaagaaagggcatgaattaaaatcaccaagttcctgttctcctgtgggtaggagtagatactgagtggatgaatttaatactgagagaaaactatttagaaaggtcattaggattcaagttgattcacagaattcattgcactctccaatgcagctccagtaataaagctgacattttgacccatcatcaaacctacattatacctacgttgtggggctgttgtgagcttttacgcagcattgcatataaaatgcctagtctcgcacctgatatataagtcttatcgaccatcactatgaccattcttatcactatcatcttcattttgaatattctttcttttggtaagtcacagttattctcctgctggctttaggctgctgttttaatttccctaagtctccctctagttgtgatctttggctttgatttaccctacacatttatgcacttctttttcttgcctacttggttctaatttttcctgcctctagccagttggcaaatttctccttttgatgtctatcttggcattaaataatgtttaattaatatatgtcagtgttaccaagcataccatctgaaacaaaattgccattcagccaatgtaaactgaatgtgaatcttacaaattcttgccttagcttcgtcaattcctggtcacttgagttatctccacaacccttggccacttgctgccctgaggagcatgacacattgacaggttggctgtcttcgtatcactaggactttggtgcaggtcttggttctctcattcctaacccagcctgagacattctgttcctgataataaaaaacacattttccttttatatataatattccatatcttctaatacatctgtaaaaatacttttgacctagtaatttaaagatgcttcttgtaacaccataaaaaagagaaaatattgccaaatgttgccaaaggagagaatagacagaaataaagaacagtaatgcaaatgaagcttttcatttagacttttgttaaagtggctgagaaaatattcttttggccaagaaatgtgttgttatcaacagcttccaaaattttggcctttaaaaatcatgtttacattattattattaagacatcaaacatgcaattaaataactctctctttaaatgcaataactttgccttccagaccaatgcccatcacaaatagccagccagattatgctctgtacagcttcaggagtcctcattcccatagattatgatatgaatagtggcccttgagttttacatggtagcccaagtccagcttctactcaactgatcaatgatttttaattatgttggaccatctttgttgaataggtaaaaaataaaatatagatttgaaaaaaaatagttataacatgttagaagagctttctgcaaaacataattttggaaaagtcatgtttccattgggatcaagattgtccattctattaagttaccgaaagaaacataaaaactaaaggtaaatttataccttagggggctgctgatatttaaaggttggaggtagaagagggttggacttggtggaaatcctaagaagtaacttaactgtgcaattaaagtgaactatagataaaattagaaagtgaaactaataaaaaactcttagcctgttttagaatcattcaagttattctcaacaattccacttattatttcctttaaatgtattcttttactaaatataattagttgcatacatttttgaaaacctgcaatgaatacttttttatggtaactacttaaatgccaagatttaaatttcaaaatactgattgtttccataaacaaagatataacatatttttatactctccgagtgtattttctattgccaaaatactgtgtttacaataaactttaaaaaattctcgctattttaacctttgtccactgctacgaaaaagctccaaataatactctttatgctgaagccaaggaaatgtgcgtatgctatatgagtgtcctagtgaccaggctgtgatgtgtggccttgcactctcatctacaattaaatagttcaggagtagacacatgagtcagatggattatatccaagttggcatttaaaggtcttcatttgggaatgtgcatggcaccctggaacactgaaagtgagactaggtagactagtgggtgaaaatgacagtggctgaggtgaagctctgctggtagatagggcccagaacacactcagaacaggcctcacagaggatttcgaatctttttctaagttctgtggaaaaccattgaagagctctaagtagaggaatcacacacttatatctgtttttaaaatatcaccctactgcttctggctttgagaataactggtagcagatcagcctgccagccataaactattggaaaactcgaaaaatatgtgcaacagctcttttcaggcactggaaaacagacactaaggaactgtgtttgcaatgaggagtggaacaaatgaggaatgtcctacagtcgcccaggatttctgcctggaggcacttcctagatttagacatgagcagaggaaacccaagcagggcatgccaatcatacttagctgaagagacagaaatcaaagttcagttggaggaggtgaggcagctggaatttgtagggcattgtaccagagaggagggcactatgcagtaaaagagttccagaaatctctatacagatttcctggaatctttggctgagctgtaaatgcagagaagagactacacaaagccttgcaaaacaaacaagtgccaggaaaagaacaaatcctggttggcgggagggagttggcaggagtatctccattctggacatttgggaagaacaagaatcctgctgaatatatgttgccagctgcacttaagtgtcaaccttaggaaaagagacttttgacaaaatatggtgacttactggagaccaaaacattggtatttagtgtcccttttcactagatacaccgctccccagggcattgtgagggagcagagagctgcttttcaacctccactctctcaaggacctagaaccaatctggtataagccctcaaaagtctctagttagtcacctttcctagaaatccaagaactcccatactcctgcttgaactgtgcatcataaatcccataaatgagcccagacctgaacaaacaaaagtcaggacttatttggcttatgggtatctggtaacttctgctttaaacctgcagcacaaaagcctctgaggtaaaagaccacattacggggtcccttttaaaaaatttatttttaatgatacaggaggtaaatgtaattccaacagcagtaagaacaaaatacaaattaatgtctcaataaattaatctgccacactaagtatctattttataaattcaaaccaaatgtgcttaatcatcaagggttgtatttaatatatttttttaacatgccatttgtacttctatttaattgtgatgatatgaacaggagttggaaatactgggtagaagagggcagtctacacctgtaatcccagcactttgagaggccaaggggcacggatcacctgaggtcaagagttcgagaccagcctgggcaacatggtgaaaatttgtctctactaaaaatacaaaaaataaaaattagctggacgtggtgccatatgcctgtagtcctagctactcaaggaggctgaggcagaagaatcgcttgaacccaggaggcggaggttgcagtgagccaagatcgtgccactgcactccaccctgggtgaaagagggagaatccatctcaaacgaaaaaaaaaaaaagaagaagaagagggcagttccccagcaaagcccctactctcaagcctggacacccgtggccctaaatgagaacaggcatttctgttttctctcccaaaaagttgccttttggcctgccatgtccctatcctgtatcccaggctccagaaaagaccagcagatgaggatataagacaagcagatgaacagcagaatgacacagcagagaaagagggaagagggggaatgtctgagtgctgagaggagttcggcttggggtggtcagagaggagtttagtggctgaatggtccaactccaagggaagatcatctttccactccatccccacttctggctccccatccattccactgagggccacctccaccactcaataaaaactcacattcgcttgaattcccagcactttgggaggctgaggcaggcagatcatgaggtcaggggttccagtccagcctggccaatatggtgaagcctcatctctactaaaaatacaaaaattagccaggtgtggtggcgcacacctgtaatcccagctacttgggaggctgaggcagaagaattgtttgaacccaggaggcggagattccagtgaactgagatcatgctactgtactccatcctgagcaacagagcgagactgcatctcaaaaaacaaacaaacaaacaaaaaaacctcacattcatccttcaagtccatgtgtaatccaattcttccaggacagtgggcaagagctcaggacacagaaagctgtcactctggccttctgcccttgcaaaaaggcagagagtccactgaactggttaacacttaaagccatgtgcagacagcaaggctaagacagcattgtaacactggggttgcaggcacccacccctagacactaccacagggccagagcccaaagcactggccccagcctctgcacctgcccatctgcatgctccccttcctgcaaggggtttgagcagtgatggcaactgaacaagtgagccacaaacctgttccatgtcctgcatgggggatcagggaactcttcagtttcatgatgacaagatgctctgagaagccatcatttaacccgatgcatgccggttggccttcagtttgctttaattagtttatcatcatgcttaaactggatatggagattcaaaaggaactaaggtagaaccaagcacagccaaatgaagataccctgtcataattttacaacttctgagacatcataattttacaacaaaacattggagatattttctggaccaaatcacagagaagtaaacccaaacagagcctggcagtcttcctcagctgtggagagaggtcagatttgcaagagtgggatagctggatttgtgaggcactgtcccagagaggagggagctacacagaggaagaattttagaaatcaccacagaaatccccatgagtcttttgggaccaaaagcaaacattaaaataagaataggcacacgaaaggcaggagtgcaaatacacttaacgataatcagtaatgactgtagtccctcagctacatgcttatcagtttttgtttagtattgactgttttctgtacattaaagggtgaaagaaaaagaaacattaaaaatgtgctgggtaccttctatgtgcaaaactttgaatgacagatttgattttaccatttcaaagaatagaaactagcaaacaagagtcaagatgagttgttcatatcttgcctgcagaaaaaataacgtgcttctttttgttgtagagccgaggagtctccctatgttgcccaaggtggtcttgaactcctaggctcaagggatcctcctgccttgatctctgaaagtgctgggattataggcatgagccgctgcacctggccaacaatgagcttcttaataattgttttcaatgaagacaatgaagggttgttctgaggaagatgctcacctgttctacatctcccctgcaagcaaatctaaaggcaaagagtgcagctctaaccaagtcataaggcatgccttcttgactctgaggctgtttagccacaagaactaccaagggactctaagtggggtcctgctattagaaacattaaatctaggactgaaaattgtctgtttgaaatagttatgtgctcatattaaaaaatgagaactgattaggtaaattgggagagcaaaagggcaagacaatgtctgttattgatgattttcagattgctgaattaaaatgcttatttcattcgagaagaaggatttaacagccaaaatcacacttaaccatgcatgaaaagagccactgttgaaaaatggctgataaaaatgattactcaattttaaaagcctgcattgtttaacgtaattgatgcaaactttagagaactgagtcagaattttgtaaaatgaacaagctcaatccaactaatacaagtgcagagtgccctttacaattttgaaagtaatacttgggtgtaaatgactacattggattacaagatactttaccacacaacttagaagatccttttgacatttagagcagaatgtatcaaacagcaggaatgggtaaagtgaaggacactaatacttgatctacatgttacgcttcactcttacaatgctctcatcactctttatgcaccttcttcatctacataaccaataagagtttcatataaggcagatgatgctactcgacatttggcacaggtagtacttataaataccttacaatttggcctccatctatgggattggtagaaagggcagattcatattcaaaaagtacactaactcatattaaatgtgttcagagttaggttcagtataggtatataaggcatgagtcatataaaaagtgaatgtatataaaatgctgcataagttataggaaaataatacaatgaagggtaaaatatataaactgaaactataaataaagataaactgtaatggccattaattgttagtgtacactaaattaatgtatatttataaattcatattaatagatgtacattaaattcacgtgtgtattgggggtagcgggagatcagaccagaaagggtgctagcagattgttgcaacttctttttgtttaatcatagtctctagtatcttcctctttggggggtaacaaatatattttaaaaaatcctttcatatttcattcattcagtgaatgagtttacaaaataaaattcttttcaatatgtgtttttagtcttattcataagggaaaacaaagtaggcagagagcttttcagattttaattctgtcataattacttacatgtgcaaatacatagaaaagtttagtcaaacagttaggcagctaattgtgttgaaaatacaactgcatgctcacaaagataatcaagcccctagggtgtacacttctgtttcagaactatttttaggccctcaggaacttcagccacctcttgactcctggaaaacaatgtcaaaatctaactaactgaatgtgacccagcatttatttcaaagcgacaacactaaatttgattgcaaagtaacagtaagaaattaaaagtttaaaagccagcaactgtgaatgttcaaataggaatgttcctgctatcaattttctacacatacagtgaataaattgtgttaaataaggaactgatgttcttcacagtagggaaacaaccatttattgcaaatcctaaatttgataggaaaatttactttcttttcttattctgtgtcaaaaaatatttttggaacatttaaaatgatcctgagattgcaattgtttatcactacccatgctaaaatagatacattaaggtgttaaggacctaaagaatttagaaatgtccttcaggggaaaaattcctgaaatttcattgtacatgtggcatatatttctttgccattgtcgttcaaattttgcattctagaatcaattaccctatcaattttccctcaaaaatattatctctaatcttattctctccctttaaaaatcttcaagtgcaattcttaggaccctataatatgattattaaaattttttccattgtgtatattgatatttagaaagagagtgtgaaaagaattgtgattggcttttaaataaattttcttaaaactgtatcatgaataatttgccataatttacattttatgtgtcaatttataaacactatgtatttgtttctcattttattatgtcaccttgcattataactaagatgttatctctgcttgtttcttaacttcaatcattttatgagagaaataccagttacttactcaggaaagatgatttgaaacatggaaaagaaaattatttcccatgagggaatgtcaataatgggaatctaacatcaccattcttttaatatttaatagatagccattcttttaatattgacattgtgccatgctaatattatttcaagtgtgatctctgccaaaaggtaggtgtctagggggtaagaatcaataatgacaacaatcttttatttgtaggcctactaagtgttacacattgtgctgacagcttttagcatattgtattcaatcttgataagaaagcttcaaggtgagcattattattgtcatgttataaatggcaaaacagggcttagatcattttcccaagttataaacctagtaagtagcagatgtgagattcaaacctagggatacatcatatttaaatgttagattaagtagtatcaagtggcagctaagacaagacacctgagcatgctgaagggtacctagctgtgatgttattgtgctcctctaccattataagtcattctgaatccttgtcaattcaactctttatttactgggaaaattctcacttttccttctaaaatcagtgcagctcagacttgtccatagagaagtctttcttgatgatcacaggatttctttcctgaaatctcacggtccattttattacttaagtctgtgtattactcaggttctccatagaaacagaaccattttatgtgtatataaatgaggaatgacccatgcaattatggaggctgagaagcccacaatatgccttctgcaggctggagacccactaaatctggtcgtataatttaacctgcatctgaaggcctgagaacccaggagaaccaataatgtaagtttcagtccaagggcaggagaaatgtgatgagacattccagctcaagcagtgaagcaggaaaaagagggataaattcatacacatacacacacacacatatatacatatatatatatatatatatatacacacacacatataaatataattttttttttttgagatggagtttcactcttgttgcccaggctggagtgcaatgtcacgatctcggctcactgcaacctctgcctccggaattcaagcaattctccggcctcagcctctcgagtagctgggattacaggtgtgtgccatcacactctgctaatttttgtattattagtagagatggggtttcaccatatcggccaggctggtatcgaacccctgacctcaggtgatacacccacctcagcctcctaaagtgctgggattacggggtgagccacggcgcccagccaaagagggatgaattcttacttcctctgccttttgctctattctgggacctcaatagattggatgataccaatcactttggcaggggtgattgtgggccttgcaatctactatactgagtcactgattcaaatgcaaatctcagccagaagcacccttacagtgtaacaccccaaaacaatgtttctcctgggcaccctgtggcctactcaaatgaacgcataaaattaactgtcacagtctataatggagtataacatgcggcactgcctggtacaccagtcttcagctctgtcattagaaaccctagggcttgaacatgtttcagggaaaaaaaaaaaaacctactacaaaagtactatcgtatgtcaaaataaaatgaaagaatgaacgaacagttgaacaatgggcgaatgagtgaatgtgcatcacacatagctggacgagaaaaatttaatacttttttttctcacagaaatagagttatatcaaatatacttgaatagtttctagtgttttcagactgaaaaattaatttcaaagaaactttatttactttatataataccctgtaagtcatgaagctcaagtaattggactgtaaattaaattactgagttacaaggacccatattacaagctattcctcctgctgtttttcatcagaaacgttcatatgatattgtggaattgaatttttaccatcaaataaatattgcatgcttggttaaatgggacatgattccaagctcaaaaaataaaatatagaacaggcaattcactggtcagttgtgaaatatgaaaaagaagtaagcacatatttcttttttttattatactgtaagttttagggtacatgtgcacaaggtaaaagtttgttacatatgtatacttgtgccatgttggtgtgctgcatccattaactcgtcatttaacattaggtatatctcctaatgctatccctccccccctctccccaccccacaacaggccccggtgtgtgatgttccccttcctgtgtccctgtgttctcattgttcaattcctacctatgagtgagaacatgcagtgtttggttttttgtccttgccatagtttgctaagaatgatggtttccagcttcatccatgtccctgcaaaggacatgaactcatcctgttttatggctgcatagtattccatggtgtatatgtgccacatttatcttaatccagtctatcattgttggacatttgggttggttccaagtctttgctattgggaatagtgccacagtaaacatacgtgtgcatgtgtctttatagcagcatgttttataatcctctgggtatacacccagcaatgggatggctgggtcaaatggtatttctagttctagattcctgaggaatcaccacgctgacttccacaatggttgaactagtttacagtcccaccaacagtgtaaaagtgttcctattcctccacatcctctccagcacctgtagtttcctgactttttaatgatcaccattctaactggtgtgagatggtatctcattgtggttttcatttgcatttctctgatggccagtgatgatgagcattttttcatgtgtttttcggctgcataaatgtcttcttttgagaagtgtctgttcatatcctttgcccactttttgatggggtggtttgttttttgcttgtaaatttgagttctttgaagattctggatattagccctttgtcagatgagtagatggcaaaaattttctcccattctgtaggttgcctgttcactctgatggtagtttcttttgctgtgcagaagctctttagtttaattagatcccatttgtcaattttgcttttgttgccattgcttttggtgtcttagacatgaagtccttgcccatacctatgtcctgaatggtattgcctaggttttcttctagggtttttatggttttaggtctaacgtttaagtttttaatcaagcttgaattaatttgtgtataaggtgtaaggaagggatccagttttagctttctacatatggctagccagttttcccagcaccatttattaaatatggactcctttccccattgtttgtttttttttttttttttttttttttttttgagacggagttttgctctgtcgcccaggctggagtgcagtggcgcgatctcgactcactgcaagctccgcctcccgggttcacgccattctcctgcctcagcctcccgtgtagctgggactacaggcgcgcaccaccatgcccggctaatttttgtatttttagtagagacggggtttcaccatgttagccaggacccattgcttgtttttgtcaggtttgtcaaatatcagatagttgtagatatgcagcattatttctgagggctctgttctgttccattggtctatatcttcgttttggtaccagtaccatgctgttttggttactgtagccttgtagtatagtttgaagtcaggtagcgtgatgcctctggctttgttcttttggcttaggattgacttggcaatgcgggctcttttttgcttccatatgaactttaaagtagttttttccaattctgtgaagaaagtcattggtagcttgatggggatggcattgaatctataaattaccttgggcagcatggccattttcacgatattgattcttcctacccatgagcatggaatgttcttccatttgtttgtatcgtcttttatttggattcctaggtattttattctctttgaagcaattgtgaatgggagttcactcatgatttggctctctgtttgtctgttattggtgtataagaatgcttgtgatttttgcgcattgattttgtatcctgagactttgctgaagttgcctatcagcttaaggagattgtgggctgagacaatggggttttctagatatacaatcatgtcatctgcaaacagggacaatttgacttcctcttttcctaattgaataccctttatttccttctcctgcctgattgccctggccagagctcccaacactatgttgaataggagtggtgagagagggtatccctgtcttgtgccagttttcaaagggaatgcttccagtttttgcccattgagtatgatattggctgtgggtttgtcatagatacctctttttattttgagataatttattgagagtttttagcatgaagggtgtagattttgtcaaaggccttttctgcatctattgagataatcatgtggtttttgtcattggttctgtttatacactggattacgtttattgatttgtgtgtgttgaaccagcctttcatccccggcatgaagcccacttgatcatggtggataagctttttgatgtgttactgtatttggtttgccagtattttattgagaatttttgcatcgatgttcatcagggatattggtctaaaattctctttttttgtagtgtctctgccaggctttggtatcaggatgatgctggcctcataaaatgagttagggaggattccctctttttctattgattcgaatagtttcagaaggaatggtaccagctcctccttgtacctctggtagaattcggctgtgaatccatctggtcctggactttttttggttggtaagctattaattattgcttcaatttcagagcctgttattggtctattctgaaattcaacttcttcctggtttagtcttgggagggtgtatgtgtctaggaatttatccatttctttgagattttctagtttatttgtgtagaggtgtttatagtattctctgatggtagtttgtatttctgtgggatcggtggtgatatcccctttatcattttttattgaatctatttgattcttctctcttttcttctttattagtcttgctagcggcctatcaattttgttgatcttttaaaaaaaaccagctcctggattcattgattttttgaagggttttttgtgtctctatctacttcagttctgctctgatcttagttatttcttgccttctggtagtttttgaatgtgtttgctcttgcttctctagttcttttcattgtgatgttagggtgtcaattttagatctttcctgctttctcttgtgggcctttagtgttataaatttccctctacacacttctttgaatgtgtcccagagattctggtatgttgtgtctttgttctcgttggtttcaaggaatatctttatttctgccttcatttcgttatgtacccagtagtcattcaggagcaggttgtttagtttccatgtagttgagtggttttgagtgagtttcttaatgctgagttcgagtttgattgcactgtggtctgagagacagttttttacaatttctgttcttttacatttgctgaggagtgctttacttccaactatgtggtcaattttggaataggtgtggtgtggtgctgaaaagaatgtatattctgttgatttgaggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtctctagggacttgctttatgaatctgggtgctcctgtatgtggtgtatatatatttaggatagttagctcttcttgttgaattgatccctttaacattatgtaatggccgtctttatctcttttgatctttgtcggtttaaagtctgttttatcagagactaggattgcaacccctacctttttttgttttccatttgcttggtagatcttcctccatccctttattttgagcccatgtgtgtctctgcatgtgagatgggtttcctgaatacagcacactgatgggtcttgagtctttatccagtttgccagtctgtcttttaattggagcatttagcccatttacatttaaggttaaaattgttatgtgtgaatttgatcctgtcattgtgatgttagctggttattttgctcgttagttgatgtagtttcttcctagcctcgatagtctttacaatttggcatgtttttgcagtggctggtaccggttgttcctttccatgtgtagtgcttccttcaggagctctgtttgtcaccaccaggcctggtggtgacaaaatctctcagtgtttgcttgtctgtaaagtattttatttctccttcacttatgaagcttagtttggctggatgtgaaattctgggttgaaaattcttttctttaataatgttgaatattggcccccactctcttctggcttgtagagtttctgccgagaggtcagctgtaagtctgatgggcttccctttgtgggtaacccgacttttctctctggctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcctggataatatcttgcagtgttttccaacttggttccattctccccatcactttcaggtacaccaatcagacgtagatttggtctttcacatagttccatatttcttggaggctttgtttgtttctttttattcttttttctgtaaacttctcttctcgcttcattttattcatttgatcttacatcactgataccctttcttccagttgatcgaatcggctactgaggcttatgcatttgtcatgtagttctcgtgccatggttttcagcatcatcaggtcctttaaggacttctctgcattggttattctagttagccatttgtcaaattttttttcaaggtttttaacttctttgctatgggttcgaacttcctcctttagctcagagtagtttgattgtctgaagctgtcttctctcaactcgtcaaagtcattctctgtccacctttgttccattgctggtgaggagctgcattcctttggaggaggagaggcactctgatttttagtgtttccagtttttctgctttgttttttccccatctttgtggttttatctacctttggtctttgatgatggtgacgtacagatggtgttttggtgtggatgtcctttctgtttgttagttttccttctaacagtcaggaccctcagctgcagatctgttggagtttgctggaggtccactccagaccctctttgcctgggtatcagcagcagaagctgcagaacagtggatattggtgaacagcaaatgttgctgcctgattgttcctctggaagttttgtcccagaggagtacccggccatgtgaagtgtcagtctgcccctactttggggtgcctcccagttaggctactcgggggtcagggacccacttgaggaggtagtctgtccgttctcagatctccagctgcgtgctgggagaaccactactctctttaaacctgtcagacagggacatttaagtctgcagaggtttctgctgccttttgtttggctatgccctgccctcagaggtggagtctacagaggcaggcaggtctccttgagctgtggtgggctccacccagtttgagcttcccagccgctttgtttacctactcaagcctgggcaatggcggggtgcccctcctccagccttgctgctgccttgcagtttgatctcagcctgctgtgctagcaatgagcgaggctccgtgcttgtaggaccctccaagacaggtgcgggatataatctcctggtgtgctatttgctaagaccattggaaaagcgcagtattagggtgggagtgacccgattttccaggtgccgtctgtcacccctttctttgactaggaaacggaattccctgaccccttgtgcttcccgggtgaggcaatgcctcaccctgcttcggctcatgctcggtgcacagcacccactgtcctgcacccactgtccgacaatccccagtgagatgaacctggtacctcagttggaaatgcagaaatcacccatcttctgcatcacccatgctgggagctgtagactggaggtgttcctatccggccatcttagctccacccccagcacatatttcttcttacctaatttgattacccaaaattttgccaccgtttgtctagtcatttaataataactttggaatctttgcttatgtaaaaagaattgcaaagagttaataacctctctatcctccaggaattattgcatagtttaagacattccttattaacatcccacaagaatttcccagtggcccacaatagtctttcttcacacaatattttttgtaacattgtctattctataattcattatttttataatttgattatgttttctaatattccaaaaatttcacatctacttactttccaataatttttttcaaaattaagtccaaaatcattcacactgaatatagtgctgagtataaacagggcctaattaattgggttgaaaaattctctcatagctcttatagcaatgcttctcaaagagtggtccagggcctccaggggggccttgagaacccatcagaagatctgtaaagtcaaactatttttgtaataatactaagaccttatttgtctttttcactgttaggctctcatgagttaactgtggatttttttccagaggctgcatgaagtgcagtataacagattgactgcagaagcagagaggaaaacccagatgttttctattgagccaaatcattaaatagatttgggaaatgtaaaaaaatgctactcttctcattattttgtttctaaacatatatttatttttcataaaaatattgtttatgttaacttctaatgggtttatcatagttattggaaaaattaatttgtaaacaaatttttaaaaaatatgtcagttttagtatctaatacagaaaatatcaataaatttaatctgcatacgaaggctttttgtagtcttcaataatttttaagagtgtaaaggagtcctgagaccaaagagtcttagaattactacttttaagcatctcaaacggataagtacagatacacttatttggaagaatagcaactactatttactgcatttgtccaaccagctggccactttatacacattacatcatttaatcctccacagtgctatgagccagatattgtgctcctctctttttgggaaagaaatctgtggctcaggatgatcaggatgttcctctaaggtgataagaggaagcactggactttgaaccaggtctgactacgttcaaacttcagattcttaatcattaccctggctcagtctcaaaaaagatttaaaaacttgttgcatgagcacatgaaaagctgatcaacatcaaaagtaattaaggcaatacaaactaaaaccctaatgagatgtcatttcatagccactaaggtggtcataataaataatctagacaataataaatatgaacaagaatgtaaagaaatgaagaaaccttatacatcactgatgggaatataaaatggtgcagccactttggaaaacagtatggcagttctgaaagtggaatatatatgtgagttaccacatgacccagcaatttcattcctaggtatctatataagataaagataaatgaagctatgcatagcctaggtatccatagctaagacaaataaagtatatgttcatgtaaagacttgtagagaaatgttgataacagcattatttataagagcctaaaaatagaaataaccctaaatgttcatcagtttaagaatagataacataaaatgtggtatatctgcacaatggactattattcagccataaaaaggaatgaagttttgatatatgctacaccaaggatggacctcaaaacattttgctaagtgagagacgccagtcacaaaggaccacatgttgcataattcgattatataagatgtcatagaaaggcaaatttaaactcaccaaaagtagataattggttgcctgggcctggaggtcggaaggattaatagcaaatagacataagagttcttattgtggtcatgaaaatgctcaaaaactgacttatggtgatagttgcacagctcagtaaatatactaaacatcactaacttttattcttgaaatgggtgaatatgatacacagaataagcctcaaaaagtgcttaggccatttggaaagatctctttttaacagttactgaaggaacatacagtagttaaagaaataacatagtaattaagtgatagtaaagaaaaagctgaaaacttggtgactgaaagcttaatagagattagggagtcagtgcaagaataagatcaacacagaataaacaggggaatgaaaacctaaagagaaaagagcaaggaaggatgagacaaagatcagggaggcaggttgttaactgtgatttcacagttctaaaaggaagttggaactgagcagattagaacagtctttgtccaaagcaatgtgaaaatagacatcaagacccttaatttttctttcctttgacccaaggatttatactgtgaaaatttatcctaaggaaattatcttaactacagaagaaaatgttacgcatgaaataattttaaaaaataaatccttgccattgtttacagtgtaaaaactaaagaatacctaaattctttaagaaaaatagtgaagtaaatcactacattcacatagtgaactattaaacaataattaaattgatgttaccaatgagattgtgttcagtatcttcatctgtaaaggcgataatattagcatctagctctaccaacaaaaatctatgtattttttgttgagagaattaaatgtagctaacacatatgaaacatgtgcattcttaaacacagtgagcaacacatggtaagcgattatttaaaattaatctctgttattaattgacagaaactgacacatgggagaatcaataagggattagagtaaaacaatttagctagctattaaaagaacaataatttttaaatcatttatttattccaaagcaaaggagagaaaaatatggtacttttgtgaatatctaaatcaaactttaatttctatattataaacataaaagtctgattgttaaatcttagaaatctttcataaatcagcagaggtaataggttcaccaattatgaaatttcttctttgagaagattaaaagaagaaattgggaaagagaaataaacaattataagctaaaataaaaagatagataaagacagtaaaggaaagattttaaaagctcagccagggttaattcttatgtcctacttggtttcctaacccccaaattccttttatttctacagacagggttacagatagttcctgctacttgagtgccgtctaatgtcccaattcctatctttcctgtagtgaaaagggaattttaaaaatcagttctcagaagggtcagagttgatttaatcttattcataatccagctctgaccttgtgttaattctagtaactagacttctggtttacctatgagattaagtcaccattttctacttcatttcaataattgaattctttattgtcagatttcttgagtggctccctgcttctaatacccataatttgctggatttatcttgctagaatcccatggatctcatctttgaaatacagccgagtggatggagccttgcagacatccctcatgcatgatacttatttgacttcataattaataatacatgtactaatgttacccaggattgtacacacctgttacatattaataaaaaaggacagggttatatttgtgggtcttggttgacacttagagcttgcctaaattgtcatctcttgcctgtcaccatatactcaagaaactcaacttcccttgcctgactagctttcttgacttacaatataggttgttacatctccaaaacaatacttatagcatccaaaaagtcacattcagtataaaaagtgtcaactctactactgaatttttccattgcagataccaattctatgtcaagttccagagataaaaattgagaatcagagagtcagagaggtcaaggagacacagctaatcccttgggtggttatacctaaaaacctaaaatctaaactctaatttagagatggtagagctgtttgtttgttttacgtactccactagacagatagtatagagtgtatatatgtttagaaattttctatatttgttttaaatattactatgtctgaagacaggaaggagcctatactatttacatgattctattctaataagattcattactactaaccctatttaacagttattaagcaattgcagtaattatggttattcatatttcaatacatgaaatattattaaagatagtgtcttaaataatatctcatatttatcatttgatgagaaattttaaatacattattagatttaattttcgtaaccatcctgagagatatacggatgagatattcttacccctgtttaatagataaataaaatgtggcgaaaaaaaggtgaagtaatatccaaaggtaacattatttttattttaggtataatttgaactcagatctgcagactcgatatatagtgttggtagtaaaaattatgctcctgtctctataatgtatttttaatggaattttagaagttagcattatgctaaatggaatcagattaagaaacatacctctgtctaacattgaaacagactccaaatgtctttataatgggcaagtggatacagattaagtgccatgaactatcatcatcctaagagtcttacttcctttcatggtgattgtcagggatgcttttctgagattcaaatattctcatggatgagttaaaagaagatgaaacaagatgataaaaccagtctcttttcaagaaaccataaacatgttagcaaccatcaaatttctttacgccctcattctagtaaattataagctatcaaaactgcacacgttctgaaagtttactaaatgcaaataaaatagtctctttgccatgctgtaacttgagataataaaggacttaaataaattcagtgaaagcaaaaccccatatgtttgggtgtcagaggctactttgactaagctcatttcaaattataacatcagcaaaattaagctattaaaactacaaataaaagagtatttttagttctaagaagaaataggactaattggatacacatatgcctcctaggctgtatatcttaaatgtgaggctcatcagtagttattattaaagttggcagaaataatggacatagtaaattgtactttagatttttctttatgcacaattgcttggtgttatcttcttaattgagtcacagaataaaatctaagaaaacagatgtaaacacacagacattaaaatgcatcactacttttgcctttaccttttcatattggttttcgaagtgatgcatggttaaatgaacctaatttgagagaaatttggagatggccgctgagtctgtgtgctggtcagggggttgctttctactgttgatattattctttgcgtattaacctcagaaggggaacaatatatggaaatgggatagaaagtcttcagaaaccacagtaggaagattaatattcatagcacatttatgaagtaggcatcattatgtgtgtgtgtgtatatatatatatatattcacatatatataatttttgaaaaattattttacagataatgagtttgagatacaaggatggtttataacttacacaagatcacacagatttcaatattctaattctaattcaattttttctaattcttagttgcatgtgttagtccttatctaggtcttagaaaattacacttcttttttgcaatagtccaaatagtctaaaccgtacttagcatttagtgttcaaccaagtttcttgactatgtcagtaaaatgtgctggctttaaacgctgggatcatgtcatcatcactgtttcctcagagcccaacaaaatgcctggcacatatcaggaacttcataaagagcattaaatgaatagataattgaggacatgaaaaatacatccatttattcatttagaaaactgtgtgtatttataaatgacagcattccaagtcacacatatttaaacttatgaaatttctagatggtttaaatttataattaatgtaaaaatgaggaaggacagagaaaacattctttgtatgcaaatattattatcttctacatagtcaataagattttagaaaacaatgttgcatagaacatatgaaatatcaattgcttactattattgtcaataaaggagagcttctcttatataacattcattataaacatctgtgtgtaaggaaagaaattagttttgtgctataaatattggtcatataattcattaattccttcatttattcactaagaggaatggactactttaggtaatgttgtaatataagccacatcacaggatcctttatttctcttcttcaatattctgaatttattccttaatattcaataatttttggaagatattatctttgtcgtattatttgttcaatgacaactatatgtaaagaattatttggaatatttgctgattgaaaactatgtgcaaagggcagtaagaatcttttcattgttttatttaattctcaacaaatataacatgaggtcaccatttcacatatatgaatactgaagttcagaaagtttaagcactttgcctaaagatgcaaaaccagtcattggcagagtttaaagtctctggcacattgacaagccctctcaatgtggagaaaaaggaactcataagctgttggtgggaacgtaaactagtacagccactatggagaagggtatggaagttcctcaaaaagctacaaataggaccccaatatgatccagcaatcctggtactggtaatttatccaaaagaaattaaatcattatatcaaagagacacctgcactctcatgtttattgtgtcattaatcacaacaggcaagacatgaaatcaacctaggtgtctaacaacagatgaatgaataaagaaaatgtgacacatatacacaatggaatactatttagccataaaaagaatgaaatcctgtctttcacagtggatagaattggaggattaggacattatgttgcgtgaaataagccaagaacaaaaagttaaacaccacactttcttactcaaatgtggaagttaaaaaaaaaaagttgatctcatagaagtaaaagaacagaggatactggggctgggaaaggtcaggggaagggagtgatagggagagatttattagaggatacaaaattccagctagataggaggagtaagttctagtgctctataccactctaggatgactctagttaacaataatatatagtttcaaatagctagaagtggatatttaatgttcccaacacaaagaaacgataaatctttgagatgatggatatgctaattaccctgtgcattactatacattatatgtatcgaatcatcactatgtactcataagtatgtgcaattattatttgtcaattaaataaatttaaaaagacaagccctctcaatcttcaaattctataatttttactcttcctctaaatctctataaaattgattgtaggctgggcataggggctcatgcctgtaatctgagcactttgggagggtgagactggcagatcacctgaggtcaggagttcgagatcagcttgaccaacatggtgaaaccctgtctctactaaaaatacaaaaattaaccagacgtggtggcggttgcctgtaatcctagctactcaggaggctgaggcaggagaatcacttgaaccccagaggcagaggttgtagtgagccgagatcgcaccattgcactccagcctgggggacagggcgagactccatctcaaaaaaaaaaaaaattgactgcaatgtgtttttgttgttgttgttgtttgtttgtttgagaaagagtctcgctcttgtcacccaggctggagtgcagtggcgtgatctcagctcactgcaacctccgtctcccgggttcaaacgattctcctgcctcagcctcctgagtagctgggattacaggcatgtgccaccatgcccggctcatttttgtatttgtagtagagacagggtttcactatattggccaggctggtctcgaactcctgacctcaggtgatccgtcggctttggccaaccaaagtgctgggattacaggtgtgagccactgggcccagcctgtagtgtgtatttttgtatgtttctaattttaaaaatcaaaaattgaaattcctgccactgtttacttaaataaacctaaattagataccactacccttatgatctaaagtcttctctctatggtcccaaacagtctctttatgaaagtttatgatttctatagaaggaaacatccttcagacgaactgaccaatggtactggcaatagaggcatctgatttagaaagccagttggtataaatatggccttatcatattcctgccttcctggttctagaatccccagtgtatacaaatctaaacatgaatgctttcttgcccacaagtataaagcaaaaaatgtttcctttctggaacctaaaggtatacaaaaattctagtccttcattaactatatttaatttaataattaaggaaacatattaaaaagctaagccacaggtaatttcaaaataggggagagtaaaactcaggaaagagaggagcaagacttatctttattaaaggtttatcataaattagaaaaaatatggcatagtctttatattttcaggcatagaaattttgccggcattctgaactacaaatgctgctgttaagataattttgtcactaaacaacaatatgtgatgggaacaaagcaagatgccaggagatacaataaaggctagaatgtagtttatagcaaatttggcccactgcagtggaattggtaaatggcttctggaaaatgtatagcatcataaaaaaccccaaagccatgtttcctctgaaaaatgttaaacaaaggtttcaaacataaaaatgctcatttccatattgattttgatgaccagcgttaaatcaggcagtgtgaatggctgatggactctgctcctctgtgtcattattctaccatttcattctgaagggaattactgtatagatggcagtttgaaacaattttcaagcctctagatagagggttttattttttttctctaaataaatgtaaacaattcttttctgagaataactgtacccaaagaaggtggaaacttgggaattcagtatgattttaaagaataaaggtgttatttcacttgggtaagtattatttggttgaattcttcatgatatagcaaaataatttttgaaaagtccctttttataatgacaagctatgcatacatttctgaaagcagcagaaagtttctgaatcatcttgaaatatcccacatctgaaataatggcgtggtggctcacacctgtaatcccagcactttgggaggccaaggcgggtggatcacctgaggtcaggagtttgagaccagcctgaccagtatggtgaaaccccgttctctactaaaaatacaaaacttagctgggagtggtggtgtgcacctatagtcccagctactggggaggccgagacaggagaattgcttgaatctgggagacagaggttgcagtgagccgagatcgcaccactgcactccagcctgggcaacagagagagactccatctcaaaaaaaaaaaaaaaaaaaagaatatttagttggaaaccattgccttctgttctcatgttagaaagaatgtggaatacatcctccaatttgttgtaatataggaaattaaattgaatagtaagtatgtgtgtgtgtatatatatatatatatatatatatatatatatatagagagagagagagagagagagagagagagagagagagagaaagagagacagagacagagtcttgccctgtcaccaggctggagtggagtggcatgatctcggctcactgcaacccacgcctcctgagttcaagcaattatcctgcgtcagcctcctgagtagctgggactacacacatgcaccaccatgctcggctaagttttgtatttttagtaaagacggggcttcaccatgttggcctggatggtcttgatcttttgacctcgtgatctgcctgcctcggcctcccaaagtgttgggattacaggcgtgagccaccgcacctggccaaatagtaaatatattcataacaattaaaaacacttgtttggtaactgctctcacaacataaattttgtatgaccagtaatgactggattagagacttttgcttgcagctatatggtaggatagacaattctaattacttgatcctaataacttacttaattacctaataacttacatgaaacgttatttttatcacatttctgggctctcagtaagtaaagagactcattgaaggtgttaggttggggaaagagttgtaaccaagtgtgaaagacattgggcatctagacttgagtggaaaaattgaggtgatgagattaagaatcttgattatacttgggaccctggaatggggctaatgtggtctgagatctgcagatgtgaatataaatcttcggtagaaaaaaaaaatgcctcacaaaaagcagcaaacaacaaatatcagatttacatcctgaaaaaaattcatgtactagagtgatctaatatagtatttctctttctttgtctatagatagagatatggaatcataaaatcagaaaacaaaaataatcatcaggcaaattcaataaatagtagaaaaaaatatacatgtcatttcctatgggccaaacattttataagtttcaatacattaaatgatttaattctctagttattgtctaaggtaataacaatttccatatttccattttatttatgaaaagattgaaattaaaggaagttttatgtcttattaagagccaaacaggctggatgccatggctcacacctgtaatccaagcactttgggaggccaaggcgggaagattgcttgaggccaggagttcaagaccagctggggcaagatttttgtgagattccgtctctacaaaacattttaaaaatgagtcaggtatggtggccacatctgcggttccagctattcaggaggcttaggtaggaggattgcttgagcccagaaggtagaggccacagtaagctgtgatcctgccactgtactcttgcctgagtgacagagtgagaacctatcttaaaaaaaaaagcagacagcaagaatctaccaaatatctaaaattgaagaaatatatatgtttaaaaaaagttaacaaatggatgaatcatcatatcatacacaactgaagaaaagattagtgaattggaaaagttatctgcagaaattatctggattacagtacagtgaaacaaaggcctggaaatacataaatctgaataaagaatatggtggatagaatgagactacccatcatgtatactgtcacatgctcaggacgagataatcgagataatagaataaatgacatatttgaatagaaaatagctaggaactttctgaaacttgttagagacatgagttcacaaacaggaggcaatgatatatacctccaaaacagtataaataaaaatgaatccgcacttagacacaccttagtgaaactacagaataacaaagacaaaaaacaaccttaagaatactaagaataccaaatcatgaaagacaatcaggttggcatcagattcagaaaggaatcctgactcttaagcctcttctcttcctgtctactctttcttcagtctttcttgcaaaaatgaaacacaataacttcatcttagataaaatatgatgttagcattaattagtctatatatttttatcagtcttagaatagtggctaaaagaacaggctttgaacagcagatttgcattttgctatcaaccctataatttaattagccgattattagcttaaatataatcaattcacataatcccactgagactccatttcctcatctgtacaatgcatattattccatgtactgcatagtatggttgtgggattgagtgtgataatgtatatacaatttagcattcttcttggaatgtataaaacaatacagggaaactatcaggttgaatcatatgaaattatcttgtaggtcaaaaaagttgaatatcagtcatttcacttgggtcaacttaatagtaaattgtggtttcaagttgagaaagaatcaagtttacttttaaattcatatacaaaaagagacatacattttaataaggaaaagaagctagtttacaatcaatcttgcctcctacaccattatagtctgtaggttttactctacgagtgtccgcttgttgatgatgtgatgtaatctaccagaatctgacttgaatagaatatttaataagttgataatcatataactacttttatgattagaccatgtattggctgctcaaataacaaaatttcctggtgcttctactggtaccaggggatttatggtttaggcataagatttaggcttgcattttattgtgactattctaaatatttctctgatgtgtcaggtagtcctttaaggtggccaccatgaccctttcttcctgagtttgtgacttgtttgtaacaaacagaaaacggaaaagttgatgggatatatttgattacatgttcgttacttcacaattcgttacataagattatatttcttgtcctgatggagtctctctcttccttgatggcattcagaagacaagcaactttgttggggaaatcatacagcaaaacctgtgggcagcctctaggagctgacagtggcttttggcagatacaaagaagaaactgaagccctcactcctacaaccacagggaactgaattccgccaacaacctgaatgagcttgaaaaagcctcaaatgaatccacagccctgtctgacaccttgattgctttctaagactccaatcagagaacacaactccaatcagaggacacagtaagccatgcctggatttctgacacacaaaaacccacatgtgagtattgttttaagctgagaactttgttgaaatattaataggcaacaatgattaacaaatatacctggaaaataaagagctatcatcagagagtggctcatgaaggaaaagaaaaagcaggttattctttccaaagccattcacaaatttcacaactacgctaacttttctattttgaaacagttgcaatcttaagaaaattgaattatcaggatgatctttaaaagtaatcatttccatgagaaaaatacccaaagagattcaaaatccagagagtatgacatgtgcagtaacaagtttgagagttttttttgtacaagaataatgttgaaataaggtggttttatggtcataagtacagtttttaaactgcaactttaccattaaatggcttaatcaaaactaaccaaaacaaatatactcatcatttactcttcagaatatcacatacctagcttctcagtcaccccatcaccaatggctttgatcctgcagttttctttagaggcagtttacagagccaaagaaaaacaaatgagtggaccattactaatactcttcaactgcacaggaatcacatttcctctattatagcaacgtaacacattggtgatataaagttatatcattcagtgtaaaggattattctgtgatttttagtatatattgttctagatagcaggcataaattgggtactttgttgagaatctgctgcccaagttaactgcaatatcctctttcgttaaatacttcaaagtgtcttaattggctcttctgtgaacattctgggctactcactgaaagacacataagactatacatggaagcaagaatcttagaggaagcattcaggacagagaagggaaaggaagcttgctttttgctgtcactgcctaggcaaatgatagagcttcaatttgctctgagaaagagaaattttgattatactttttagcatttgtccacaaacaagaagcaaaacttagaaatatgttcttttcccaatcaaaaatagaatgttgaacgaatttatctgagtaagggcaagagatacatttcctgactccatagtcaatgaacacaaaataaatcaaaacgtagctccagaaaaaaaaaattggggaagaaattcccacatcttattgaaaaatgatgggaaattggaaaggggctcctgaaaaaaaaaaaagcctggagaaattgctgaagggtcaattgggaaaatgcttattttcctcttatttcagggcaacacatgacagaatcaatgtcatctcaagagattccagtagctgaatggtttatttacatattaaacacaagttggaggaatgagtttggtctttgagtatcctgaattttacactatttacacatcccctcttgaggttttacttagtgtactgtaaaggcaaacaaagccttgtctatccacagaaggactcctccagatcctatgggaaagatccaagagctttgttaaacaccaaatagtctttaaataacaatcttctgataacttgatagtaaacagccatactttagtgatttcctagtaaacataaattaatatactatatcagattatttggaaagatcattattttctttgaaaataaaacaaaaacaaaaacaaaagtctgtaattttgtgcacagacccaacaatctcatttcccatttatgacagaattcagtgaatcatgcttctacaacacattctgcttcagggcacacatctaaaaattaatctttctgaggatacagtaatcatgaccactccggtgtcaattactgtgtatggagaatgtactatgtgccaagtgctctgctatttcattcaatatgtagaaggttattacaacaacccatgaggttgctgtaagtatttcctctaatttttcagataagaagacttgggctgagagaagttaaataacttacctacaatatcagaataaagttgggatttgaatgcagacaatctgattcctgagtaccattgttaaatagcagatattaaaaaaaatgtgagtcagtgttagaaactgaataatatcatcttacatttattcaggaacatttaacaatatgattgcttaatgagattcataattttactgcaatcaaatgctgcaaaactcaactcctgaattagatttacggtatgctgcaagtagatggttaaaaacatgatcacattgtagatatttacaaaaataaatgaataaaaataaaaatttgcactatcatgtttagtagcatggagaatttggtatgggaaggtcaagacaacttcctagtttgatgagttttgtaagatatttcctaattaagtgtgtgaaattttcatcatgtaatattaaagatctctcatatacaattctgcacaaaaagaggtctgaaaatctgaattattttatagtacaaataacacaaatgtagttgaaattagcaaatgtttagtgactattatatgccattaagtatatcaatttcacatgcatccaaactttaattttactgtccaggaggtgacaatatataataataaaaataataataattttaagagtcatgaagtaagtactatatgccagaatgaaagggagaagcactaaagagatggaagatttcattctgacttagttaagatggattcctagagcagatgtcacttggatgggtttttaaatagtagaatttcaacaagcaagcaagaaggtatcaaatggaaggaatatttcattatacttagtaggtaacaaggccccagcagtcagactgaagactcaaacatacatgggctctttggggctaccctccctccttgtatctcatttcataaattgattttcaggcagagcctctttagtggggaaggaacatacacaatgaactattgtgatcaaaacatagacaaatgtgcatgacaaattggtagagataggaggaaccaaatattgaaggaagatagagatagttttccaagaacattcataataaaggaagaggactagcagtaggaagcaaatacaacaaatggggtctgaaagatgaaggaaaacagtggttctcagcactgcattgcgatagggccttgaactcagctaaacccatctagcctaacaccattgtatactttggagtgaaaaagggctgtataataaattgtgtcattaaatgtggccaataatcctatcatgaaattcccctaattggcacagagactctcacttcttaaggtgccattgagttgttttaactgtgaacatagggatgaaatgaaaagagagaagcaaatcacgtaaagatacttaacaatataattccattttataaatctcaaaaatgtacagctacattagatattatgcactatattcttatctggcaaaactatttttaaaagaaataacaaacaaacaaaagcactcattagtggttatcttggggaggcagactgtggtgaagcaggaagaggaggtcatcaacgaggggcactaaaggggcttccaaaaatgaagcaagttttatttctcaagctgagccataggtaaatgggtgattattttattatcattatgtaatctttcatgtatgatatatttcatcataaataaatattgattttaaaggtagccggttttatctttaaatgatatatatatgcttctctaattttgtgtcctactttttattcctgtataatatactctgaaaactttccaatttcattaaaaattcctcagtaaagcatttttaatgtttggaacaaaatctattaaaatagaatagattcatgatatatattgttgggtactttcctaattttcattgctacagtatcagattcatttccattataaaaccagtgactgcttcagggcccacagaaatgggcacaattgtaaattcagtaggctcaaatatatatttttaaaaggctatgtttgtacatctttcttagcctgttggatgcgcagctcactgtgttgaggcagacatctgttggtatgcacaaaaataaaatattgttgtcttgtttttgtatttttcatatccagagaatcaagtcatagcttttgcctgagggagaacctcaagaaaaatgaactagtgtgacgtgtgtttctgccaagcagaaaagaacatggaagtaaacttatctacataaattaggtcagacagctggtccgagtctgcccactcagcctgctaggggagcaaccaagcaaaagttaagattgccaatttgtttcattttgtttccctctggatttcaggagttgatgtagaaaaaaaaatcaggaaggaggaactggagattaatcaacccagggatagtttttgtaacaggggaaagggatcgctgagataaatctagggagatgaaaactgggtttagaatatttgaggaggctttttgttttgtttcactatgcaaatggggaaagagtaaaaaaaaaaaaattaaaaacacacaaaatctcaaaaatgtgaatagtgaggaaaaataatcatccatatgggagtatccgtgacatttgtaaaaattccgtgaacacggccagacgcagcggctcacgcctgtaatcccagcagtttgggaagccaaggcaggcagatagcctgatgtcaggaggtcgagaccagcctggccaacatggcaaaaccccgtctctactaaagacacaaacaattagctgggcatggtggcgggcgcctgtaatcccagctacttgggaggctgaggcagggagaatcgcttgaacccgggaggtggaggttgcagtgagctgagatggcaccattgccctccagcctgggcaacaaagtgagactccatctcaaaaataaaaaaaaaaagtctatgaacactaaaaaaaaaaataagagtcccttgttagtctgtgtctaaaaaagaaactagcactggctcttgaaacaacatcaaggtatcaagctctgcttccttctgtctcataaagcacattgttctgaactaccttgagatatcaaaaatgtgtccaaaaacagttgaaaatctgaattattataactaaagggttatcaggctcaaaggaacctgagtttgagggtgggtcatctatttgcaacaaaatatttagaagtagttgagaatctgtcttttagagtaagtggatcgttgaaaatgcctcctctttttgccatcctcttcacttgggtaacgtccttagcctttttggatttaggctttcacttcatgtgccctgggaagtcattctagacctcattccattaggacctagacatccattactctaagtctgtcactgtgggctctctcttcccgaactaactgtgagctcctgaagaatacatactttgtacatcatagcatctcaccacccagcatagtgcctgatgcataataatatttgttgaatgaaaaatcactgaaatagaaagcatatgtataaaaatgttagttctagtgtactgggattcaaaggatcatcatgatctacacttatcagtcttaacttggaattaccagaaagataggctcagacatctgcaactaatattatttttaaagaataatcaaatattcagacaggccaggcaggaatacacacgctagacaggcttaattctggtgtggcgttcatcatcaaacatacctgagagtcatgacaaagtgagtttggttaagtagatatacgatttaaaagaaatacaacttaactgagagctcattactgagtattagtatgtgtaagaaacttgcatttaaaggtactctgtggcctctgtgtttatgccaattttggtagcaagcccattttattgtaggaagtcactatttcatggatccaccatttaactgggtcacattgggaaaattattttatgcaaatctttaaaatgaaaataatattatgctcatagggctgttaccaggattaaatgtaatggcaaatgcaaatcacctagcagtaccttcgatacattataaaccctccacgaatgacgcttccctctaacccttgagaacaatatgtcagtagcacctacaaacataaaataggatatctcttttaattgattgtaatttccattattatgttatttttgctatggaataggaaactctttatttttgaatttttacactgtttcatatattctagatgcaacatttttgaggagtatgatatgatatgcaaatattctttcccactctattatgacttttcactcttttaacagtgcctttcacagaggattttttttaacttccaaggaaatcaaattataatttttttatgtcattacttggtgttgtatctaacaatgccaaaccaaagtcacaaaaatttatcctatgttttcttttaagagttttctattgtaatttaaagctgttatctaatttgagtcattttttgtatataatgtaaggcataagttgaggttcaatgtctaaattgttccagcaccacttgatgaaaaggctagtctttctccactgaattatcttggcatttccatcaagaattgtttgatttctgaactttccaaatgacctcattgatctatgtgtctactcttttgcaaatatcactcttaattactatagttttatagtgcaagtctcaaaatcaggtacagtggatgctccaaatttgtttgcttgttttgtttttttttttttttttttggctattctggttcctttgcctttccatataaatgtatttttgtaattctttctttagaatcagcttatatatagctggaaaaaaattctgctaggattttgactggtattgtaacaagtttatagatcagcttaggaagaattgatatcatcatcatattgagtatattccaataatggaacatgatacatcactccattttttaaggtcttctttaatttctttgactagcgttttgtagtttctggcaacatataggtgcagcaattatttttttttagatttatacttacgtatatcaatttttgaagttttggtaactggtattcttttataattttggtttccaattgttcattgctagcacgtataaatataatagatctttggaattcacaatcatgtcatctgcacatagaaaaattttattttttctttgccaatatatatgccttttatctttcttttgccttattgcactgactagaacctttaatgtaatgttaaaaaggaccagtgaaataactagccttgtcatgttcctgttgttaggaagaaagcattcattcttttactgttaagaatgatgttagctgtgggctttttgttgataccttttatcaaattaggaaagtccctttctatttctaatgtatagagaatttttattatgaataaaattggaagttcgttgaatgcttttttctgcatctttgatataatcatttgatttttccttttttagtctgttaatatggtgggttgcaataattaatttttgaattttgaacggtccttgcatccttgagataaactatacttggttatacagttattactctatattgctgggttagatttcctaatattttgttgcaggtttttgcatctacgttcatgagagatactggtctgtagttttgttttcttctaatgtctttgtttagtttgatccctcgggtattactggcctactgaaataagtttagaagtgttccatctttttaattttttgaaattatatttaatgtaattccttacatgatgcaatgtttagtagaattaaccagggaaactgtccaggcctggagttttatctcttgaaagcatttaaactgccaatttaatttctgcaacagatagaggacattcaatatgtctctatcttcttcagtgacttttttttgacagctttaagatataatttacataccatgcgagtcaccctttaaagtgtacaattcagtgcgttttggtatattcacaaagttgtgtatctatcaccataatcaatttaagaataagtttatcaccccaaaaagaaactctgcgccctttagccatcactctcaaatgtccccagtccctctaggcaaccactaatctgctttctgtgcttatatatattttcctattggagtctgctatgaaataacattttatattaatggaatcataaaatatatagtgtttgactggcttctttcactcagtataatgtttccaagtattattatacttggaataatgtagtatgtatcatactttattatatagtatgtatcagtactattatactcactttagggctattaataatgatgctataagtacgcatgtgtaagtttttgtgtgggtgtatgtttttatctctcttaggtatacagataggaactgaattgctgtgtcagatagtaacacatacgtatattgtttaaaaacagtctgaccattttccagagaagctgtactattttgtattcccaccagcattgtgtccaatttctccacatcttccccaacactccttattgtctgttcaatgacatttaaaggtacgtgtccttcaagcacttggttcatttcatctagttcattaaatgtatgtgcatagacgtgtttgtagtattttattattatccttttagtgtccatggttctgtagtgataccctgtttcattcttgatattaataatttgtattttctatttctcttcagtcaacaggggaactgctgccaccactacctccaaagtggacttcattttcaaaggctaggagagttaaatgagtttcatcccatacccctaacccctgcttatctgtcctctggcctgagaaagtgttttgcttggaggttttttgtccatgcttggtgtgcacttcccagattcagcttgcagaagagtctaagccaggaaatatggggaaaaaaaggggagtccagggaacatattattgtatggggttatccttcaaactctgatttcctctccagtctgccattactttacagagtcctccaagatttgctttaagtattatgtccaatgttgtagttgacatcagtggaagagttagggaaaggtatacttactccatttttaacttgggttggtgccacaagctacccagtcccacgtatgacttactagtcacataaactgcctgacctagtgggaaaatctactcacctttctgctcatttttctttcaaggacacaatacttgaaggataatcctgaaacattacaagaacctaaagtatctttgcaatcaaaagaagattaaatcaagttcagtataattttagttgtctctaattacatcataatgtaatacaaatattttgacatcctttccaggaagaacatactttctttttaaatttaaataatgtttagattcctacttttgttcttacatcttctacctggtcttctctgacctacaaaacttataaaacttacagttgtattatgctctaatctattcctttttgcccctattcattttgttccttaacatattcctgccttgttttataaaagaatcccactatttaatatatcctcaaccacagttaaacaactgaaagatttgaatcatgctctccttctcagcacttagtttattggtatcctcacagcaagtaaatatcaaatcagttttgactgaagaaacaagtaaagtgagcataatccttcattatattctcaccctaaaatggcagaggggatagcattgcatccagacacttatatgatgagaagctggagacagttttacaggctcctcacaggtaaatgttgatagataggaggtcgtaaaaagggacagaacaggaaagtttgcacttactttcagggattgaagtctactgttttcttttttattatagaaggagatgggggtgagtggatgtggattggttcagaatatgaattatgacttgattagcctctcatttcataatggtggataagaaaaagctggtgatcctaaataaggcctgataattatctaggaatatcaggaattaatattctcctacaattatgttatagagataattaataagctaatttcttaaatgtttagttccagggtagtactccaaattttctacaatttgagtatcctgatttctggattaaatcattcccagacaatagcatcaattaggagatacatgcatacctctgttctgttttgcattaaaggttcacatctgtcatcccccccaaacattcattcttcttgagagaaagaattatgtcttatttattttgtctttattcattatttgataggtacagtgcttgtgcatcagtatagttcaatgaaggttaaagtgatcttctaattgtgatgtaattgcatgccattgtaccaatcatcttactatttttttttttttttgagatgggtctccctctgtcatccaggctgtagtgcagtggcttgatctctgctcactgcaacctctgcctcccaagttcaagctattctcctgcctaagcctcctgagtagctgggattacaggtgcatgccaccacacctggctaatttttttttgtttttagtagagacggggtttcagcatgttggtcgggctggtctcgaactcctgacctcatgatccacccgccttggcctcccaaagtgctgggattacaggcatgagccatcgcacctggccctcatcttactaaatttgttcagcatttgaaaacttttaaagcattatatctatatataaaaacactgaacttttttttttttaaactcagtcaatttctcatccctctatcatgtagctttacattattcaatatctgtacattgaaaataagggtttccacgtgtttgggaaagaggaaatctatgaataaaagttactctcatatctaatcatttgtatatcttcattgtaggaaaggcaatggcttaaagtgaagtcttccccatttttctgtgggaaatagatgttgctcattactgaacaaaaacccaggatgtatttgaatatgacatctgaattttagaaattttccaaagtcaatgtagagataatctaaaacagattatgctgaattttttggaccagtatgtgctttccaggtgggacagggaaacaactctgaggcttacctctaatgtattctttccttctttctttctttctttctttctttctttctttctttctttctttctttctttctttctttcttccttccttccttccttccttccttccttccttttctttctttctttcctccttcctttcttcctttctttctttctttctttcttccttccttccttccttccttccttttctttctttctttcttccttccttccttccttccttccttccttcctttctttctttctttctttctttctttctttctttctttcctttctctttctttttctttctttcttttttctttatttctttctctctctctctctctttcttcctttctgtctctctctctctctgtctctctctttctttctattatattttaagagatggagtctcactccatcaccccagctggagtacagtagtgcaatcatagttcattgcatccttgaactcctgggctcaagtgatcctcctacctcagcctcctgagtagctaggactgcaggcatgcaccttcatacccagctaaattttgaattttttgttttttttttagtagaagtgaggtctcactatgctgcccaggctggtctcgaacccctgggctcaagcaatctatctgtctcagccccctaaagtattgggattacaggcatgagccactgtgcccagccatcaaattcataatgttttaaaccaacaagaatcctcccctccccgcccctccccttcctccctccctccctcctttccttctttctttctttccttttcttttttcctttcctttccttccttcttcccttccacttccacttcccttccctttccttctttcttttcttttctttctctctttctttatctttctctttctttctttctatttttctttctctctctctctccttctttccctctctctgcatctttctctctttctttctttctttcttttttagagatagggtcttgttctgtctccctggctggagtggagtggcacaatcttggctcactgcaaccttcacctcctgggctcaagggatcttcctacctaaacctcccaagtagctgtgactataggggtgcaccaccacacttggttgattttctaattttctgtagagatgagatctcactatattgcccaggctggtctcaaactcctgggttcaagtaatcctccttcctcagccccccaaagtgctggaattacaggtatgagccaccatgcccaacctaaccattctttttgagattagggtagtcgcttccatcattaacctttatcatccacttaccttctgtttctttctttaatgaagtgttaaattgtaccccaccactgcattgagagaatacttttgagtgaaactttattagcctttgtaatatcagaaaagatctgtgtgacatatgcagctttaactaaaagaaaccactggttttgctcaaaacagtgatattttccagcaaatatcacagaggttcatacacaatttttttttttttttttttttttttgagacggagtcttgctctgtcaccaggctggagtgcagttgtgcgatctcagctcacagcaacctccgccttctgggttcaagtgattttcctgcctcagcctcccaagtagctgggactataggtgtgcaacaccatgcctggctaaattgttgtattttagtagagatggggtttcaccatgttggccaggatggtctcaatctcctgacctcatgatcctcccacctcggcctcccaaagtgctgggattaaaggcatgagccaccatgcccagcccacaaaattattaaaaggtaatttgataggccaggtgcagtggcgcatgcctgtaatcccagcactttgggaggccaaggcaggaggatcacttgagatcaggagtttgagactggcctggccaacatgctgaaaccctatctctactaaaaaatacaaaaaattagccgggtgtggtggtgtatgccagtagtcccagatactcgggaggttgaagtgggagaatcacttgaacctgggagacaaaggttgcagtgagctgagatcctgccattgcactccaccctgggcaacagagtgagactacttccccctgccgaccaaaaaaaaaaaggtaatttgataaattggaagctttaaagaatccctcagatagctttgctctgagagttctgtcaaatgtttattttttatacatgaagtagttttacagactaagatgctttcaaatttgcttttcacatttaattaaactgtcatctgtcattaagataactattaattagatgttcttgatatctttttaattctctaaaaaagtgactatttctgaaaaggaaaacatctttaaataaattccttcattataaacttagatcagatgacttagtctttcactatttttcttttggtataaaatacacggtttcttctaccattgtattccttaagcatgtgtaatagcgatacacttcaacaacagaatgaagctgctaaacattaggccaaaaaaatctcctttgctatatcgtgcgctgcttatcatttgaattgttaaaaatgtcttctcttcaaaataattttagtttgaagaaaggacacaaaactggtaaacctagatgctgtggactgaatgtttgtgtccctctcaaattcatgttgaaaccctaatccctaatgtgatggtatttggagatggggcctttgagaggtaattaggtcataaaggtggagccctcataatgggattagtgcccttataaggagagacattagataacttgcttcctttatctttcggctctccatcatgtagagacagcaagaaggcagctgtttgcaggccagaaagagggccctcaccagatgctgatgatgctggcaccctgatttgggactttcagcctccagagactgtgaaaaataaatctctattgcttaatccactactccatttaatttgttatagcagcccaaactgaccaagacaccagattacaataaaaaaaattaaaaacatattaggggaagtgaaaacagccctggatataaaattttgtcagaacaaaatacaaatctcagtattggttgttttctgtgatttatgttttatatattgcacattaacatatttccacttcattcagaaggtaaatcacatgaaatctaaccaagtattgctttactatattccaatccaataataacaacaataatgttaataacttgctatttatagaactaagactatgcagcaggcatttcaagagatctatatatgctatttaatggaaattatcacaaaacctctaagagataagttttattgcccttgttttacagatgacagaactaaggcttagactggttaagtaatttgcctaagatcacttattgttggtaagtattagagctaaaattataatacagcttttggttttaatatctacaaatattatttgcctactaaaccacaataaactaaattgcttagtctttatgtacttctctttcttttgacaaacctgacaaattgttcttgttatatatatataatatatatatatagcaaataattaatttcaaccattagaacaatagcaaaaacaacaataaaatcatttaaaatatggacaaaatgtccaggtgcactgactcatgactgaaatcccagaactttgggaggctgaggtgggaggatcacttgagcccaggagtttgagaccaacttcggcaacacagtgagatcccatctcaattttttaaaaaattattgaataaaaaaattacatcgacaaaacacctagttctccaggagtaaaaatgtataagattggcagaaaacttcttaagaaattaaaaacaacacttttttatattttggacattttttctttggttattttatattttggccattttttctttggttattaaaaagatgtagaattttgacaatttgaaaacagctaaatagcaaataaattaatgcattgtagacaaatgagtcttaaatttatttcttaaacgtttaagtaaaataatgtacagaggaacattgaagatctcctagttaaccctcttctagcacttacagatatggggcccatagagtttaacgtattttcacaattatatcacagtaaatctaaatctagaattttggttttccatatttcctctgtaatgatttctccacatgaccatggcacataaaatgatacttatggcaatggttacagtcctctatgtatgtctctaaaatgatgaaaccatgttgcatgaattagcaacggagaggatttcctcttccacagtattccgtactatcaataatcaactctattaaggatccctggtaagatgtgcattgtattattcatccatttaatatatacatttactgtatgtcaggtcctttgctaatgtttccagtattaaatgtcaggcgagaaaacagggaggggtataagatatatgtgcactaaaaatgtgtagtctctcggaaccaacccaaatgtccatcaatgatagattggattaagaaaatgtggcacatatacaccatggaatactatgcagccataaaaaaggatgagttcatgtcctttgcagagacatggatgaagctggaaaccatcattctcagcaaactatcataagatgagaaaaccaaacactgcatgttctcactcataagtgggagttgaacaatgagaacacatggacacagggaggggaacatcacacaccaggacctctcaggggctggggggactaggggagggataacattggtagaaatacctaatgtaagtgttgggttgatgagtgcagcaaaccaccagggcacgcgtatacctatgtaacaaaactgcaagttctgcacatgtaacccagaacttaaagtataataaataaaaaatgtatagtctatttggtgacatgggaccatatgaagcatatccagagtataagccatttagaagttgtagtaggcagcctgtaacattgtccagtgatatctgcctcctggtattcatgccctattcgcttctaacaaactgaatacagcaaaagcgatggtatgccactttagaagttatgttatacaaagatgctggcttgcatcttaggctctctctctctctctctctctctcatctggatcattcacactgaggtgccatgatgtgaaaaaatataggcagcatggagaggtgcccatttagtgaggaactgaagcctcctgccaacaaaaacatatgaataagcttggaagcagattctttagcctcagttgagacttagatgactgcagctctggccaacagtgtgaatacaacctcacaggagaccctgaccaacaccacctagcttagctgctcccaggttcatgaccgtcagacattatgagacagtaaatgtttgttgtcttaatttgctaaattttagggagatttgctatgcagcataaataactaatatggagaggataatgtctgttgcagttctcagtttttaaggaggcagagtaaggaagctgtaatttggtgggcagctcacactgttgcaggaaaggccataaaaggctgagtcagtactcatgagaaacgtttgcccattaactaatgagatataatatgcatgtcagttaggtgtaatgtgtaagttaaacgaaataaatctttagtcactaaggtttttgagcttggaaagttctctgagaaaaaaccatgattcagcaattctgactgcacaaattctatgctattgtctacatatgtgttcccccaaaattcatatgttaaaacctattcgccaatgcaatagtagtaagtggtaggacctttaaaagatgaaggtcatgatggttctgccttcatgaacagttattagtgcctttttaaaagaggcttgaggaagcttgtttgtcctttccaccacttagaacacatcatctatgagggatgcatcctccccagacattgaatctgctggtgccttgatcttgaatttctccagctccagaactgtgagcaataaatttctgttgtttataacttgcccagactaagatattttgttatagcagcctggatgaactgagatggtctaattataaaagcttactgagcaccttttaaaaagtaaataaaaacagagcagttagcaacaaaacctaatgcaaccacttgcttaactctgtatgattaaggtagatgtgtatgtgtgtatctttgtgtgtgtgtgttctagtatcttcagtgggtttttaaaataaaataaatgagttataactacaacagttacagacggtgttggataattgaaagggtttgcaaaattctatggaaactactcaaggaagacctattcaatgtaagaaatgcaacatagcagaagaaagaatgtgcagcccacacacccgggcctgggagacttgcacacctacctagagtcccttctcagtcacacaggatgtgcttcatctctgaattatgaatcttcaggatatacgtcccactgatcacatagccaagccatgctatgtaactggttagcccatgcgtaagccatcaatctacacacccctaaacattgtaaacaagctgactcttggtaccaacaaggtgatttcaaacttaaacaatgtattataaatataaactagttcaagccttcttattgtggccaaaagtcagtgtcagacctccaggtaatcatggagagttccagcccagctgtaagataactcttttccaaatgatcatttaaaacaaaagaaatcaatcattgacatgttatatatataatacatactatacatatatagttgcaacattacatataatacatatatttatatataatattgtaaatatatagaaacatatgcacatatgtacatatctttaatatatgtaatagatattcaaaaccagcataacagatgtttgccatgtgacactaaaatctggtttcttaacaatgacaaaagaaatgacaaatataggaaatgaacaaatacaaaaagttaagcataagctgatagcagtggaagccgaattttaaaattttggggtcatatagttagattcatgatattctaagcctcctgggtggggactggtagagtaatgcattttacagaggatagcgaattgctttctttatcatgtgactaatttagttattctggttttctgcatctttttaaggcttcttttataataataataataataataataataataattattattattattattattattattattattattattattattattttctgggagcccgctgactttgtattctaatgtggatccattgctttctggatctgctgggcatctgccaacttgccattttattcattacatctctgggttagaatcactatttcagcattccatgtcgtcctatttctgtttttcccatctcttgtttagtttgggcacactttcaagtcatttctcaagaagatctacacaagttacatttctgagttcttatgcacacaaaaaggtttttatttgaccacataatttggatgaatatagtattctaagatcatgttaattttctcatgaacatgaagccattgcttcattgccttgcagaactcagtgttgtgataagaagtctaacaacagtcaagcagaaactcacagctcctcagcagagccctcctgtgcacagtttagatagaggcttttgctgctctctttcatctatctccatgtttccagctgctttctatcttctggatcttttttttttccctgtgataatcctacacccatgcatttgccattaagagtttattcccttttgtgttcctttactgttattttaacgggatgttagactgggactgcgtagttatatcttttcagtttactcttgtgttagctttctaaatagatggaaaagacaaaacaaaacattgttagtaccttgactcaaagttatttgattgtaattgtggagatacggcaaatacattaataaatgcaaataatggaaaaacactaataccgatttaccaacagaagtagctattaaaggatatataaataaataacataggggagatggcaagagaagtacaatattttaacttacttcttcttccctcaaaaataatttcattttttatcaacatccatactttaattcctctttttacataagcattttgaggcatgtggtaagggaatttgtataacctttcttaaatcactacaacctacaatcaacactagactttagaatatctggaatcttaaagaaatactgccagcagtgtttataataaatgatacttttaaaaatccctatatcagcagaggaattttataatataaattgttcatttaactttaactgctacagattttggcagacagtaaaattaaatggtggatgatcaccagaatatattacattttgcaagatagcactgggttactaatacatttcaggagaagaaatctcttcccaggtccttaggctgctgtgtagtattattaagcagtaatactttcttttgtaattgatgaaagaggaagctgtaaattaccatgagctagaaattttgatttgtgaagtgaaaatatatttcagtagaaatcatggcttggcacacagtggaaaccgctttccagctgtctaaagtctccttggctttattcgaactacttctatcctccctgagctggttaactggacacctgatcgatgtccacttgttctgctctcagaattgttcttccaattgtggctatctttagaatatcctttccacctttagtcaagcaatctttcttcattgatgatcttatgatatctagtgtttacagtttttttgtttttctattatactttaagttttagggtacatgtgcgcaacgtgcaggttagttacacataattttttcccaagtgaaagagagctaaatagaatttacccatgcatgataaacaattaattgatttcattgaataaaatattcacatctattaataaagcttgtagataacattgtcatttgcaaatgttggccggctaatttgtttttttcttagcaacaatatgccctttcagcatttgcttttacgtccatgaagtctgatagcataaatgcaatataccttatttcggcaacagctataggtactgctcacctaagaaatgcttaattcttcatttactaaacttgctcgtcttgaaaacgtggcaatataattatacccattgtaaccacccccacccaaccaggactacatctgaggaatcacataaaaattggcatgaaagacatagttgggaagagggtggggatgaaatggctaaagctattgtcaattaagttctgctgcctgcaccaattacttaccaccaggggaaatgcaatctgatttacacactcgaattcacatggtttatgttctctcccaaactagaggaaagaaaatctaagggacataatatcttggtttattctccagcctcagtgaccttgaacctcgaattaagttttacagatgagtatataaaagttttatcagctcacatcaataaatatataaccagacttttctggctatatataaagacccctaaaaaagtaaaattagctgtctttgcagctacaggctattcatacatgaaatagatacttgcaacaactgaagggaattgtttcattagtttcataaatctgatttttgagatgaaatggaagagagaagccttctgccagtttgtctacatttttaaaaacatacactatgttatggtttataaaacattttacagtaattatctttcaaagatacttaactattggattactcagtagacagctatctagaacagagctcctaacagctctggtgaggcatattggtgtgtgttagtgagaggagctttcagatcttgagctccttagctctcaaggtagctgggaaggagctaaaactgcttgataactgcagagcctctgatcccctcgggccttgagcagccacttcttttctcccagtggctgtgcaaacattatgattttattttatttttttgagagacagggtctcactctgttccccaggatagagtgcagtggcacattcacagctcactgaagcctcaaactcctgggctcaagtgatcctcacacctcaacctcccaagtatttgggactacaggtgtgtaccaccatgcctggctaacattttttaattactattttcttcttttgtagagctgggtctcactatgttgcctaggctgatctcgaacacttgggttcaagcagtcctctcacctcagccttccaaagtgctgggattacaggtatgaaccactgcccagcctcaaacagtatgatcttagaaaacactagtctatgctgttacaaagaatgtctcatacttagtaatcttaaaaattagtgaagtcaaagtacccattccgttggatttaaaacaaaatataaagttcaattcagtatcactctacatttgaacaataccaggatacagatgtgttaaattttgtcattgtagttaaagaaagaagaaacctcagtatatcactgaagggtaaacgttccccctttttgaaaacctgcatagactcctttatacttttacatatacagcaaaacaaacattattttatgaagctagtgtcttggccatagaatcatattcacatcatatattctgctatggcatgtcttccctggaatgtacctcaatttggagtggtatcataataccttgtttaataaatctaccagaaataaagcaggcttttatgcttgttttaaaggtttcataaaccatctaaaagaattggctttgcaacaagctgctgaagggcaatgttcttggttgcataatatggatgcaagtagttccattgtcccagtgatgtccaattaagttggcagcatcaatcctcaatttcctttctctgggtccttttgcttcctcgttgataatcatcctctcctgcttctcatcatccccaacttccccctttgctaacagacttcaaagccctttattatgcagggaatatgccagtgtaagagtcttagtgtgaggcagagcactgtctgcaaagaagctcgaaggccaggtactcacccctatgcatgctgacagccaaggtgtgggcacatgatttaaactctactaagataatgcttctggcactggaagttgagtttaaagcaagtgaggcaaaagcagggatattttatgatttattccagtggtagaaccatctgaaatgtggtagcgaataaatgtaccagctgtgtggtccagtgtcataatgttatgatactgttagtggcattaagtgttcagagggggctggaatggtactttgaaaagctattctttgggatgactttaactgtgttcctatatgaagtgtcccttgcagtctgccagttttttcttcttgttctccagtcttcctgtgtttttctgcctaatttagccattcttaatttcagttctttgcaacccagaaccaaaactaatacttaatacttcatgtctaatctttttaaacataaattatttttctattgccttcagcacataaagatccatagagtaaatctgaattagtcattttacagaaatacgggaaagtaggatcagaatgaaagatgtgacctctttctctttctagatgatatcttgtttcccaggagaagatccatatgaggctagtcacaggtgttctagagttacagaagatacaagacctctggaacacctttgcactggtgaataaccacacagcatgttcccattctctggttcatcttccaattctcccttcttttcagcccatgccaattcatctccactgttgttaacccatccttcatttagcaaaaatctcaaagttactgtattagtctgttctcatactggtctcacactgatatgaagaaatacctgagactggctaatttataaagaaaacaggtttaatttattcatagttccacatggctgggcaggcctcaggaaacttacaatcatggcagaaggcacctcttcacagggagacaggagagagaatgagtgcccgaaagggaaatgccagatgcttataaaaccatcagattttgtgagaactcactgtcacaagaacagcataggggaaaccacccccatgattcaattacctcccactgggtccctccctcaacaaatgaggattatgagaattacagttcaaaatgagatttgggtggggacacagccaaaccacatcagttacatattttacatttttcagatatggcagtatctcaacccctctttatgattctttaatatccactcttaagccctttatattattcctcatttaacaataaaatttctatcactgtgtcagaatatattattttttaaaaaataaggctataccaacagtgtcactttagattactccatgtaccatgtcaaaaaggtgagaaaagattttgcatcacacaatacatattgaagattgcagtttttatagcattttcttttttctgacaagtttgtatgttcatttacttaaaatggcaagataagaatcttgccattcttattttagttctttaactggatccttagtctcttaactagatctgggtcctatataaatccagtcttccttggacagaaaatagatttttccactcagaagttctaacagctactttcttcaactcataatgtcacctaaggtcccacactcctatgggaacagaagcacttccacggtcatgagatcttactcttctttagagaggctgagttgtaatttaatttccaactttagaattatcaacacgaagacacacagttatccaggttagccaagtgatctgcagacagaaacctcttgttaatgctctctaattgtgttaaaaaaaaaaaagagttatattaacgtctaatccaaaaggcagaaaggatataatttgaaagcctgttcagactgcttaaaggggaggaaattcgccaacaatggctcccaaatgtgaaagcacagttactaccccttacagggatttgctggaagcattaccaaaattaggttcagtcagatctttcaacagacgtagttcaatgatggttcttgtaagtaattgaatacacaatattcatgatcaattgttcaaaagcttgctaaagaaccttttaaaaatctgaccccaagttttctggaagtggctaagatctaactctggacagtaatgaatcactttcttaatcttttctctgccccatcctttgacacagcccactgtttccaggggttgttttcctcctgaattgggatgacaacctattctcctgcttaactagactgtatcacagtgtaatcttgcagtacattttaaatttaaattttggagaaggacttggtgatcattgatcattgggcccctctgctatgtgtagatgctaccggggaaaataaaaataaagaaagtgtggtgtctgtctttaaggacattacaatctagtgggagaaacttgtatgtaaatggctgattatgatcaaaggcaaagtgaaataaacattaactagaggacaagctcatagtaatacagataatggagcaattaattctaactgaaagggaatcaaaagctcctttgcaaaggtggtggcatttgagaaagtgtttagaatgattatattttaagagggcagtagagaagaaaaggcaatcattccaactgcagggatagaattagcaaagccttagaagctcaattcaagagatttcgttttgggttttgatttttttttctttttaattctaacatacgacacaatggtaggccctgggagagattcaaagaaaaataatatgagtgtctttttctcctgtagctcatattccattttgaaagaaaagccttttttttttttttttttttttttttgagacggagtctcgctctgtcacccctgctggagtgcagtggcaggatctcagctcactgcaacctctgcctcctgggttcaagcaattctcctgcctcagcctcccaagtagctgggattacaggcacatgctacaacacccatctaatttttttgtattttttctagagacggggtttcaccatgttggccaggctggtcttgaactcctgacctcatgatcctcccgccttggcctccaaaagtgctgggattacaggtgtgagccaccacacccagaccagaaaagccatttttatgacagtatatctgaggagttcatcaagagcatatacttgtctgggatgatgtaattgagttggcacgtcccttaagagctacagtgcacgagaacagaaagaattcattattgccaaagatttctagaggacatgaatataagctttttcttgaaatatgcatagaatttgatgtgagaaacaaggggtagagatatttaaaaagagagtgatggcagttaataatcttggcatgtccccgccattgtggaagtattaacttaagtgttgtggaaggtgccttttggcccacatcagaaaaaaaaaaaaaaagttagaaataaaattttaggtgaaatcaaattcctccagagttcaagaaggtaaactgagtgaagaagactggggctataatgagacagagtggaagagactatggcatggtagagaccatggccaaggctcagtgaaaaagaggacaccactaagctccagccaattcccgtgaaaattatgttggtcaaaactccactggccacataaaaattctttgagtcatacctagtatgtagactactaattttcaaacactgccggactgcagagggtaaggactgctagaactaaaacctttagtttttataaatatttaagattgtaggacagagctgcaatgccaaaaaaaaaaagcatgttttaatcaagctacaaaatgcaagatatgtatatgtaaaccatattaaatgaaagggaattgagaggggttaccaactgctattaaagttttttcaaactacgttttaaatgaaatacatcttaaaactctatctgttgcttaaactggagtaaacaatttacaacaaaattttagaaaaatttattggctcaaaatttctttcaactgtctcatttgcctttgagacaaaaaacatgtaactatatggcaattgttcattctaagaaggtgggaattctggatacacactttccagtctcggcctcatcagatacttgatgaatgaacctgtatttgccatcactgccagttgccaacagtggatgccaccaggatatcttggtcagattcatttatgtacctgttctgttttggtccatgagcctggcaaacagtaaaactaggtgggggttggaggtttgcaacagctgctctggggcctgctgattcctgaattttatagcgttcataaatcacacaaaaatgtcttatgtccgtccacttccagtttaggtttttccccaacgtagtacaaaagaactgaagttgacactaagagtataatttgtaagccttcacaatacagtccagaaggtttattatttatttaaaaagctaatatattctatattctctattaagaattcctgacaggaggaggagcttagtaacagggataaatggggtggaataaagaatttcacatgaagattacaatattatgcttctatctgggtgaaatgtagcattccagatgttgactacatttcactagagtttgtgaacaatataaattcctgagatataataggtcagccctgcttcttaatgctgagaaaacacttagaagatcatcaaattttgaaaatgtactaatgagctacaaagtctgattaaaatcaaaggtgctatgttctaaaaaccttctttgtgatttagataagtatggcttatatttcatcatttatgacaatactttaaggcaaactttgcaaagacggaaaagtcttggtaataaacaacaattcactatagctcctcataaagtcattttcagaaagcagggttaaatcctgaagactgtataaaagaaaaggaaacacagagaaagacagtccacagatattactgttcacttgctaaaaagtaaactattaaggcctcataacacaaaacatgatatttccaattatttaatttggcaattatttataactaataagtccaagatgtgaagcagacgcaaacaacgatgaacatctcctgttagtaaattctggaggatagagtagtgggaagtatctttcatagacaatgtctccatgggaaagaaaattttcacatttttcagctttggttaagatcaaactgatctaattagttttctcatctaatttattgctcagaattccttttagtaaggcatgcttttcataaatttcaaagaaggctatttggagaatagtttggaattagacataaacaaaaatggaaagctttttcaaagatacaccaaaatttttctgagtaactaaaataacaaaattgggacatcataaactataccgttacgctaataataagatgctgtttatacataataacccaggattattttatattcattatatttgggatataggacataatttatctagagaattttaattaaaattatatacaactaattagaagaaaacagatttttttctcttctgaatgtgataatgtagccatatggattagctatctagaaaggttattataaatcaaagaggtattaataaacttgcaattaagtgtttaaataactttgtttcattattttctgatctcagagtgattgcaaacagtggcataaaactgtaaacctggtacctcaaacagaattatgatcataaagtatgctcacaagactaacacgattataaaactgagacagaggcaaaatattagtcctcctagattttacctaaccaattcctgataggaaatttttatttgtctaaaaaaaaaacccctgttacattcttcttttacttacattctattctcagaaggtagaaaaaaatcagggacacagaaaactctgtatgtggttttgaccaacatgaaaggagtgcttaaatttagttagggaagagatactgaatgaccagagcacaatcatctttttaaacaagtaaatatattgccataacttattgaaaaagtaactactatgtgccctattgataccggtgactttgaggagtggatatagcaatataaatttaataatatcaagagttttatctttccttaccacattgttagcattgcattattttagaaatatttcaaagagatagtaagaaaattacataccaagattcatcaatgattttgtttatcaacttgctagaaaaacagcaaaactgatcatcaattccctgcaaaccttgctaagcttgccttgcagcatagcacttcagacctagtctctagtgaatattattcaactgttggtttgtttctcttaattcatttcaaggagtggcttcaaatataaaagaaaaattaaaaaaatgactcatctttgtcccttctactcttttggctaaacaatgtgcatatcaaatttcatattccatatgcataacatgaaaaatgattctccaggatcgatgacttaaggttggaatttcaaatattttaggaatcacagatgcaccatcaccctagtgtgaggaggcaatagtaaaaattctaacctgaggatttcacaaattcacaaagggttttcccaggaaggagttctgctatcatgacttataaaaatagttgattgtcctcattgtttttgaatccatatgaattcagacacttctgtaagtttcttggagaaaggttaacaatagtgttaaaatgccatttcactgagggattcaagaactaagcatttgctggctggtttttcgaaaatactaacctgagtgctgcaatcaacacaaaagagtggttccacatttcttatgcaatcaaagaagattatgtgcaagaacaaattgctgttttgcaaacagactgcagatgaaggtaagagcatttctctggaaacgtaggacagacttgctgtgtttaagtaatgtaaacaaaaacttagggatatcaatgatacagttaacagagggtttggtgactatcacatacttgataccatatcagcctaattatatctcctaatagataaggcattaatgaacattctaagtggtttctgactaaggcctgtgggtaatttatataacgcatatatttatagaagacctctttttaccaatgaatatatttacttctcagtgataaatttcaaatcgcataaccaaagtgtgcaagcactgtatagcaatgtatgtcaaaagaagcaacacagactagaatctttcccacatgtatgaatattcgtagctatgtagattcaaataagagaaattgtgcagctgttattggcaactgacttaccagtacttgtaaggaagttaacatttctcattacaccttccgtgtaagcccctggctcgtaactgtccatttcacccgtgacgatgtgagcaactcttgctgcccggcctctgatagcacccgcagcacggtctaaattatcagcatcctggtctcttaaggctatgatacacttgttgacatcttccaagatatggctttctgtaagtaaatgaatcaaattagtttttgcgtgtgtctgtgtttaaaatcatacaaatctagcatattataattatgttaacttctgacttcagatagagtgcacattggaaatggaagactttgagaattataaaaaaattggagacatattttgcttacatccctttattctttaatagcaaaatccatgaaatataacatgttacatttttaagagaaatttgtattgactgcatattattttagattctagttccagtagattagattttagactgacatagaggtggaaattaaagacagtttctagattaaaatgaaaacaaaatatgtgatgatgaaattctacatcgtgaatgaaagcaatattatacagattataaaacttatatatacataagtcttttaaaagatggatttaaacaaatgaattccagagaaagttgcctactctgaagagtgtctcctgacctcatcctctccattctttagatgactaggccatgaagatagcaggaagttactatagcacagtaatattttctttcttcataaaatgattaatactcccagctaaaactaatgaatgaagatgcacaaatatgtggaatatcaacaaacatggtcaatgatatttctaacaaattgaaagaatattaaaagaattagtgttctggcttctggctttatcacatgaatccccacttaatatctttaacgactatttctttaaaacacacacagaaaacaattataacaataagatctcagtaattccagaacatatcattaattctctttctctctttttttgtccctctcactctctctgtctgtgtctctctgtctttctctttcccaatctgcttgtgtatatgtgctgactatgtgtgtgtttgctacaaaggacaattattcttcagttttctttcagagtcacacttccctcttgtcgtccaaaaaataaaatcagtctgggtgtggtggctcacatctataatcctagtactttgggagacctaggaaggaggatgacttggggccagaagttcaagaccagcctggaaaacacagcaagaccctttctttacaacaaaataaatttagccaggagtagcagcatgttgctgtagtcctagttacttgggaggctgaggtgggaggattgattgagcccaggagtttgaggctacagtgagctttgatcatgccactacactccagcctgggtaatagagtgaggccctatctatctatctatctatctatctatatatatatatatattaaattaattatatatagttaaaatttaaatgtatttataaacataacattatttaatcatatatgtattcatatatttcataatgatatgttccggaattactgagatcttactgttataattgttttctgtgtgtgttttaaagaaatagtcattaaagatattaagtggggattcatgtgataaagccagaagccaaaacactaaatatatcctaaatatatacgcacccaatacaggagcacccagattcataaagcaagtccttagagacctacaaagagacttagactcccacacaataataatgggagactttaacaccccactgtcaatattagacagatcaatgagacagaaggttaacaaggatatccaggacctgaactcagctctgcaacaagcagacctaagagacataatttttgaaaaaagaaaataaagtcaaactaccattgaatatggtccctgttaaccttctgagatctggcttctattattctgttatacatattttatgatttccaaaatccttcatgatcttccatgcctctgtcctgtgggcatattagaaccttggcctgaacagtctgtcccctttgacctgcttgctcaactcctactattctttcaagccactaggcaaatgttcctgcctcaggaaatgcatgctgacctcctcattctctacaacaaaaccaactttgttccatgttgtttaggattcacataaaatggtttatgtgcctcaattagagattctacctgtgttttaattatttacttttaaaaatatctctctagtagaatttgaaatatatctgagggaaagaattttatcttattcctcgaggtattctaagtagtacttgttataatacttggcacttgttaggctaacaagaatgcttgttgaatgaatgaatgaatgaatgaatgaagctctcttataagacattcttaaatcatgggctatgaacctaagtgaacacatatctgttatctgaaattagataaatttaacccatattaaggacatttaaagtcacttatattaaaaatattaaacactgaaaaccttcattataaattaactagggctttaacctaatttgcagcattcagttatgaatgtatcattaagccctacagtaaatacagtcatggtccaatctcaacagaaagcatatgtatattatcatatttcccctggaacagaagtataggttggaccttagaaggtatagtaatcatcaatttttaagaagtccacagatgtacactttaatgacacattaagaagctaccattttcacctaaccaagatggccaaataggagcagctccggtctgcagctcccagtgtgattgatgcagaagatggatgatttctgcatttccaactgaagtacctggttcatctcactgggactggttggacagtgggtgcagctcacaaggggtgagctgaagcaggacagggtgttgcctcacccgggaagcacaaggggtcagcggatttccctttcctagccaagggaagccatgacagactacctggaaaaacagggcactccctgcccaaatactgcgcttttcccaaggttttagcaaccagcagaaaaggtgattctctcccatgcctggctcagtgggtcccatgcccatggagccttgctcactgctagtgcagcagtctgagatcgatctgcgaggcggcagcctggctggggaaggggaatctgccattgctgaggcttcagtagataaatacagtggccaggaagctcgaactaggtggagcccaccgagctcaacaaggcctactgcctctagactccatctcttgggcagggcacagctgaacaaaaggcagaagacaactttggcaggcataaacgactctgtcagacagctatgaagagagcagtggttctcgttctcccagcatggtggttgagctctgagaatggacagactgcctccttaagtgggtccctgacctctgtgtagcctaactgggagacacctcccagtagaggccaacagacacctcatataggcggctgcccctctgggatgaagcttccagaggaaggatcaggcagcaatatttgctgttctgcagcctctgctggtgatacccaggcaaacagggtctgtagtagaactccagcaaactccaacagacctgcagctgagggacctgatagaaggaaaactaacaaacagaaaggagtagcatcaacatcaacatcaacaaaaagatcatctacaccaaaacgccatctgtaggtcaccaacatcaaagaccaaaggtagataaaaccacaaagatgggaagaaaccagagcagaaaagatggaaattctaaaaatcagagcacctcttctcctccaaaggatcgcaactcctcaccagcaatggaacaaagctggatggaaaatgactttgatgagttgacagaagtaggcttcagaagtgtggtaataacagacttctctgagctaaaggaggatgtttgaacccattgcaaggaagctaaaaaccttgaaaaaagattagatgaatggctaactagaataaacagtgtagagaagatcttcaatgacctgatggagctgaaaaccatggcacaagaacttcatgacacatgcacaagcttcaatagcagattcgatcaagtggaagaaagggtatcagtgattgaagatcaaattaatgaaataaagtgagaagacaaggttagacaaaaaagagtaagaagaaatgaacaaagcctccaagaaatatgggactatgtgaaaagaccaaatctatgtttgattggtgcacctgaaagtgatgggaagaatggaacccagttggaaaacactctgcaggatattattcaggagaacttccccaacctagcaaggcaggccaacattcaaattcaggaaatacagagaacaccacaaagatactccttgacaagagcaaccccaagacacatgattgtcagattcaccaaggttgaaattaagggaaaagtgttaacggcagccagagagaaaggttgagttacccacaaagggaagcccatcagactaacagcagatctcttggcagaaaccctacaagccagaagagagtaggggccaatattcaacattcttaaagaaaggaattttcaacccagaatttcatatccagccaaactaagcttcataagtgaaggagaaataaaaccctgtacagacaagcaaatgctgagagattttgtcaccatcaggcctgccttacaagagctcctgaaggaagcatgaaacatggaaagaaacaactggtaccagccactgcaaaaacatgccaaattgtaaagaccatcgatgctatgaagaaactgcatcaactaacaggcaaaatagccagcgaacatcataatgacaggatcaaattcacacataataatactaaccttaagtgcaaatgggctaaataccccaattaaaagacacagagtggcatgttggataaagagtcaaaacccgtaagtgtgctgtattcaggagacccacctcatgtgcaaagatgcatataggctcaaaataaagggagggaggaagatctaccaagcaaatggaaaacaaaaaaaagcaggggttgcaatcctagtctctgataaaacacactttaaaccaacaaagatcaaaagagataaagaaggccattacataatggtaaagggatcaattcaacaagaagagctaactatcatatatgcacccaacacaggagcacccagattcataaagcaagtccttagagacatacaaaaagacttagactctcatacaataataatgggagactttaacaccccactgtcaatattacacagatcaatgagacagaagtttaacaaggatatccaggacctgaactcagctctgcaacaggcagacctaatagacatctacagaactctccatcccaaatcaacagaatatacattattttcatcaccacatcgcatttattctaaaattgaccacataatgggaagtaaagtactccttagcaaatctaaacgaaaagaaatcacaacaaactgtctctcagaccacagtgccatcaaattagaactcaggattaagaaacttactccaaacaacacaactacatggaaaatgaacaacctgctcctgaatgactactgggtacataacgaaatgaaggaagaaaaaaagatgttatttgaaaccaatgagaacaaagacacaacataccagaatctctgggacacatttaaagcagtgtgtagagggaaatttttagcactaaatgcccacaagagaaagcaggaaagatctaaaattgacaccctaacatcacaattaaaagaactagagaagcaagagcaaacacattcaaaacctagcagaaggcaagaaataactaagatcagagcagacctgaaagagatagagacacaaaaacccttcaaaaaatcaatgaatccaggagctggttttttgaaaagatcaacaaaactgatagactgctagcaagactaataaagaagaaaagagagaagaatcaaatgaacgcaataaaaattgataaaggggatatcaccaccgatcccacagaaatacaaactaccatcagagaatactataaacacctctacgcaaataaactagaaaatctagaagaaatggataaattcctcgacacatataacctcccaagactaaaccaggaagaagttgaatctctgaatagatcaataacaggctctgaaattgaggcaaaaattaataggctactaaccaaaaaaagtccaggaccagaaggattcacagccaaattctaccagagatacaaagaggagctggtaccattccttctgaaactattccaatcaacagaaaaaaagggattcctccctaactcattttatgaggccagcatcatcctgataccaaagcctggcagagacacaacaaaaaaagagaattttagatcaatatccctgatgaagattgatgtgaaaatccttagtaaaaaactggcaaactgaatccagcagcacatcaaaaagctcatccaccatgatcaagtaggcttcatccctgggatgcaaggccggttcaacatatgcaaatcagtaaacataatccatcacataaacaaaatcaacaacaaaaaacacatgattatctcaatagatgcagaaaaggcctttgacaaaattcaacagtgcttcatgctaaaaactctcaataaactaggtattgatgggacatatctcacaataataagagctatttatgacaaacccacagcccccaatatcatactgaatgggcaaaaactggaagcattccctttggaaactggcacaagacaaggacgccctcactcaccactcctactcaacatagtgttggaagttctggccagggcaatcaggcaagagaaagaaataaagggtattcagttaggaaatgaggaactcaaattgtctgtgtttgcatatgagatgattgtacttttagaaaaccccatcatatcagcccaaaatatccttaagctgataagcaacttcagcaaagtctcaggatacaaaatcaatgtgcaaaaatcacaagcattcctatacaccattaacagacaaacaaagagccaaatcatgagtgaactcccattcacaattgcttcaaagagaataaaatacctaggaatccaacttacaagggaagtgaaggaccacttcaaggagagctacaaaccactgctcaatgaaataaaagaggacacaaataattggaagaacattccatgctcatggataggaagaatcaatatcgtgaaaatggccatactgcccaaggtaatttatagattcaatgccacccccatcaagctaccaatgactttcttcacagaattggagaaacactactttaaagttcatatggaaccaaaaaagagcccacattgccaagacaatcctaagcaaaaataacaaagctggaggcatcatgctacttgacttcaaactatactacaaggctacagtaaccaaaacagcatgatactggtaccaaaacagatatatagaccaatggaacagaacagaggctcagaaataatgccacatatctacaaccatctgatctttgacaaacctgacaaaaacaagaaatgaggaaaggattccttatttaataaatggtgctgggaaaactggctagccatatgtagaaagctaacactggatcccttccttacaccttgtacaaaaattaattcaagatggattaaagacttaaatgttagacctaaaaccataaaaaccctagaagaaaacctaggcaataccattcaggacacaggcataggcaaggacttcatgactaaaacaccaaacacaatggcaacaaaagtcaaaatagacaaatgggatctaattaaactgaagagcttctgcacagcaaaagaaactaccatcggcgtgaacaggcaacctacagaatgggagaaaatttttgcaatctacctatctgacaaagggctaatatccagaatctacaaagaactcaaaccaatttactagaaaaaaaaacaagtccatcaaaaagtgggcaaaggatatgaacagacacttctcaaaagaagacatctatgcagtcaacagacacatgaaaaaatgctcgtcattactggtcatcagagaactgcaaatcaaaatcacaatgagataccatctcatgccagttagaatggcagtcattaaaaagccaggaaacaacagatgctggacaggatgtggagaaacaggaacacttttacactgttggtgggtgtgtaaattggttcaaccattgtggaagatattgtggcgattcctcaaggatctagaactagaattaccatttgacccagcaatcccattactgggtatatatacaaaggattataaatcatgctacaataaagacacatgcacacgtatgtttattgctgcactattcacaatagcaaagacttggaaccaacctcaatgtccagcaatgatagactggattaagaaaatgtggcacatatacaccatggaatactatgcagccataaaacaggatgagttcatgtccttttcagggacatggatgaagctggaaaccatcattctgagcaaactatcacaaggacagaaaaccaaacaccgcatattctcactcattggtgggaactgaacaatgagatcacctggacacagggtggggaacatcacacactggggcctgtcaggggatggagggctgggggagggataacattaggagaaacacctaatgtaaattatgagttgatgggtgcagcaaaccaacatggcacatgtatacctatgtatcaaacctacatgttgtgcacatgtaccctagaaattaaagtatagtagtaaaagaaagaagaagctactattttcaagtatattggcaaggtttctttttttaaaaacaaatgcaacatatatgtattcaacgaatgtttactctgtattcactaaggtgttcaattttatattgtagagctattttcttagtcctataaaagtgaaagaatatttacagtaaaaacaatgtctgttcttggaagattaataatatataatacactatgtaatttctctttaattaaagatgaaatgatagcttgtacaaactattttttccccagtgaattttgcagaggagaaaatatacaaagaatattcactaacaatgaatgagtagtcacctcttctgtagaagtatgatctatatgcccatgaatttattatttaaagcagtgaataaaaatatagcaagaatttttctggttctttttttgtttggctttgcagaaggttgtgtgattactgctcacaattaaataatcctgtctgaggccatagtgttaaatcttgttgaagaattatagatgtaaggtcagatatggaaataaaagtcttatataaacatatgatatgaaaaaattataaataaaataacgaaaagaagctataaccagacttaacccaaagcagctatagtaagaatattagagaagatgtgtaaatgatctttgaaattactaagattaaatatagcacaaaataattagaaaaggttcacaaagtttgtattactgtgacacgttcccattaccctgaatgctttacagaatgctaggaacaactatttgcatgaagctctaaacatagaatgcccgaaaaagaaaatcaaaatgttaggtacctcccacatatgcacaataactaaacattaagcaacttcttaaaaatgattatttctctgctatttatatttctggtgaatttaagtggctaaaagaacttcatgaaggcttgagcttttatgcctagctacacagcctttaaacttttaggaaagaaaaaaaatgccaaataccttgtatacaacttcctactgttgaatctctttagactttgcttctgatggaatgggtttactctttaaacacagcaaaagtcatttggttctctcctcaaaaattttttttttctgaagtagatgcacttgaactcaacaaatgcatcatttttaaaatgaggttaaaagaaagagaatatgttattatagaacaagcacatttagaatattatgttttgaaggattgtcacatagtgaagatttttcttaacagcttcagagtatcagcttaacatttgctctgaggtgaggggtggaatgtcctggtgttagcgtaaatgctgaaatgcattcatttaagagcagacaattggtgaattattagcaatttctatcaatcatttttatagccatcttgagatgcaaagggtgatttctattttgttggaaaatagtaatacatgggataataaaggaattgatgttttactaaaagatactttgtttggtgcaagcttctctggctaactccatcttcagtcaccacaggaagtgtagcacaataaaattttgaaatgcatttttaaaattataattttttctagttgttcagtttcattcatatatatatatggagagagagagagagagagagagagagagagagagataaggtctccttctatcacccaggatggggtacagtgccataatcatagctcattgcaacctcaaactcttgggcccaagtgatcattccacctcaggctcccaagtagctagaactgcaggaactcaccgccatgcctggctgttttaattttttatagagacagggtcttgctacgttgctcaggctgatatcgacctcctcgcctcaagcgattctcctacctcagattcccaaagtgttgagattactggagtgagcccctgcacctggccagttttcaacagttaaagccagaatttaaaggtcaaatctattgccccagggaaagtagaaaacaaacaaaattcagtgaaaacaaaatgttaaatcactggctttctacagccaaagtagaattttataaatctatagtccagagaacagactgaaagtagcagcacattttgtttgcaaaagctagattggttcagaggtaaaagtttctccttttaattcctgaagtgggactttgaatacatcaacagcaaagccttaaggggaagagagtttatgctataatccatcaagcaagaaatgatacactatcaacagtttcctcccctgatatctacatacacaagaaaaagattcagagaagggaagaagagagaaaaagatattaactagtttttctggagaaactgagttataatgcaaaatcgattgaattttctaaattgtcaagattaattctagctacccagtgtatatgagctaagagacttaagctaaatttaattataaaaaaaagtttccatttttgcatacctggctccatagctataaattaaaaacacattacataggcaactacataaatgttcaacaaataaaaacaagaatacagtaatttttctttcccatttacccaacatacatgaaactaaaaagcaaatagaatgcattagtgtgtgagttaattgttgcttatctatgtacttacagaatttgtttgtcaggagtttgactatgatgattggtttccaaattaaataatatcccacagaaagatctaagcaaaaactagcttgagaatacagagtatgcatacagttaaatgtaaaatgtaaagtcccttcttcctctttacctcctaaatcctttcttctgtctcttctttccaaagtcttaatatatgttagaaaatgtagacgatataaaagataaagtacagtccctgtctgcaaaggattcacaatctagtaaccagaaaataaagcactttgtattttattgtcttttattccgcccaatacaatagtcaaaattgtagtcacttggtaattttacaaaagttttgttaaactttaacaaaatttgcccagtttctttgcactgaaagctgcttattctttcgcttttagacagctcgaatttagttgacttacttttgaaaattattgaaagaaaaataaagtccaatattgctatttacaagccaattatcaacaatacttatacaaactctgcagcacttattcacacacaattctatagaagaacacacacacacgaaaaaaaagaaagtcattgaaggcttcatatttctctcaatatgtcttaagtaggctcttgtaacaacttgtgtagttgttaagaaatttatcaaagcttggaaacagaaaaaatggactattgcttgtccttttaatgtcctgttgaacagacattgcaatcaggcccacctggcaaatatctaattctcaaggagtgtgtatctttgttccacttgctattagtgtcgatcaggatattttaaaactctgtaagagttaatgctctttaaaaaaaaatttgatgaccatgtaaatgattcttgttacaaaaagtgttatttttgtagaaaagataatcctaaaggctatagcttcattgctctgtaggacattaaccagttttgtttctaaatgagaaattttattgaaccattctttatctaaattttttaaacaaggcttatcattttagcgcctctcaaaaataaatttttgacacatgctcatgttaaatttgtaaaactcaggctttcaaatttataaaattatccatagactgtacaccttgacttggaagctactgatttttcaattagagtgctatccagaagaaaagatataaagcaaacattttatgttaaatcataaacctacatttaaaatgcagtactacaaagcttctgtaagataacagaggagaaactctaggtgatcttgggtttggcaagaacttttaaaatataacaccaaaaacataattaacaatttttttacaaaaaaatgaatacattggacttcgtaaaaatttaaaacttctactctgcaaaagacacttaaaagaataaaaagatgctgggcatgatggctcatgcctgtaatcccagcactttgggaggctgaggagggcagatcacaaggtcaggagtttgagaccatcctggccagtatggtcaaacccgtctctactttaaaaatacaaaaattagccaggagtggtggtccacacctgtagtcctaactactcgggaggttgtggcagaagaattgcttgaacctgggaggtggaggttgcagtgagcagagatcgctccactgcactccagcctgggtgacagagtgagaccccttctcaaaaaacaaaacaaaaaaaagaataaaaagccacagactggaagataacatttgcaaaacacctatctgatgcacgactggtatcaaggatgtacaaataattcttaaaattcaataataagaaaacagctcaattaaaaaatgagcaaaagatgcgagcagacacctcaccaaagacatacagatgacaaataaggacacaaaaacatggtcaacattgtttatcatcaaggaatttcaattcaaaacaacacatggcccatctattagaatgactaaaatttaaaacactgataacaccaaacactggtgaaaatgtagagcaataagaactctcgttcatcgctgaagagaatgtaaaatgacattttggaagacagtttggaatgccactttggaagaaatttcagcagttgcttacaaaagtaaacatacttctactatacaatcgagcaaccataccttggtatttacccagataaatttaaaacttacgttcacacaaaacctgcacatgtgtcttaatagcagttttatttgtaattgccaaaacttaggtgtaaccaacatgttcttcagtagatgaatggataaactggaacgctcagtcaatggaatgtacaaaaagcgatgaaaaatgatacatcaagccaagaaaagacatgcaggaaatttaaatgcatactgctaatgaaagaagtcaatctgaaaggctacatactgtatgattgcaattacatgtcattctggaaatggcaaagctacgggaacaataaaattcctagggagggtaaaatgtataggtagagcgtaggggatttttccagatggtaaaactattctgtgtaatactgcagtggtgaatacacattaatatacatttgtcaaaatccatagaatttacaacacaaggtgaagcctactgtaaacggtaggatttacataataataatgtatcagtattggttcatcaatagtaacaataaaggatgttcttcaaacattctacattcagtgtcaagtccattttagaccttaaataagcactgttcagcttctaaaataggaataaaaatattcaattacatacattatttacagatgtctaccaacaatgaagtaggaattgtgaacatactacaattttctgagaatataactaagaaaaagtttggtcctattctttccccaagtttctagccttcacacagtaacaccttctggttgtcaactggtttcttggagtttttaacaaatactgtttgagtctctcttcttttccaggcactgtgttgggtaacatatacataagattttgtttaattctcataataattccaagagatagatctgttacatttcatttttatagttggagcaaaatagagcctttgagctgataaatatgttctcaaaattcacaaagttatagtaatttgagtcataactcaaaatcaaggtttatctaacctgctaagtttctataaaaaatgctaaagtctcatctgacttcaagataaggtgattctataattatattattcagctattccaaatgtataatgggaagggaaaatcataggtttaaaatattttctaaattttatagaaatggtacaaaagattgtttatgctatagtaatctatagctgaatgcattataagttttcacattaattttcattgagcataagataatcatctatgcattttagaaggataattttaattctgcaaagcttacattgactatgctctggtaatgttaacattctggatctgtaataaggagccatcatagctagagggaacttcaagtattctagagacatcaccaggaaggtggccatagaagaataaataaacaaatgaagtttagtgccttagctacttagctattctggtgtaggagctaaagtctaagttattgcattttatgccattcttatcctgacaaaataaacaaacagaaaaagtgaaacaaaccttaggcattctcactcagaccatactcttttccatcaactcctctactactgagctttttcatgttaattgtcccattgcttcctctcccacagactgagaacctattaacatctaataacaaagcactgggttaaaaaaaaaaaaaaaaaaaaagaagaagaaatctttcaggatattaccagactgagcatcaggactgtcagcaggaacagacagtagtgagcaattctcccatattatgcaataaaaccattcaagtcttgcacactggatgctaatgttgaatgcctctgttgctcgattgtcttataaaaaaacagtcagtattcaatcgggtattattcctttctcatagttcaaaatacagaacaacttgagtgtccaaatataaaatctgtgcttttggacacagaaaagcaaatcccagtactgtttaaaataaccccctagaggtatatgacacatatagcagaaaagaaaccctaaacaaataaagtacaataaatgcaaatgcacagatagaatgcaaatgtacagataaaattaagaataaatgagttgctgataacctggtaaattttactaagtttttatttattttttcccctcagaataataagtatatacacagctcaattatctttactaccttcgaaaatacagtatctctccacgtgggaaaaaaaggctaacaaaagagaagaagactattagtagatatacgtcttagggaagttcactttcctagtcaatgaattaattttaaagtcaagtacagcattcttttgctgaaattcatttttctcttatattttgctcagaggtgcacaaaaattgtcagaacagatccctctctatgagacaaattctcttcagcatcatttgtaattgcttcaaggaaaccataactaaaaacttgaattttccacaggtatgacaaaggaggagtccatgaggttaaaagcaaacacaaggtatgactttttccatgcccaaatcggtatcattcacaaaatattctgtatcaccctgattgtttttatcatatgtaaattgctataaaactacatggaattggacaacaaattacaaagactaataaaaaaatacaaggcaaaaagatatggcttaaaaggtaccatgttttcaggaattcaatgtggttcatcttacctcagatttccaaaaagtctgtacttattatttacctttccatgaagtttctccatgaacctgccacaaagctttctagaagattctctaacagatcctaatcatagccattctgtaacctctgaacaagatcccaatttcaccagcatcagtaattgttctcttaagagttctctatttcttgatactctctgtaatttttatttatttatttatattgtttcagattcaggggtttcatgtgcaggtttgtgtaatggtgaggtttgggctcctagcatacccatcacccacgtagcaaaaatggtacccaataggtaatttttcaattcttgccccactcctacccttcccccttctggagtttgcgttgtgtgttatttccatcttcatgtctacatgtacccattgtttagttcccacttgtaagtgagaacttgtggtacttgattttctgtttctcagttatttcacttagattaatgccctccagcaacatttatattgctggaaaaatatatgatttcattctttttaatggctgcatagtattccatgcatataccatattttctctatccaatcaaataatagaatacaaagatatgtatttatatactattagctttctaatttaactctgaaagcatatgcaggagccaaaatcttattgaactgaataaactatacttatttagatattaaaagagggatactaaaattcccttttagttatattgaaccagttttatcctaatacatggaatgtaatcaggcaaaataattaatgatgtagtttactaaacttaattttaaaaagtattgaaataacttagtacaattttcaaggattaaaatgttaagagagtaattatattttcgcctcaattataaattgggcatccacatgaaagtgacaccttaggcttctgacatgtattaaaaccttgtaaatgaactcagtttacagcagatctagaaatgtttatgagtaatttaaccacagcttcccaacaattcattggaatagttattaagcattttaaagaaatgagtttatggatgggtagagttagatcaggaaataatagttcccaaattatcaccctcaagcaattccatttctagtaaatagtccccaaattaccatcctcaaagaaattccatttctaataaagaagatgcttttctatgcacacataagtttacagattcatgtcaaaataaaatttaaaccacagctactgattgaagtgaaacaatgattttaatttataatgcaaactaaccattggtaaacacaaataataactttatttaatagaatataacaaaccaatataagcttttcacttataaagtaattaaattacataaaaagatgcttatgacataattttaagtgaaaaaaatcaggctatgtatctattaaataggaccctcatttaaaattcatatatttatttctctacaatatagcatataattacatacattttaagaaaaatatatggaaggaaatttccaaactcctaattgtagttttcaataaatagtggcattatgagtagtttttattttttaaagcattgatatattttccataaaataatattgcatgcagtaatatacatgcattactattgtaagatactattaaaattatactctatccttgattagccattgttattaaacagagaactcttatagctaaggcttagggaactaagcaaactaccatttattaacatttatatattgctgaagtaaatataacattgatacccacagataaagcttaacatccttagttcttccagtattgttttcctctctctctttgcccaccaaatgatagtaattccaaactaatattttctatttaattagtactcatatatatattcacatggtatattcattcattcaatatctctttcattgaataatgatatattcattttaatgagtatttgcagagttcctactacaaggtattttgtgaggtgtagagaaatttcaagataaataactcactgtctttgctttaaaagaactcacagtctagtcgtagaaataagcaactaaagaaatgactccaaggaacatgataaatgccataatgtacatgggtaaacaatgctagaccatttatttttccaatgacatacttactttttccacatgtgtacatcattgcattatgtaccgtgagttgtcccactgggatcagactgatcacaatgtgtatatcttggtctttatgaaaataattttttaaaagtttattgtgtatttacaagttcctgggtgattgtgggagtaggggtggggcaattttcccatcaaaataataagtatatgtttaataggcattgctgacaacagctattaagagtttgaagacaagtaattgacttactgtgagagttattactagagtaatatttatataaaagatattttagtaagagagttttatgttacataaccaatttacaaatattattttatcacatggcttattgtttatattctctttcttttctttgcacattttaagtattttcagttggctctttcacaacttgcaaagtacaattcgtggcctttgtgtacaagatttcagttttgtttagatcagatttatgaaaagagtggcatgaaaattaaaaatcttccctgttaaagataggaacaccaatagttctcttatttcctaattatgtgctcaagaacaaattttttgtctcatacagaaacttggaaagtgaaaattggcatgaatagcagtcatatgcccagcagttacaacaattgcatgggatcagtgtaatgtatctatggtattgtatttagaagaaattcttgccaggactcaaacatgatgaaagacagtaacgcatagaacacacaaccatataataaggatcacagtaggagaaaccagtggacgtactgtaatgaggccagtgataataaaatcaggaagaaaggtaacatgacggcaaaaacactgatagaaatgagaggtacagtatggaaaagatagataaaacatgaaacagaacacttttttttagtgctaagactaaattaaaatcagagaaattataatcttctcttttactcaattcaagatcttgaatgaagatatgaaatttcttttaaaaatgcaaagagtgcagttagcctacatagcttattctccttttagttctaaacctccactgtcagaccatctaatcaaaccatcttgcacaaattcagtgttattatctcagcaaccttgcctggaaggccattccttgcatttaagcatctctgcatgaaaaacagattcacaacatctggtctgatttccttttactttagttttcattttgttgcctctttgattttatttccttttccaatcatgtctgttgaactgaaaatagtaatttcactgatatctatgttctttatttcacttcctatttttagggttagaggtctaccctgttgcttaaggttagatgtaaaataataatctgggtgactataattacccttgctttcttcatacaatttcaaatgttgacataagctttgttttcttatagtattattcacaccagacacctgagttaaaattgactgtgaatattttctcaatgctgtgtatccatgggctctgatttattttcctttcctgcatctggttgcctcttgtgtcttctgcactagtgaattttcaacattttaagaaagaaactgatcacttagaacaatattattttaacagaaaaaaaccacaagagatatataatattatagcctgaatgataaacataatacttgactttgacagtcaagagtaagtaaatgcgtgcatatggcaccctacattccatcctaatttattctgtggtatatgcgtgtgaagtgaagatgctatatattataaaatcacattaaaggaactaaataagaactggactatttttctcacacttactctgtcatcagctatcaaagccaaaatgcaaaattcctttgttccttatcctactatacagatctatgctgtcatctaaaaaacattgctgtataagacctaatatcattatattttcaatgaatagttatatgtagtgaatttaatcatgttccagtgatactgctttctctataactggcttatatgacatatgttcagctctttaagtgttaatttttataatttgctgtcaggtgccaagaaagaatatatcccctgatatggataatgtcacttctctgtcccaacaaacctaaatttatgccacttgtttataagttgtttatgtcaaaattatctccttgtcaaaacagcaaacttagaagatgaactcctaaatataataataatttacaatggcttaaaaaaattaagatcctaaaggcatacacatatgcatattcacacagacatatatgtgtgcatacatacatatgctttttatagcctattaaatttagtatttataagaataatcctgaagctaagaagctgataaaaaatgaaaacaaaacaaagaatcaaaacatgtttacaaagaaaatataaaaaatagaaaagaagaatacaaataaaccaaccataaggttcaagagaattaccattaatatcctacagatttgtcactatgctttctggcagccaaggcaaaagagaaacataatctgttggaacatgagataattagtaatttttatcatttgctttttatgtaacttaaatattctctttgtcaagctcttttgccccagtggatagctttgaagagcatatattataaatgggttattgactgaggggcctaatggcaaatgaaatcaatatacccacactaagcacttcaagctgtcgatattggcatgtgtgagaaagagtgatatatatagatatagatatatagatatatacacataatacacatattcataagtggcagctctatttccacctctctcccatgtcaattctataactgcatgtcataggtaatttggaaacaaaatctctggtagctttatccctctcttccctgctataatataaacttgtctcatcaagaaatgtttgagctgactcactttacttatttctttcaatagatagatagctatatctatcaattttattttattgctgattattcaacttttgatacctattttctcttccaacagcttcatataaaatcaaggaactctttgacttccctatgaatgaatatgccttactagtataattgggtgtgtcatatacaaagacaacacagacatagaaataagcctggtacctactgtctgataagtactgggagtattctgaattggaaaatggggactatgatcattctgaaaagaccacaggtatgtcataatatagagaagcaatcagataaagagaggcattaacatatagataaattatgtggccttattgttgtttgactaaattatgagtccttgagtgttgttttggctttgctgcttaccagttctataaacttagatatagtgttaaccataaacttgcatttcctcattaataaaatggggttaataagatttacagtctctgagacagttgtaagaattaaataaaaatatacatatagtccgggagcagtggcttattcctataatcccagcacgctgggaggctgaggcaggggattgtttgaggtcaggagtttaagaccggcctggccaacgtggaaaaaccttgtctctactaaaaataaaaaaattagccatggatggtggtgtgtccctgtaatcctagctactccagaggctgaggtgcaagaatcactgaagtggaggttgctgtgagccaagatcgtgccactgcacttcagcctggtgacagagctagactgtgtctcaaaacacacacacacacacacacacacacacacacacacacacacagcatagtagctggcatttagtaggcatgcaaatattgattgaattttgattttacttttgcaagttggttccatcattaaattattccatttctttcttttttttttttttttttgagatggagtcttgcactgttacacaggctggaatgcagtggtgtgatcttggcttactgcaacctccgtctcccaggttcaagtgattctcctgcctcagcctcccaagtagctgggattacaggtgcccaccaccacacccagctaatttttgtagttttagtagagacggggtttcgccatgttggccaggctggtctcaaactcctgacctcaggtgatccacctgcctcagtctcccaaaagtgttgggattacaggcatgagccaccatacccggcctcttttattttttagtggtaaatagaaatttagttgtaaatagatagctccaccgatagtgaggttaaaatgctcaaagtggaaaatgctcatgagacaaaataataactgatttcatctcacatgaatgtgaaatacctcagataaaattcatttgttcaatataatggttattatttcatgctgtattttatattactcataattcaaggaacataagaaagtaatcactaacccaacagatatacaatattaaagagactgtactgaattaaattagttgcattttttattatgagaaccattgattagatgcatagagtttattaatcctctggctgttcaaccctctttacctgtatatttccctgctgactgtgatttccttgaggaaaaacactttgtcttcttcatttattaaatgttcagtaccaaaaagagtgtcaggaatacaataagcgttcaataaaagttgttcaaatgaaccaatatcatacattggctttttcttacatttttatttcattaattactttgtaaattattttcagtttactcatatgtcaatatattaacagttaacagagacctgaaatattattgagatagagcagggataccactttttaaaagcctatggatctcaatcatggacataaagacaaatgctgagtttctaggatggaaattctaggaacctagttagtcctagaaataaataaggaaaataaggaacttgttaaacaagaagataatcgtagcctaaaacaacagccaaggaagttagagttccagagatgcttgctttctgcatagaaacttatggtaacatcttaatgtcactgagttgtctttcagaaacttggacccccacagggaaccccccacctaagggatccactggcatgaagacctcagataaggggaagtgaagactgaactttaatcatcatatttgttccaagttttttcccgagggccttggagaaagtcactccccctacctagttaacatttttctactcactccaattcttaaacaaacttctctgccttaaccaattgcaaatcagaaaatcgttgaatctacctatgacctgtaagcccctgcttcaagaaatcccacccttttaggcctaaaccaatgtgtaacctccatgtattatttatgattttgcctgtatcttctgctttcctgacatttacccttgcctttagacaaccttgtgtgcaagccatcaaggagatcaggatttgagcatttagctgcctggtcctccttgcttggcaccctgcaatgaaagcctttctttctatcactatcctggtgtagatatctggtatattagtccattcttacacctctataaagacatacctgtgaccaggtaattgataaagaagaattgtaattgactcacagtgccacatggctggggaggcctcaagaaacttaaaatcatggcggaaggtgaaggagaagcaagcacttcctacatggaggcaggagcaggggcaactgccaaacacttttaaaccatcagatctcatgagaactgactcactatcatgagagcagcatggagggaactgcccccatgatccaatcaccttccaccatgtccctccctcaacacacggggattacaattcaagacgtaatttggggggagacgagccaaaccatatcacctcgttttactgcacagggtgagcagaccccagtttggtcctaaaacggtatttgcaagacagctactgtacaatccgcttcattaataaactgcccttgcaaaatcatgacagtaagagaaatctgacatacttgactccatcttgcttctgacctctaagctgtgcttggtcattcctgggcatcagccaagctaactttgcgaggaatttatagtttaactttgaaacaaaaatgataatattccttccctaaaactaactcctccttgtttggagactgaaactgtctttgtaagactgagaggccacaagatagatgtaatttctaaaatcgcttactgatcaggagttatgtggtcaggagtcaagatttgtgaccttctcaattgctcctacagataacatcactactgtagaacctcagatttttttttccagatgtttttcagactaaccccaactggactcatgactcttgaatttactggtcttgtggcctcactcagaggcagactcagtacctgaggaccgttttctacacctttatgattttatcctcaaccaatcagtagcacccataacctaaatccttgaccaccaaattgtccattaaaaccccctaacttccaagccttcagagaggctgatttgaccaacagcccaggttctcttacatgggccagcttcaggtcaattaaactcgttcactactgcaatgctgtggtctcagtagtttgattttgtttgtgcagcagacagaaagaacctgttacatgattgactaaactcctagcgcatacttattgagattctattgtgtgctgggcacttggctaatttcaaggtaaagcgtaacagtactttttaatgtcctgactgtcttgagcttaaagtcctttaagagaaagagatattaaattaaataataagtataaaagtaacaacactttgcctaatgttattttagagaacaacttatgaatacattcacataagatgtttaaataagacactttaggtcagacttctccaacctgcagccctgtggcccaggacagctttgaatgtggtgtagttcaacacaaatttgtaaactttcttaaaacattatgaggtttttcctgtgggttttttttttcacatagtctatcattagtattagtgtattttatgtgtggcccaacacttcttcttccactgtggcccagggaagccaaaagattggacacccctgctttagatccatgaaaaatggttaggggcagaacattccaaagagaggggagatgtgggagaagtaagcgtgatatcctaaagccagggcgagtttggtggaattgtataatcatctcctgcctttgccctaaggccagggtgagtttggtaggaagaaatacagaagagttaagcaactatctaaaggatgctgtttcaatagtatgatcaatcagagtttaacattataatggacacagaatgagtgtctttatacagattccagtgaatttatttggactctaaaaatgtttagagtcaaataaccatgattgcactccttgctacacagctctggcttagatctaatcaaagtttttgatagactgcttgacacagaaaactatggttgtggtgttaaattatgtgatttatattaaataagtgacctgatgtctagaacataatgtgttctcaataaatttatttattaacaataaattgcgttaatattccaactaataaattatttaagaaaaatatgtcgaatagagtgctaaatgattgtagtcaactaactttaaacagtgcatctaatttcagtgtttcctttttaagattggctcaaaatgaggtacactgacccccatcattgccatttgcattcatttatatccagtgttcttctcttatatatgagtaatataagaatcctatatatctttctaacttgaaaccacaaaaacatctcctgaacttttcctctggtggtttgctttgggtagcactaccaactcaatttcctattcttttgctgcatatcatatttgagccatacatcataatgtacttgactcagatgtctggtgttcctgtcctatgctgcactagcttgcaaggtcttgctttttcttgacaacctgcctcttaaaacagatttcaaactaaacctcctggttttgtaatttgatccaagtctactcccttggacagaatatcagtaacaggatttgccacatcttttcctttcagccatactgactaccagggtggaaatagtcatattttgaaagcagcatcctttcagactgctttgtccgcttatatatacattttaactctttagtttcactccacagtggaaagagagaggcaaaaatgggtttctctgaaattgctatcagcagtgttatctctcttcaagaagaataaaaaaaggatcttattaaatggcagttaatgacaatgaaaaaagggatctgagaactaatgaaaataattttgaggaatattctctaactatatgcattatcttggctcccaaagaagacccacctccacttttgaggaccatcatttagaatgggcatgaaacataactcagtggtttgatgaagaagtgatgattgagattctttcatctcttcatttttaggcactgtttttcatcaccaccacaaagaataagaatggaatacaaaatactgtgggggtttttatgttcattgaaaagctttttcctgtccaaggtacttgttctataagctttcttgctgcctggatttccagtgttccaaggaaattttcaaaatgtatatgaatttgttttccataccaatgcctgagtcttaaaccaaaaactatatgaagaaaagtctttattgttataataataagctgatgttgaatacttgtacatccaaggaattcttcatatattattagttccattaatcttccaaatgacacaaagagataattagtatcattaccttcattcttatcaaagatatagagacaaacactaatcaagcaacctgctcctagttcaaataccaatatattaagtggtatagagttaggattacatctggacaattcaactcaagagctcttgctctaaaccacttctccatgctgccactcttgtataattatgtcattataagaatatagatagtataatgatatagataatttttccatgactatttagtgaaataaccatacttatatcttcctcatagcaaaagcagatcatttcgatatgttttgatttcttaagttttaaaaggtttctgaataaaattttctttcaaaggattttatttacatagaactaattaatttacccttttattaaacactatgaattttctcttcaaagggctcctctgatactaataaatgcctatcctccgactttccaagaatatcaaacaccagccaacagatttatgtgatagtggaaaacacccaattagcttcggtagaatgctttcttaaaagtgcatgtattctaaccttgtagggaatttaaacaactgtgcttaaaagaaaaaaaaaaaaacaggaaaggaagatttgagtcaattcatcatttttattatgtactctcaactcgacccaaaacacatctaaaaaaacctatattttagtgacatttactactactttgccactccacttttaaagcagcctatgtgaatatcaagtggatgggcctgtttctgtacaatatcacatactataggagaaatatctagcaccgatgataataataataataatttaaaaactctgaacactgctgtttgttagattactccagatatttgaatattccttttctttcttagttctttaattagctgtggctttgatatgagacatatatttatttgaagctaaaagcccactttcacaacttttacatattttttttttttgagacagagtctcgctctgtcacccgggctggagtgcagtggcatgatcttggctcactatcacctctgactcttgggttcaagcgattctcctgcctcagccttctgagtagctgggattaaaggtgcccaccaccatgcttggctaatttttgtatttttaatagagacggggtttcaccatcttggccaggctggtctcgatctcctgaccttgcgatccacccgccctggcctcccaaagtgctgggattacaggcgtgagaaaccacacccggccaacttttacatatttttaaatgttttcattcattatttgcagttctgttctaacgcataaattatagtccttcctggtatcaatgcagagtttgttctacaaccccaacggatatcaaaatccacagatgctgaagttcctggtgtaaaatggcatagtatttgcaaataacctacgtgcatcctcacatacacttgaagtcatctctaaattacttataatacctaataaaatgcctacacatagcttcatctgcacagattcgacatagtactcaatgtacagtcaaattcaagttttgctttttgaaaatttgtaaaatttttattttcaaatattttttatccttagttggttgaatgcacaaatatggaacccatggatgtggaaatccagttgtaccttttaaatctccattttttatacaattcttattttccaaatggtggccttttttctctccttcaactataaaattatagttcattaaaccatttatttattttcatagagtatatgtcatattttagtcacaaaacctcgaccacatgacagaaggggcacctaatcattctcattggcacacaaggtcttgttaaaattataaagtagacaaatattctcttcagtatccttctatctttatatcatcttttaatgttccttcttccaaacccaaaattttaatcatccttaagctgtacaaagtatcctacctaggtcagccataaaggtcttcctgatatataaatattcctccaactttccatttattctttcaataatactcttactctttagtgaatatagccttggcaatcaatgtttggattaaagaaattcacactaaaatgtcaatgactgtaattcagatgtctaatgagtacattaaacattttaaaagaacagtgtataaaacctagctgaaatgaatatataatttatacactggaatggagagatatttttcaattggagagttcttcatactaatctttttctatatgagcaggccacaaccacacatatctcattttcttgacagaatcctgatggcttaagttgaactagaatatttgaaataacttcaaagagcattggcatacttttttgctaataggtacagtataccaaaacaaaattattaaatttctggagttatcctatcagccaaattatttttctatcaagtccacttctattgacattttctgggtattctacatatctctcatattccaaatagtgaatctgcctctagaaatatggctaataaagatggcttcaaatcaaatagttaacctgcctctagaaatatggttaatgagggtgggttcaatgggaaattcctgggaaagtctgagcaatgagaagtggtcaaagagaaattttgggatttgagaatttagattgctctaactttgcttcatgtttttggtctacttaacatgccttctgaattttcacttcacctcatctcatcctcttcaatctaattctacagagaattttctaactgttcccaaaaaaaaaaaatgtctttttaagaaggatagagatgaacttgggaatcttcttggttcaatagttactgtggggaaaccaggagagataatataatcataataaaataaatatagccaaacatagtggtgcagtatgatgaatatgacatctattatcaagtctgattttgtggaattttaaattggaaatgctttgggaaatccagaactcaacggatatactctgatggcagtgagaccataactatacaataggtcacattgtcttctagctgaaattactaaagagacatttagtttatgtattaaacacaaaacaagacaggatcgataatatttttatagttttaatagttaggtcaacatctagaacttaaaatgcaacatttaaaaccaagaacctgattatatagaattagaaaggtacaatcagggaccttcacttattccttatttttctcctaaggaagtcttttagagtgttctgatactgccagttctgctctgggaaatctccatactcaggaagcaccaagtgccctagacctttcccaattctctctccctaccagttgcgttttctactccttcagtggcctggcttgctccactgttattctgattaagtaatctgtgctaaaagcaagcaataaacatccagacaaatacatctatatttttaaaaggactttctaacatgaatgctctaattacaaaatgttgcagtaaatctattcaggaaagctttataagtaactaaatacatttaaggatggctgttaaataatcagatcaaaaagataaaaaagatcagccttgaccttggaacaaaactttggtagaataattatctttcaggtggagtcaagattgcagaccagcctgctcttcacagagtattctaatcttcagatagaaacactcactctcttccctctagtagttccatcatactttagtacctactcaggcctacttctagaaaaaccaaaggggcatttatttggtgaactttgcaacccagtaccaaataaagagtatgctagtcccaccctgatgttaggccctggtactagcaaacctaagcttctgtgccttggccccacgcttttatcatgcacaactgtttctgtggaatagagtctacctctgatcctcagtccttgagatgaggcaattctaaatactgattgccccccactcctgacctttccctctgcctttctgcatattaggtgtatattggttctctgtcactgggtttcccctgccttctagaataatcataaataatctttgtcaggaccctatcacagatcatcttcccatcttttgcctacttctcccattaccagacacaaggctccatctgccagagatgtactgttcgtgtttggaatgcgtgctgtgtttctaaggctctttctcatcctggtgttggtcataaagtgcctgtgtctcttaaaacttacaccattagcaagcatttaaaccagcggaactcttaaaggcaattgagccctctcaatatatagaagagtatagagatctaaagagtgaagtgaattacccaagatggcataatatgtaactggcaaagctgtgattagattaatttgaatttcaacattcaacacatatttagcttctctcaacttcaatttcttctgtcaatttgaaaataataatgtcctatttgctaacagtgtttgaaaattaagaaagacatgttaatatgcctaaaattatttttctggcataaagtaggccttgagtaaataatgtgtcctgtgttcacattttttcctcacatctttggtaaaatcattgattcttaaagtatagaccagaatattaagaaaaataatataaagcaagttatgtttaggactaagttatctaaatgcttactgtaatggagctattcagtatactcctttaatttattttgattttgtgtttttctttgattttgtttttccttctggtacataaacactatcaggagataacatttttatcattactatattatataaatatttttagaaactattgtcaatatagtaattatgaatatgataattaccatgaggtaattttttatataaatatggaattcaaaaataaatttaacaaatatttataaggtttaccattggataaagataatgtgggtgcttgagacacagtgctgaacatgaaagacaaagttcctaagcaagagagtctacattttattaaaaataaatgatgacaaaccagcaagtagataaggactataatttcagacagtgataaatactgtaaataaaataaaatgaggaaaataactaacaacaaacatggtggagttcaattttacatgagtgtcttttagattggttctgagacacagcttcttgtatgaagaactatatgcagagttcctccaggaaacacacccaaaaggaaatgaggaaggaattgtgcaaaaagagaaggtgacccactgagccctcaaatgacattccgaggagctctgaagcctgtaaggattctaccaaattggggcaaggagatgacctatccccatctccgtcagtcgctgatgaaagccatcacttgaaagggtataactttgggcctagaagtttcctacggcaaaattgtggatccaagtacaagagtaattatcacaatagaacatgaaatctaagctgagtaagacaggaaacaaaaacgtgaggaatgaaaaacatgcattcgatattccagcaagataaaaagctaatttggcatgaaggattagagaatacataatcagaaagataataaagtggtggtcagaaaatagcatcttaaaagagagattctggaaaagaaaaatatacttggaataataagcacaggaatggctgactacaataatgttgaagaaaaagatcattaaaaatgaagaggccacaaggttgagaggccaaggtattaaataggttggtggaacaaatgtgagctgcacagaaagatagcttaaaaagtagtagaagggaaatcagagagccaaatactattttttttttttttttttttttgagacagagtctcactctgtggcccaggctggagtgcagtggcatgatctcggctcactgcaagttctgtctccctggtttacaccattctccttctcagcctcccaagtagctgggactacaggcgtccaccaccatgcccagctaattttttgcatttgtagtagagacggggttttatcgtattagccaggatggtctcgatctcccgaccttgtgatctgcccgcttcggcctcccaaagtgctgggattacaggcattagtcaccgcgcctggccccaaatattaatttttatttaatgtgagccagtatcttttttattgttcctggaatattatttggtaaaacttgaaaaaaaaatgaattcaattaccaaatagtttaggaaacacttaggtgaaagtcacataggtgtaataactctaggatttcttgaagtgattaacactttatattaattttaagtatccaaaagaaagataacatacatcaagttttataaaattttcagtgattatatcacaggaattgcaatataagtaacatgttgaggaaatgctaataattcagagtagcaggtcacaagtctttgaaacaggatacaacttatgagtactctatcttgtaaatgcacagacacacacacattgtatacagttttatgtagttagcacaagtcttggtggtaatccatagagcctacattacaaacctctactctccattcttgctggtaatatctggtccatgggtcagcactattggcaccccttgagaacttgttgtatatccagaatctcaggtaccactccggatttactggataagaacctacatttttaaaagattctcagatgatgtgtatcacattcaagtttaaaaagccctgcactagaaggttacatagttaattttcacactcacaaagaaaaactgttttacattgttagagaattactatattttcaaacagtgttctgaaatgtctctgaatatttataatgactcaaattggccttaaaaacaggtgggaattagctctcttaatattttgtcacttttataaaacaaaatatggtaacatggtattaactattaattttatagttggtacaagcaatagagcttgaaaaggtattttcttgtgtcttaataccactaatgtatgatttataaaggcatggaaatacaatctcaggagtcttaatatttccttagaagattaaacagccatgtaaatccattatccagaaggttagacataaatgtcagttcctgagtgtcccacaaaggaaagtgtggattcttaataacagagaggacacaaggtctttccttgagagatttatgtctgatcacaatttcccacgtttaaatatccacaatcaacaataggtacaactttgtttgccaaaaaagacttttaaaatatcaaatggggagatacagaaaagaatataggacaatattttctgtgcattaaatcttcacagataaattctactacttgatataatcagtccagtccttccttccttacagatatatcttttaagagaagaattagtaattattttattctcctaaatttattcttcttttttgtttgtttattggtgaaacaaaaggattattaaaacacttaaatatattagtatgtttaaaacaaatgctctggttaggtaggttagttaggtagttcaaaaatgggttttgaaatgggcaccttgggaggcttcaggatggctgactagggagcattttgtacttgctttctccactaaaaagagctaaaatacccagtagatattagatcatccaagagagaacactggaatccaacaaaatagtgacaggcaatatctaaagtaaggaatgggagaaggaagcaagcagcctgttcagcctggattgactgagagcctagagagactccccaatagagggaaacggtaggtgagagatgctcagcagcctgcattttcatcatagactcctatagtcctagccacgggagagtcctcaatactctcaggccatgaaactaacatagggagttgcaagaagattgtattatggcagcttcccatggaggaagcttgaatatggtcatggtccttcacattccttgtgacctaagcaactacagcaagatgccattttagaactttgcctgcaacagactgcacactgtcctggaacccaggaatgctgaggctaatgtgcaagagaagcattaggctgctgctcccagggcttaggcacaagtgaccttgggccactacactctgatggagttgcaaccagggtatgggatgccatctttaggactgaggtgccagcaaggtgccattctagagcaccatccccagcaaactgcacactacctgaagcccagtggtgctgaagctgaggtgcaagagaagtgatgggtactgcctggggtttagacacaagtgaccacaggcttctccacccaaggctgagcaagggtgccaccaaggctgtggtgcaggtggcatgcatgctccccacctgctgtcctaggccatcatcactgaagctggtaccaccctcaacccccactggcagggcagcagggcagctactatagcctcccactcaagcattccacaatgacttggggatcaccccgctcctgactaccatggccagtgcctgtacatgccatctgggggcctgaagataagccagcctagcccaggtttccccatcatccccatgccacagcatacagtccaggggccagggaatctcccagtttagttcaccactgatgacatatgaccactcctctcggggacctgaggttaggcctacccacacagcagctactaccacaaattaccacctgcaggcctggacactgaccttcccagaacattacagttacttccaatgacagcatgcaccacaagggacctagagggttgtcacaccactgccactcgcattgcctacgccatattagctgcccatggacccaagaacccacttacctgctcagttcacagctgccactactgggctttgagtaagccacctgaaggaacaaaaattggcccacctgtatgacattatggggcatatgagcaggcactctcagcccactgctgcaaccacaggagctcaaagactggtccacttgacctctgagtcccaagcaaaactgcaccagagctttcctcaataactggaccctaagccaccaaggaagtctcagatatcactggcactgtttgtagccaaaaaaatcaagggagactacactaattcatgtacctagaattgaaaccagagttccccacccaaccaacaccacagattcttcctcaaaaaaagtccttccctgtgaaagcaaattgaaaaagttagaagaagcaactgctacatgagatgcacggatatcaatgtaaggacacaggaatcatgaaaaagcaagaatatatgacagctccaaaggagatggaattcataaaatcctagtaaaaattcaattattgattctaaataatttcagtgagatataagagaattctaaaaaaacaaaacaaaggaatcagaaaaacaattcaggataagaatgagaaatgtaacaaagtgatagataacgtagaaaagtatcaaacagaaatcctataaatggagaatcattgaatgaattacaaaatacatttaaaagcttcaaccatagactagatgaagcagacaaaataatttcacaacttgatgacagtgttttataaataaccctcagacacattttttaaaaaaaaagaatgaacaaagccttaatgatatatgggacagaaaaaaaagtgataaaatatataaattattggtatccaagaaggcaaagagagaaagagtttaaaaacctatttaatgaattaatagaggaaaatttcccaaatctagcaagagatttaaacatccagatacagagtcccagcagtcaccaaacagacacaatacaaaaagttcttcttcatggtatactatagttaaaatttctaaaatccatgaaaaatagagaatttttttttttaaaaaaaagcaagagaaaagcatctagtcacctataagaaacctccatcagaacaagagaaaatttatcagtagaaaccttataggccaggagagaatgggataatgtattcaaaatgctgaaagaaaaactgcaagctaagatactatatctaacaaaattatccttcataaatgaaggagaaataaagtctttctcagacaagataaaactaagataattcatcaccactagactgaccatacaataaatactcaaagaactcctaaacatggaagcaaaaggacatttatctacatgaaaacacacaaaagtataaaaaatggtgaagcaaacatacaaatgtggaaaaagatagggctcaaatactatccctacagataactaccaactgcaatgacagacattaagaggaaaatcaagaacaaagaatatacaaaccaaccataaaacaattaacaaaatgacagcaataaaacctcacatatcaataattactttgaacataaatggattaaattcttcacttaaaagctatagactgaatgaatggattttaaaaaaatgatccaactacatgccacctacaagaaacacactttacttgaaaagattcctatagactgagagtaaataaatagaaaaagatatttaactctaacagaattcaaagtgagcagaggtagctatactcatatcatacaaaacagacttgaagccaaaaacagtaaacaaagacaactaaatagtgataaaaggaccaatctagcaagaggaaataacaattctaaatatatatgcacccaaaactggaacacccggattcataaaggaaagattactaaatctgaaaagaaagactccaatgcaataactgtgggggaatttaccaccttattctcagcactagacagatcgtctagaaagaaaatcaaaaaagaaacattgaagttagagtggaatttagaacaaacagacctaacagatatttatagaacattttatccaacaactgcagaatacacattattttcataatcatacagaatattctctagaacagaccatctattgagccacaaaagaagtctcaacaaattttaaacaagcaaaatggtatcaagtaccttctcagatcacagtggaataaaacaagaaatcaataccaaaaagaaacttggaaactatataaatatacaaaaattaaataacatgcccctgaacaaccattgtgtcaatgaagaaatttaaaaattttgaaactaatgaaaatgaaaacaaaatatatcaaaatctgtgggatacagctaaagtagtactacgagggaagtttatagaaataattgcctacatcaaaagtagaaatattacaagtaaataatctaacaatccacctcaacaaagtgaaaaatcaagaatgaaccaaaccaaacattagcaggaggcaagaaataataaagatcagagcagaactaaatgaatcagaaactagaaaaacaataaaaagcatgaatgaaatgtaacactagttttttgaaagtataaacaaaattgaaaacattaaaaaaaaaaaaaactacgagctagactaacaaagaaaagagaagacccaaataaactcagaaataaaaaggagacattacaactgatacaacagaaatacaaaagatcatcagagactatcacggaaaactgtatactaacaaactagagaatctagaggaagtagatacattgctagaaacatacatacaacttaccaagattgaatcaggaagaaatagtaaacctgaacacaccaagtagtgaaattaaatcagtaataaaaagtctcccaacaaagaaaagcccaggtctggactgatttactgctgacttctaccaggcctataaacaagaactaataccaatctttcccaaactactccaaaaaattgtaggggactgatttcttcctaacatattctataaagccggtatcattctgataccaaaagcacacagggacacacacacacacacacacacacacagaggtataggtcaatatctctgataaacataaacacaaaaaaccccaacaaagttcaagcaaactgaatttaacagcacatcaaaaaaataatacccaatgatcaagtgggatttacccaagggacacaaggatgttcaagatatgcaaatcaataaacatgaaacatctacagaataaggaataaaactcatatgctcatcttatagacaaagaaaaatcttttgataaaattcaacataccttcatgataaaaaaattctcaacaaactaggcatagaataaacatgcctcaaaaaataaagtccatatatgtcaaatccacaaatagcattatactgaatggggaaaagtttggaggccttttctctaagaactggaacaagacaaggatatgtacttccaccattcctaatcaacaaagcactgaaagtcctagccagagtaatcaggcaagagaaagaaaaggcatccagattcaaaaagagaaagtcaaattgtccctctttgcagatgacatgatactcatatttagaaaagtcaaaagactccaccaaaaaacccttagagttgttaaacaaattcagttacactacaggatacaaaatcaacatttttttaaagtagtatttctatacaccaataatgaaatagcaaaaaaaagaaaaagcaaaacaaaaacaaaacagaagaacagaacagcaatcccatttccactagctaccaaaaaaattacataggaataaaccaatgaggtgaaatatctctacaaggaaaactataagaatctgatgaaagaaattgaagagaacacatacaaatgtaaagacatcccatgttcatggatcagaaaaaaataatagtgttaaaaggaccatactccataaacaacctaaagactcaatgcaatccctatgaagacactaatgccatttttcacagaatagaaaaaacaatcctacaattcatttgaaaccaaaaaataaccagaatatccaaagcaatcctgagcaaaaataataaagctggaggcatcatactacctgacttcaaattatattacagggctataataaccaaaacacttggcattggcataaaaatagacacatacccaaatggaacagaatagaaaactcaaaaataaatccacatatttacagccaattgattgttgacaaagcaccaagaacatgcactggaaaactgaggttttcttcaataaatagtgctggggaaattgaacagtcacaggcaaaagaatgaaactgaacccctatctctcactgtacacaaaaataaactcaagatggattaaatactcaagtgtaaaactacaaactataaaactcctagaaggaaacataggaaacgcacttccaacagtcgtctaggaaaagattttatggctaagacctcaaaagcacagacaaatggaacaaaaatagacaaatgagactatattaaaatcaaaaacttctgcatagcaaaggaaacaatcaaaagagtaaagaaaccacctgtatgggagaaaatacttcaaactatctgacaatggaataatatccagagtatataagatactcaaacaattcaacaataaaataagaatcccattaagtaagaagtaggcacagaacattaatagataattccgaaaggaagacatgcaaatggccaacaggtacatggaaaaatgctcaacatcactaatcctcaggaatatgcaaatcaaaaccacaatgaaatattatcttactccagttaggatggctatttttttatttttatttttctacccaattgaacagagagtgtctattattaaaaacgcagtaaaatatcacatgctgacaaggatgtggagaaaagagaatgctcatacccttttggtgggaatgtaaattagtacaaccactattaaaaacaatatggaggccgggcacagtggatcatgcctgtaattgcagcactttgggaatctgagacgggcaggtcatgaggtcaggagattgagaccaccctggctaacacagtgaaaccccatctctactaaaaatacaaaaattagccgggcgtgatggcatgtgcctgtagtaccagctacttgggaggctgaggcaggagaatcgcttgaactggggaggcagaggttgcagtgagccaagatcatgccactgcactccagcctgggtgacacagcaagactctgtctcaaataaataaataaataaataaataaataaataaataaataaaaaacaatatggagatttctcaaacaaactaaaaatagaactacaatatgatccagcaatctcactgctgggtatgtattcaaaggaaaagaaatcggtatatcaaagggattcctgcactcacatgtttgttgtagcactattgataatagcaaagatatagaaccaaacttagtgtccattaacagacaaatggataagaaaacatgtggtatatgtatacaatggaatactattcagccataaaaagaatgagagcctgtcatttgcagcaacatggatgtcattatgttaagtgaaataacccaggcacagaaagacaaattattgcatattctcattcatatgtgggaactaaaaagattgatctgataatggtagagagaagaatgatagatactagaagctgggaaggttgactgggttggtagcggagggtgaagagaggtaggttaataagtacaaacatgtaattagataaaaggcataaattttatattttgacagcaaagtagagtgactatgctttacaacaatataatctatatttcaaagtagctataagaaaggacttcctaacccatagaaataataaatcctcacagtaatggacacttcaaaaactttgacttgataattgtgtattccatgcatgtaacaaaatatcacatgtaccccataaatatgtaaaatattatgtatccataaaaagtgaaattttaggctggatgcagtagctcacacctgtattcccagcactttgggaggcagataatgaggtcaagagatcgagaccatcctggccaaaatagtgaaaccctgtctctactaaaaaaaatacaaaaattagttgggcttggtggtgcacgcctgtagtcccagctactcgggaggctgaggcaaagaaatggctgaacccgagagggagaggttgcagtgagccgagactgtgccactgcactccagcctggatggcagagcaagactctgtctcaaaaaaaaaaaaaaaaaaagaaaagtgtgtttttaaatttctaagagcttcataataaatgtgatatatatatatatatatacacacacacacaagaaaaaaagaattcagaattacagggttgaaatgaatcctgctgatatcaattctttgtagaaataccttggacatggattgtattttttccaaatgaaattcctacaaattgccatttctggagtcttgacttcatacagtctataaacacaccattcaatgttgatatttctcaacggatccttagaagtaaacattgcacaaatatattctttactttataatcctcaagtttgcatgtaagtaacttattctgctttagttacaatcaatgacttttgcagcaatttttaatgctgatcacaaattgctcaaaatgaaactaataagatttgaaaatatatattaatatttcctcagtagctcttgctaaatgaaataggcccagtttcttacagatgtctcagtgaatcatcagttttttatcacttaatatttttttctatgaccactccagtttctccatatctctcacaataaaggagcatgtatgattctcaaatcatgatttgtttctaacaaaaggatataaatattctgtctttcatgtaggtctattatatgcatcattgatgatctttttgtttctttttcaaaacaagaagctatttttttttcaaaacaagaggctgtttttctattgttgatagactcttacagtgaattgtatctaccccctcttctggcatgcaactgtaggatgaattggttctagagaaatgctatgtttatttttcaacattgcagatatcgctttgattttttccatatcaatctagtcactgaactgctgttgtattttgagaaagatgatttttttttctttttttcttgagatggagtttcactccaccacacctggttaatttttgtatttttagtagagatggggtttcgccatgttggtcaggctggtcttgaacccctgacctcaagtgatccacctccctcggcctaccaaagtgctggaattacagacgtgagccaccactcccagccaaatttcatttttaaaaagaagtttgctatgccaagaatagctcaggaggtaggggggcagctttaactccttcaatccattaatcaaccactactacacctggtggtagttttacagccactccctgtccaactccaactctcatcttctcctgtacagaaaatctagggctactaggctatatatgtatatacatattcattaagaatgataattctacttggtcatgatgtttaaaagttttaaaaactttaaaatacgctgtcagataagatttgctttgtttttcatgatttcccattacatatatgtttatatgtgaagctggcctataatttttttcttctcctgactgctgtggatgttaaaattatactaacaaatttaatcatgttctttatatcgtatttagtcttaaaataatttgtaaaatatgggaataatatgtttcttgaatgtttggtagaatttgacagagcaggagcatcactgtcttggacaagcactatcattttaaagttccccttgatcaaaaaccacctaaatccaaagggcatcagcctaatggctaaggtcagcatgaacataaaccacaaatgacatctcgaaccagaaacattccaaccctaagataaatccctcccaaaccagagacatgccagccctgaggtaacctcctctctgcccagagagatgtttagccccaaggtaacttcccctctgatcagagacattacaaccccacaataaacttctccccgacacgaaaacattccaagcctgtgataagccctcttgccctaaacacttaaatactctcagtctgtaagagagaatgctcctcactgaaatcggccagaagcccctctcaggtttattctaaaaaataaagttgtctttggctgttgagctgctttttgtgtttctttcctctttctttaactcttacagaatttgcttgggaaaaacatccatgtctggtgtctttggccagggccaaaggtggaagagttaatgttgttattactactagttcaatttattgaccacttggcaacttactcaggttttctactttacttgtctattttattaagtatatttatttaagaatattttatttcatgaaaattgttcatttcatctaaattttccagtttattgaagctgcattcctaaggtttttcacagtattctcaaattctatttatgcactactttatttacagtatgagttctccttcacagttaaatattccctgtattaaaaaaaaattattcagtcctgcaagggctttgtttattttactaaattttcaaagaatcagctttaagtactccatatatttttgtttattttacattaatttcttcacaactttttatttttattttcttctactttttctggattaactctgttgttctttccacagttttcagagataaatgcctaaataactgtgtccctttttcttagttttaaattaaaaagtttaatactataatttccacagtcattgcagatttagacgcattcagttgcattccacaggttgtgaaatgaattctcattgtcttgcaatatatttctaatttttcattattttttcttttacatattagatatttataaataaatttgttttcacacataattttctgtatttttattgctgatatctaatttaattgtattgtgttgagataatgtagtttatagtgacctcacttttcgaaacttgaagagactttcttcctttgttacataatatgtagtcaactttcataacactgtgtgtgtgaagagaagatacagtctctgtttgctacaggggtattaattaagactttgggatgacttgttcaaatcttatatatcctttttaaaatttttatctgagctttcaatttctgatagcattgtactcaaatattctatcatgaggctgaggcaggaggatcacttaaatccaggagttcaagaccagcctgtgcaacaaagcaagacccatctctataaaaaattaaaaattaaaactcatttttccatcatgagtttgaacttatctatttctccctatgatttggttggttctgctttgttctgaagctatctacaaataattgtgaattatatactgtgtggattgttctttttatgaaaatatattgttatttaaaaaaatcctctatagatgtttttgccttaaattctttcttctgaaattaatattttgacacaagttttagtatttgcatagtatatctatatttaatttttctgtctttttaaaagatattttcctataagattagcagttagtttttttaatctaatataatacatttaatattttattagaaaactaataaatttacaatgagtatgattattgaacatatttaaactgatctctatgatcttgttttagtgttctgtttagaattccttctttattgtttttaggggaggatcttatttcttgcttttttgattttcatgtgctctcttttttccttttattaattgtgtaactgtacacacactcagatacgcataatttctgacagagattaaattttagtatgtcctgcctaccaactaaataagacaagaatcttagcatatttaaagtactaatggaaccttcctcttccttctcccaagttctttttcctagaattttagttttacctatatacacatttgtagttttaatgtgctacattcttcatataaagatatatatatatacacacacacacatatatacacacacatatatattcacacacatgctttttatcaaagtttaatgtatacaatgttcataaagtatacatctcacagctgtactgctctataaactttcacaaaccaaccacacatatggaaccaggactgagattaagaatacacaacattaccagctccccagaagctccttcgttccccatacagacccactgctctttttccaaggatgaccacatgctgacttctaccagcataaaattgttttttgtcattttgtactttatatcacttaatcatctacaatgtattttttgtattttttattcaacccattatgtttgtgagaataatttgtatcatatgactgtttcattcattttcattgttttgtagtattccactgtgtaaatgcaaggcagtttatttattaattcaactgttgatgaatatttactacttagagctattatggtcatttccgtatttgttctttttccaacttttggctagtacttgtcttttggtgcacatatatgctttctattgggtgtatacttggaatgactgtgtcatagggtactcagttattgttttaattatactgttaaagtattgtccaatttaacttgtttttaaaaaataaaactgtagatttatttaaaggtagaagtgaagtatattactgatacactttcaaaagctattgattaccgtgctttcttttttaatttactcttcttgctgaagaaatactttgtatttgtggattgtaaactcctcattttttgaatatttgaaaatgtctctattttgctttcactcttaaaggatagcttagctacaagtacatttctaggctggtagtgattttcacataaaacttaattgctttgttcttaagaagttaaaagccaatcttttttttttcctatgcaagcaatctgtttttctttctagtagcttttaaattgcctcttaccattaacttctttctttattccatgatataaccagttaaggattgtgtttattgacctgtttggccctcaatgaagtctttcaatttgaaagatcatcccactcttcaattctataaaattatcagccatatttcctctgtctttaaaaaaaaatgcttattctttgtgggattcctttgatacatgttataatttctcaatctcttcgccaaatactttattttttcatatatattttaaatctgttttttctctttgtgctatatatttcatgaattcctcatttatatcattcaagtaactaatattctgatatttcatttaaatttactttgtctattaatttctttaaattttagctttttagtgtcattctctcaaaggcccttttgtcaatatatacttttgttgatgttgtttgattttctatcaaggacttccagttttaaaaattgtaactctaccctttagttgcatacagtgtgctttgctccaatatccctccataactgagaaaattttgaatcatggaggtaaacacaagcaaaaactccacattggagcccaggatacctttggttctaatttcttctcactgccatgtgtttcttgatttttatccttgctacttattttcttttaaacttttttttttgtatttctatatggactcacagtactatcttggcttatattctgttagttgtatttgtattttgtactagccttcccctaagcttccttacggttggaactgtcttaacatctatagggtcagtatctgggcacttcaaactatacagtaggcactgaagaaagattagtgattagacaaatgaatttttgcaatgtgtataatgtgtttatctaactagaggaaatgtacccagttttctattggtaacatggacatttgaagtcatttatcatatttttgctcttgtaaacagaggtggaacaacaataagccatttcagcatatgagtgatatctgcactatgacataaatcctttatagacaagcaaatgctgagagattttgtcaccaccagacctgcccgacaagggctctggaaggaagtactaaatatggaaaggaacaaccggtaccagccactgcaaaaacactccaaattgtaaagaccatcaattctaggaagaaactgcatcaactaatgagcaaaataacaagctaacatcataatgacaggatcaaattcacacataacaatattaaccttaaacgtaaatggactaaatgctccaattaaaagacacagactggcaaattggataaagagtcaagacccatcagtgtgctgtattcaggaaacccatctcacgtgcagagacacacatgggctcaaaataaaaggatggaggaagatctatcaagcaaatggagaacaaaaaaaggcaggggttgcaatcctagtctctgataaaacagactttaaaccaacaaagatcaaaagagacaaagaaggccattacataatggtaaaggaatcaattcaacaagaagagctaactatcctaaatatatatgcaccatataaaggagcacccagattcataaagcaagtccttagtgacctacaaagagacttagactcccacacaatgataatggaagacttcaacatcccattgtcaacattagacagatcaatgagacagaaagttaacaaggatatccaggaactgaactcagctctgcaccaagcagacctaatagacatctatagaactctccaccccaaatcaacagaatatacattcttttcagcaccacaccacatctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaactgaacaacctgctcctgaatgactactgggtacataacgaaatgaaggcaaaaataaagatgttctttgaaaccaacgagaacaaagacataacatactagaatatctgggacacatttaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaatcaatgaattcaggagctggttttttgaaaagatcaaaaaaattgatagaccgctagcaagactaataaagaagaaaagagagaagaatcaaatagatgcaataaaaaatgataaaggggatatcaccaccgatcccacagaaatacaaactaccgtcagagaatactgtaaacacctctacacaaataaactagaaaatctagaagaaatggataaaatcctctacacatacaccctcccaagactaaaccaggaagaagttgaatctctgaatacaccaataacagactctgaaattgacgcaataattaatagcttaccaacaaaaaaagtccaggaccagacggattcacagccgatttctaccaaagatacaaagaggagctggtatcattccttctgaaactattccaaccaatagaaaaagagggaatcctccctaactcattttatgaggccagcatcatcctgataccaaagctggcagagacacaagcaaaaaagagaattttagaccaatatccctgatgaacgtcaatgcaaaaatcctcaataaaatactggcaaactgaatccagcagcacatcaaaaagcttatccaccacgatcaagttggcttcatccctgggatgcaaggctggttcaacatacacaaatcaataaatgtaatccagcacataaacagaaccaaagacaaaaaacacatgattatttcgatagatgcagaaaaggtctttgacaaaattcaacagcacttcatgctaaaaactctcaataaattacgtattgatgggaagtatctaaaaataataacagctacatatgacaaacccacaaccaatatcatactgaatgggcaaaacctggaaacattccctttgaaaactggcacaagacagggatgccctctcccaccactcctattcaacatagtgttggaagttctggccagggcaatcaggcaggagaaggaaataaagggtattcaattaggaaaagaggaagacaaattgtccctctttgcagatgacatgattgtatatctagaaaaccccatcatctcagtcgaaaatctccttaagctgataagcaacttcagcaatgtctcaggatacaaaatcaatgtgcaaaaatcacaagcattcctatacaccattaacagacaaacaaagagccaaatcatgagtgaactcccattcacaattgcttcaaagagaatgaaatacctaggaatccaacttacaagggatgtgaaggacctcttcaaggagaactacaaaccactgctcaaggaaataaaggaggatacaaacaaatggaagaacattccatgctcatggacaggaagaatcaatatcgtgaaaatggccatactggccaaggtaatttatagattcaatgccatcccctcaagctaccaatgactttcttcacagaattggaaaaagctactttaaagttcatatggaaccaaaaaagagcctgcattgccaagtcaatcctaagccaaaagaacaaagctggaggcatcttgctacctgacttcagactatactccaaggctacagtaaccaaaacagcatgatactggtaccaaaacagatatacagaccaatggaacagaacagagccctcagaaataataccacacatctacaactatctgatctttgacaaacctgacaaaaacaagaaatgaggaaaggattccttatttaataaatggtgctgggaaaactggctagccatatgtagaaagctgaaactggatcccttccttacaccttatacaaaatttaattcaagatggattaaggacttaaatgtcagacctaaaaccataaaaaccctggaagaaaacctaggcaataccattcaggacataggcatgggcaaggacttcatgtctaaaacaccaaaagcaatggcaacaagagccaaaattgacaaatggcatctaattaaactaaagagcttctgcacagcaaaagaaactaccgtcagagtgaacaggcaacctacagaatgggagaaaatttttgcaaactactcatctgacaaagggctaatatccagaatccacaaagaactcaaatttacaagaaaaaaaaaaacccatcaaaaagtgggcaaaggatatgaacagacacttctcaaaataagacatttatgcagcctacagacacatgaaaaaatgctcatcatcactggccatcagagaaatgcaaatgaaaaccacaatgagacatcgtctcacaccagttagaatggcgatcattaaaaagtcaggaaacaacaggagctggagaggatgtggagaaataggaacacttttatactgttggtgggactgtaaactagttcaaccattgtggaagacagtgtggcaattcctcagggatccagaagtggaaatatcatttggcccagccatcccattactgggtatatactcataggattataaaacatgctgctataaagacacatgcacatgtatgtttattgtggcactattcacaatagcaaagacttggaaccaacccaaatgtccatcaatgatagactggattaagaaaatatggcacatatacaccatggaatactatgcagccataaaaaatgatgagttcatgtcctttgtagggacgtggatgaagctggaaaccatcattctcagcaaactgtcgcaaggacaaaaaaaccaaacaccgcattttctcactcacaggtgggaattgaacaatgagaacacttggacacaggaaggggaacatcacacactagggcctgttgtggggtggggggaggggggagggatagcattaggagatacacctaatgttaaatgaccagttaatgggtgcagcacaccaacatggcacatgtatacatatgtaacaaacctgcacgttgtgcacatgtaccctagaacttaaagtataataaaaatatatatataaaatcattgtattaatctgtgaaatatttttaaagaatgttcaacctgttaatatccagttagagcaaggatgtagaaaaactagtacaatattaaattaataaaaatatatcaaagcaaggaaaagtttgtgttttgatctagtaacttcattttttggaattcgtaaaataattctggatattgagaaatactttattgaagtatggtatttaataataaaaaacaaatttagaacaataaaaggttaagaaaaatataatttattcagttaatggtatagtttaaaatcttaaaagtgattgttacaaaactaaattgtatcaaaagctaacctactcatccagaagaaagccacaattaaattgcaacatgaaacaatacttttagtatacaaatattatggcactaaaacagcgatacgcattttttaaaattattattatactttaagttctgggatacgccaggtgcggtggctcacgcctgtaatcccaacactttgggaagccaaggcaggtggatcacgaggtcaggagatcaataccatcctggctaacacagtgaaaccccatctctactaaaaatacaaaaaattagccgggcgtagtggtggcaggtgcctgtagttccagctacttgggaggctgaggaaggagaatggcatgaacccgggaggtggagcttgcagtgagcagagattgcgccactgcactccagcctgggtgacagagcgagaccatctcacagaaaaaaaaaaaaaaaaagttctggtatacatgtgcagaacatgcagctttgttacataggcatacttgtgacatggttgtttgatgcacccatcaactcatcatctacatcaggtatttctcctaatgctatccctacccttgcccccaacccccaacagggtatgtgatgttcctttccctgtgcccatatgttctcattgttcaattcccatttattagtgagaacatagggtgtttggttttctgttcctttgttagtttgctgagaatgatggtttccagcttcatccatgtccctgcaaaggacagcaactcatccttttttatggctgcatagtattctatggtgtatatgtgccacattttcttgagccagtctatcattgatgggcatttgggttggttccaagtctttgctattgtgaatagtactgcaataaaaatatgtgtacatgtgtttttatagtagaatgatttatgatcctttgggtatatacccactaatgggattgctgggtcaaatggcatttctggttttagatccctgaggaattgccacattgtcttccacaatggttgaactaatttacactcccaccaacagtataaaagtgttcctatttctccacatcctttccaccgtctgttgtttcctgactttttaatgattgccattctaactggcatgaaatggtatctcattgtgggtttgatttgcatttctctaatgatcagtgataacaagctttttttcatgtttgttggctgcataaatgtcttcttttgagaagtgtctgttcatatcctttgcccactttttgatggggttgtttttctcttgtaaattcatttaagttctttatagattctggatattagccctttgtcaaatggatagattgcaaaaattttctcccattctgtaggttgcctgtttcctctgatggtagtttctttcaccgtgcagaagctctttagtttaattagatcccatttgtcaattttggcttttgttgccattgctttggtgttttagtcatgaagtccttgcccatgcctatgtcctgaatggtactgcctaggttttcttctagggcttttatggttttaggtcttacctttaagtctttaatttatcttgagttaatgtttgtattaggtgtaaggaaggaatccagtttcagttttctgcacatggctagccagttttcccaacagcttttattaaatagggaatcttttccccattgcttgtttgtgtcaggtttgtcaaagatcagatggctgtagatgtgtggtgttatttctgaggcctctgttctgttccattggtctatatatctgttttggtaacagtatcatgctgtttttgttactgcagccttgtagtgtagtttgaagacaggtagcattatgcctccagctttgttctttttgcttaggattgtcttggctatatgggctcttttttggttccatatgaactttaaagtagtttttttctaattctgtgaaaaaagtcaatggttgcttaatgggaatagcattgaatctataaattaccctgggcagtatggccattttcaagatattgattcttcctatctgtgagcatggaatgattttctgtttgtttgtgttgtctctgatttccttgagcagtggtttgtagttccccttgaagaggtccttcacatcccttgtaacttgtatttctaggtattttattctctttctagcaattgtgaataggagttctctcatgatttggctctctgtttgtctattataggtgtataggaatgcttgagatttttgcacattgattttgtatcctgagactctgctgaagttgcttatcagcctaaggagattttggggctgagatgacagggttttctagatatacaatcatgtcatctgcaaacagagacaatttgacctcctctcctcccacttgaatatactttatttctatctcttgcctgattgccctggccagaacttccaatactatgttgaataggagtagtgagagagggcatccttgcctgtgctggttttcaaagggaatgcttccagcttttacccattcagtataatattggctgtgagtttgtcatatatagctcttattattttgagatatgttccatcaatacctaatttattgagagtttttagcatgaaggggtgttgaattttatcaaaggccttttttgcatctattgagataatcatgtgtttttttttcattggttctgtttatgtgatggattccatttattgatttgcttatgttgaaccatccttgcatcctggggtgaagctgacttgattgtggtggataagctttttgatgtgctgctggattcagttttccagtattttattgagaattttcacatcgatgttcatcacggatattggcctgaaattttcttttttttgttgtgtttctgccaggttttggtatcaggatgatgctggcctcataaaatgagttattttatgataatttcttttctattgtttgaaatagtttcagaaggaatggaaccagctcttctttgtacctctgatagaatttggctgtgaatctgtctggtcctgggcttttttttggttggtaagctattaattactgcctcaatttcagatcttgttattgttctgttcagagattcgactttttcctggtttagtcttgggagggtgtatgtgtccaggaatttatccatttcttccagattttctagtttatttgcatagaggtgtttatagtattctctgatggtagtttgtatttctatagtattctctgatggtagtttgtatttctgtgggatcagtggtgatatcccctttatcattttttattgtgtctatttgattcttctctcttttcttctttattagtctggctagtggtctatctgttttgttgatgttttcaaaaaaccagctcctggattcattgattttttgaaaggttttttgtgtctctatctccttcagttctgctctgatcttagttatttcttgtctcctgttagcttttgaatttgtttgctattgcttctctagttcttttcattgtgatgttagggcgtcaaatttagatctttcctgctttctcctgtgggcacttagtgctataaatttccctctaaacactgctttagctgtgtcccagagattctggtatgttgtgtctttgttcttattggtttcaaagaacttatttatttctgccttaatttatttacccaatagtcattcaggagcaggttgttcagtttccatgtagttgtgcggttttgagtgagtttcttaatcctgagttctaatttgattgcactgtggtctgagatactgtttgttattatttccatttatttgcatttgctgaggagtgttttactttcaattatgtggtcaattttagaataagtatgatttggtgctgagaagaatgtatattctgttgatttgaggtggagagtttggtagatgtctattaggtctgctcggacctgagctgagttcacatcctgaatatccttgttaattttctgtctcgtttatctgtctaatatgacagtggggtgtaaaagtctcccactattattgttttggagtctaagtctttttttaggtctctaagaacttgctttatgaatctggatgctcctgtattgtgtgcacatatatttaagatatttaactcttcttgttgcattgatccctctaccattatgtaatgcccttctttgtcttttttatctttgttggtttaaagtctgggttatcagagactaggactacaatccctgctttttttttttttttttttttttttgctttctatttgcttggtaaatctttctcaatcccactatttttagcctttgtttgtctttgcatgtgagataagtctcctgaatacaggacacctatgggtcttgactctttatccaatttgtcagtctgtgtcttttaattggggcatttagtcaatttacacttaaagttattgttacatgtgaatttgatcctgtcatcatgatgctagctggttattttgcccattaattgatgcagcttcttcacagtgccgatggtctttacaatttgatatgtttttgcagtggctggtaccagtttttccttgccatgtttagtgctttcttcaggagctcttgtaaggcagacctggtggtgacaaaatctctcagcatttgcttgtctgtaaaggattttatttctccttcacttatgaagcttagtttggctggataaaaaattttgggttgaaaattcttttctttaagaatgttgaatatcagcccccaccctcttctggcttgtagggtttctgccaagagatcccctgttagtctgatgtgcttctctttatgggtaaccccacgtttctctctggctgctcttaacattttttccttcatttcaaccttggtgaatctgacaattatgtgtcttggggttgctcttctcaaggattatctttgtggtgttctctgtatttcctaaatttgaatgttggcctgccttgctaggttggggaagttctcctggataacatcctgaagcgtgttttccaacttggttccaatctccctgttactttcaggtacaccaatcaaaaaagtttggtcttttcacatagtctcatatttcttggaggctttgttaattccttttcattcttttttctctaatcttgtctttatgctttatttcattaagttgatcttcaatctctgatatcctttcttccacttgatggatttggctattgatacttgtgtatgcttcacaaagttctcatgctgtgtttttcagctccttcaggtcatttatgttcttctctaaactgcttattccagttagcagttcctagggagacctaggggaatcttttatcaaggttcttagcttccttgcatttggttagaacatgcttcttttgctcagaggagtttgttattacccaccttccgaagcctacttctgtcaattcatcaaactcattctctgtctaattttgttcccttgctggcgaggagttgtgatcctttggaagagacattctggtttttggaattttcagcctttttgagctgctttttcctcatctttgtggatttatctacctttggtctttgacgttggtgatctttggatggggtttttgcgtgggtgtcctttttgttgatgttgatgctattgctttctgtttgttagttttccttctaacagtcaggcccctcttctgcaggtctgctggagtttgctggaggtccactccagaccgtttgcctacgtatcaccagtggaggctgcagaacagcaaagagtgctgcctgctccttcctctggaagctttattccagaggggcacctgccagatgccagccagagctctcctgtatgagatgtctgttgacccctgctgggaggtgtttcctagtcaggaggcaccgggttcagggacccacttgaggaggcagtctgtcccttagcagagctcaagctctgtgctgggagatccactgctgtcttcagagccagtagacagaaacgtttaagtctggtgaagctgtgctcacagctgccccttcccccaggtgctctgtcccagggagttgagagttttatttataagcccctgactgtggcttctgcctttctttcagagatgccctgcccagaaaggaggaatctagagaggcagtctggctacagaggctttgctgcactttggtgggccccacccagtttgaacttccaggtggctttgtttacactgtgaggggaaaactgcctactcaagcctcagtaatggtggatgcctctcacccacaccaagctggagcatcccaggtcaacttcagactcctgtgctgacagcgagaatttcaagccatggagcttgttgggctccatgggggtgggatccgctgagctagaccacttgactccctggcttcagccccctttccagcggagtaaatggttctgtcttgctagcattccaggtaccactgaggtatgaaaaaaactcctgcagctaggtcagtgtctgcccaaacagctgcccagtttcgtgcttgaaatctagggccctgggagtgtaggcacccaaaggaatctcctgatctgtaggttgcaaagaccatgggaaaagcaaagtatatgggccagagtgcactgttcctcaaggcacagtccctcatggcttcccttggctaggggagggagttacctgaccccttacacttcccgggtgaggtgatgccccaccctgcttcgggtcaccctccatgggctgcacccactgtgtaaccagtcccaatgagatgagtcaggtacctcagttggaaatgcagaaatcacccaccttctgcattgatctccctgggagctgaagaccggagctgttcctattcagccatcttctattcctcatgatacacatttttaatataatggttgtaatctaattataactttataagataaaatacttataaagaaatacttcataaagtacaatatatcaaatagtactatttgtatttgtataatgagattataaatttatattttctaatctttttcttaaaaaaaggatactatttacatcatcacaacaatgaccctatgaagaacacacattaaaaaagctgataggttagcatgataaaaaataaagatttgaattttaatcacaaattttgtagagagtagttgttacctgaggattatgatacagaggttagcatgtgcatatttctgtagattttggttttcagattctctgacttgtgatctcaaagattccttatgataaataaaataattaagcaaatgaaaaatgaagcaaataaaaatggtaatataactttttacatagcatgtatgttacacattagatatagcataatagactatttcagaggaatatccggctaataaatcaaaatagtaattatataaatggtttaaattaggtcactggagggaaaaataaaaatcacaaaatagattcatttttacctcaacaataaacgagttcatcaatatgttacactaggttatgaaggactattagatcatatataagggctgtttataaaatgtcaacaaaaaaatcaaatcacaggtttttagaagtagaagctggtcaatacctcaaagaaaatctgtattacaactgaaataagaattaatattcttcccattaaatcacaaagcctttttatttcattcctataaaatcacatgaatgtgtaattgaatatcacaatcctttataacctcaggcaagcttcttaatgtctcagaaccatactctgttatcagtttctcatattgatagcatttatgttattgccagcttgggctattaaaacagtattccaataaatattattgttcacatagcttttgcaattatatctccactttagatatttgaaggtgaaattaatgcgagccaaaatgggctcaatgtgactgtcaggaaaaatgatatctttgtaatataatcaatttttctttgattattagtacagttgagcatatatatgtttatttatataaatcagggcatttcttaatatattcattttctatttcagatttgcctatttttctagtgaaatttttttattgatttgtaatattttgtatataaaacctgaaacactttaaacaccatatgtgctatatgcatggtattttctctgtgtctgcagcttatcttttcacttaatgtttatgttatcttcttcatatcaagttttaaatgctgacaaaataaaatctgtcaaattttccttagggcctcaagctcttacgatgatcaaaatgaccaatctttagtgacttttgtaactatacactacccatctgactccagattatatgcttttaaccacttcactattcttgtttgaaacttgagaatagggtagtagttaaaagcatcaaatctggagccagattatgtaggtttaaatcctggggcaccctcatctgactagctctacgacatgaaatgagttactcaactttcctgtgtacagtttcttgtttatcagttgagtaaatataattaaagagattagattagggcctggcacacaataagtgctaaataaacatttgttattatttgttccctccaaacatgtctgtttctctaagtagatgtttttgtataaattccaacaatgtgatgtttatatcaagattttattccatttttctcatttattaataactgtaagtgagttcctactatgtacttctctggcaccaagccaggcacaaaaaacagagtaattaataaatattagggttgggtgccatggctcacacctgtagtctcaacacctgggaggccaaggtgggagcattgtttgaggccaggagtttgagaccagacttagcaacacagcaagaccctgtctttacaaaatatttaatcattttaaaataattttaaaaaatcaacactaatggttgcttttctgatggtgcttgctgtctaatacaagaaagtaaaattgtaatgtgacaattgacagaaaagaaagataaaaatgttatgatagattgatctgttcaagactggtaagttgctttcctgaagaaataatgcttaaattgaaatataaggaataaataaaaatttctctggagaaaagggaaaggaagttcatttgtacaaatttagcaaggtaaaattaataaaattacattttcaatttattttgaaattagccttgcaaatacgaagtaatttttaagcaaaagttctaaatattgctttgctattccaagactaaataattaagaactcttccaattccagttatttgtgtgaattacataatgcaaacatttgtaaagaacagattgcttttagaaagtctgatcttgaatttatttttcttcgtttactctcttgcagacatatccattgtatgctttcaaaacattcttatatttttccagaatataaaaacactgtgtgcaaatgttcaatatacatgtagctggaaatagataacatttgggtggatggcaatctaatgtatacaaagagtagattcacagctgtgtatttgccagattagaaataaggctagacttctgatttctggagaattttggtaaagcaaaatataagagaaagaggtttagacttgttcagtgctatctaaaatagaaactcttgcagaaaaagaattacatttacttaatccatcctttccataattattcacactgaaactactgaaatagtatgtaaaatattaatagtacattgtttgaaaacctatacagtcaaccctctttctcctggggttctgcatccatggctgcttctgtattgaacacgtacagacatttttcttgtaactatttcctaaaaaatatagtataactatttacacagcatttacagtatattagttattataagtaaccctgtagcaatttaaagtatacagggagatatgcataggttatatgccaatagtacactattttatataaggaacttgaacatccatggattttggcatctgcagaaggtcctggaaccaaccccccatggataccgagggatggctgtataatatggattaggtttttttttcctaaagttcttcaaaagctcttgacctcaagctttttaaataaaacctacataaaatattctcaattaaaataactgtaaatatattttggagcagtacaaattgcttggcattttacttttaaaacctaaaggctgaattctatgttaatagattacaacataaaacagattcacttatatgaaacaagcaagttttttctcatattgtttgcaccaaagaaagttgcattgatgaatagaaaaaaaatagctttattcccctacttcctcaacacaataagaatgaaagacaactaaaattaaacttgtggtggagccaagatggccgaataggaacagctccggtctacagctcccagcgtgagtgacgcagaagatgggtgatttctgcatttccatctgaggtactgggttcatctcactagggagtgccagacagtgggtgcaggacagtgggtgcagtgcaccatgcacgagccaaagcagggtgaggcactgcctcactcgggaagcgcaaggggtcagggggttccctttcctagtcaaagaaaggggtgacagacgtcacgtggaaaatcaggtcactcccaccctaatactgcacttttccaatgggcttaaaaaacagcacaccaggagattatatcccgcatatggctcagagggtcctatgcccacagagtctcactgattgctagcacggcagtctgagatcaaactgcaaggccacagggaggctgggggaggggcgcctgtcattgcccaggcttgattaggtaaacaaagcagcggggaagctcgaactgggtggagcccaccacagctcaaggaggcctgcctgcctctgtaggctccacctctgggggcagggcatagacaaacaaaaagacagcagtaacctctgcagacttaaatgtccctgtctgacagctttgaagagagtaatggttctcccagcacgcagctggagatctgagaacaggcagactgcctccttaagtgggtgtctgacccccgagcagcctaactgggaggcgccccccagtaggggcagactgacacctcacacggccgggtattcctctgggacaaagcttccagaggaacgatcaggcagcagcatttgcgggtcaccaaaatccgctgttctacagccactgctgttctgcagccaccacggctgacacccaggcaaaaagggtctggagtggacctctagcaaactccaacaaacctgcatctgagggtcctgtctgttagaaggaaaactaacaaacagaaaggacatccacaccaaaaacccatctgtacgttgccatcatcaaagaccaaaagtagataaaaacacaaagatggggaaaaaacagagcagaaaaaccagaaactctaaaaagcagagcacctctcctcctccaaaggaacacagctcctcaccagcaacggaacaaagctggacggagaatgacattgatgagttgagagaagaaggcttcagacgatcaaactactccgagctacaggaggaaattcaaaccaatggcaaagaagttagaaactttgaaaaaagattagacgaatggataactagaataaccaatgcagagaagtccttaaaggagctgatggagttgaaagccaaggctcaagaactacgtgaagaacgcagaagcctcaggagccgatgcgatcaactggaagaaagggtatcagtgatgcaagatgaaatgaatgaaatgaagtcagaagggaagtttagagaaaaaagaataagaagaaacgaacaaagcctccaagaaatatgggactatgtgaaaagaccaaatctatatctgattggtgtacctgaaaatgacggggagaatagaaccaagttggaaaacactctgcaggatattatccaggagaacttccccagtctagcaaggcaggccaacattcagattcaggaaatacagagaacaccacaaagatactcctcgagaagagcaactccaagacacataattgtcagattcaccaaagttgaaatgaaggaaaaaatggtaagggcagccagagagaaaggttgggttacccacaaagggaaagccatcagactaacagtagatctcttggcaaaaactctacaagccagaagagagtgggggccaacatttcacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaagcaacaaccggtaccagccactgcaaaaacataccaaaatgtaaagaccatcaaggctaggaagaaactgcatcaactaacgagcaaaataaccagctaacatcataatgaacaggaccaaattcacacataacacttaactttaaatgtaaatgggctaaatgctccaattaaaagacacagactggcaaattggataaagagtcaagacccatcagtgtgctgtattcaggaaacccatctcacgtgcagagacacgcatgggctcaaaataaaaggatggaggaagatctaccaagcaaatggaaaacaaaaaaaggcaggggtcgcaatcctagtctctgataaaacagactaaaccaacaaagatcaaaagagacaaagaaggccattacataatggtaaaggaatcaattcaacaagaagagctaactatcctaaatatacatgcacccaatacaggagcaaccagattcataaagcaagtccttagtgacctacaaagagacttagactcccacacaataataatgggagacattaacaccccactgtcaacattagacagattaacgagacagaaagttaacaaggatacccaggaattgaactcagctctgcaccaagcagacctaatagacatctacagaactctccaccccaaatcaacagaatatacattttttttcagcaccacaccacacctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaacggaacaacttgctcctgaatgactactgggtacataacaaaatgaaggcagaaataaagatgttctttgaaaccaacgagaacaaagacacaacataccagaatctctgggacacgttcaaagcagtgtgtagaggaaaatttatagcactaaatgcccacaaaagaaagcaggaaagatccaaaattgacaccctaacatcacaattaaaagaactagaaaagcaagagcaaacacattcaaaagctagcagaaggcaagaaataactaaaatcagagcagaactgaaggaaatagacacataaaaaaactttcaaaaaattaatgaatccaggagctggttttttgaaaagatcaacaaaattgatagaccgctatcaaggctaagaaggaagaaaagagagaagaatcaaatagatgcaataaaaaatgataaaggggatatcactaccaatcccacagaaatacaaactaccatcagagaatactattaacacctctaagcaaataaactagaaaatctagaagaaatggataaattccttgacacatacaccctcccaagactaaaccaggaaaaagttgaatctctgaatagactaataacaggctctgaaactgtggcaataatcaatagcttacaaaccaaaaaaagtccaggaccagatggattcacagcggatttctaccaaagatacaaagaggagctggtaccattccttctgaaactattccaaccaatagaaaaagagggaatcctccctaactcattttatgaggccagcatcatcctgataccaaagcctggcagagacacaaccaaaaaaggtaattttagaccaatatccttgatgaacattgatgcaaaaatcctcaataaaatactggcaaaccgaatccagcagcacatcaaaaagtttatccaccatgatcaagtgggcttcatccctgggatgcaaggctggtttaacattcacaaatcaataaatgtaatccagcatataaacagaaccaaagacaaaaaccacatgattatctcaatagatgcagaaaaggcctttgacaaaatccaaaaacccttcatgctaaaaactctcaataaattacgtattgatgggacgtatctaaaaataataagagctatctatgacaaacccacagccaatatcatactgaatgggcaaaatctggaagcattccctttgaaaactggcacaagacagggatgccctctctcaccactcctattcaacatagtgttggaagttctggccagggcaatcaggcagcagaaggaaataaagggtattcaattaggaaaagaggaagtcaaattgtccctgtttgcagatgacattattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaagggcctcttcaaggagaactacaaaccactgctcaatgaaataaaagaggatacaaacaaatggaagaatattccatgctcatgggtaggaagaatcaatatcgtgaaaatggccatactggccaggtaatttatagattccatgccatcctcatcaagctaccaatgactttcttcacagaattggaaaaaactactttaaaggtcatatggaaccaaaaaagagcccgcatcgccaagtcaatcctaagccaaaagaagaaagctggaggcatcacactacctgacttcagactatactccaaggctacagtaaccaaaacagcatggtactggtaccaaaacagagatatagatcaatggaacagaacagagccctcagaaataatgccacatatctacaaccctctgatctttgacaaacctgaaaaaaacaagcaatggggaaagcattccctatttaataaatggtgctgggaaaactggctagcgatatgtagaaagctaaaactggatcccttccttacaccttatacaaaaattaattcaagatggattaaagacttaacatgttagacctaaaaccataaaaatcctagaagaaaacctaggcaataccattcaggacataggcatgggcaaggacttcatgtctaaaacaccaaaagcaatggcaacaaaagccaaaattgacaaatggggtctaattaaactaaagagcttctgcacagcaaaagaagctaccatcagagtgaacaggcaacctacaaaataggagaatattttcgcaacctactcatctgacaaagggctaatatccagaatctacaatgaactcaaacaaatttacaagagaaaaacaaacaaccccatcaaaaagtgggcgaaggatatgagcagatacttctcaaaagaagacatttatgcagccaaaaaacacatgaaaaaatgttcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtagtgattccacagggatctagaactagaaatatcatttgacccagccatcccattactgggtatatacccaaaggattataaatcatgctgctataaagacacatgcacacatatgtttattgcggcactattcacaatagcaaagacttggaaccaacccaaatgtccaacagcgatagactggattaagaaaatgtggcacatatacaccatggaatactatgtagccataaaaaatgatgagttcatgtcctttgtagggacatggatgaaactggaaaccatcattctcagcaaactctcgcaaggacaaaaaaccaaacactgcatgttctcactcataggtgggaattgaacaatgagaacacacggacacaggaaggggaacatcacacttcaaggactgttgtggggtgggggaaggggggtgggatagcattaggagatatatctgatgttaaatgacgagttaatgggtgcagcacaccaacatggcacatgtatacatatgtaacaaacctgcatattgtccacatgtaccctaaaacttaaagtgtaataataataaaattaaaaaataaataaataaataaaattaaactttaatgaccttttgatctactctcatttaatctgcttttatattcctcatatttggcagaacccacaataatcagatgagattggctaagagtaaatccatatgtctctttctttttgaaagatttactagttcacatttttaaaaagttagaattagaaattttagtcattagaaagtaatgaagaaataatgacacccattggagtaattatataaaaaaagcaaatgtaaaaatcctagaaaatatatgcccaataaaatgagaatgcttaaaaaaatgaggaaaaaatgccgagcaaaatgagagatgagggacataaattacaaagtaaaggtgctggggggacattcatctacattgagtgctgaatccacagattacgggaaaaatcactgaaaactgcattatccattttttggtgtttcttggtgctgactggaaatctgtaatgtatgtagatgccaaccaacaaagaaacaagatgggagaagagtaagggaacgaacacgtcaaataccacaggcacggtgctggatcctttacagacattataatgtggtcaaaattacatgaaacaaattgtcattttgttttccaattgtttgatttttggcatttcaatacttgaaattaaaaatgcttttttattgttaattttagcttcataaataatgttagtaaaatatttcaaatgagtgcctttggaaagctttttcaattccaggaaaggctatgattttttgccttctataaattataaccttcagcaaaaggtagtaactactgcattaccaaagggcactcatccagaaaatctggattctggagaacaccatcatcttagaaaaaccatttaatgactcaaagtccggcaatatatcttttaaaataataccacataataaagaatattaatcagacatttttctagcaagaatacatgcatttcttttgatcttctacatgaaaatgcacatactggatggacaaatgacagtaaaatactgaaaattctaacttcaaaatgggtttcatttatcaatagaacataatattggctttgattttcagattgcctactggggaataaaattaagttatcatattctccatcagagatcttagtctaagttcataattttttttgaggtaattgtttcaataattatttttttaactgaccttcaaaaagtgaaatcttctatcattcctaacttccattctgcagtttagagagtaatgaaagcagttaacatccccacttaccccagataattgtctaaaaaatcccagccaaatatgtgaaaaggacaagccatttttagaaactcatgtaatttaaatttattttctcatttgatattttgcagttatgtttaagtcacatgctagaagagttttggtattttttccagaaaataaaaacactttgtttggagtactaacataaatatagctgggagaaataacctgtaaactgaaagcaaatctaatctatataaatatcagtttgttgttctgtttcccttgtataatatagtaaggctttagacctcactttactatactgatgttaaggggtcaccatacagcaaaacactaagcattttacatttcagctttttcagaaataacgttgtattcatttcacagtgaataagaagataaggatgatatcaaagaacatcacagaatataacaagaaattgcattttacaataggtaagaaaatgttccctagaatatttacacttaaaagaaaaatcttgctccattgatataacatctcaaggaagaactagcaatagaagaaaattgtgctaaactttagaccctgttgtagcaatatttaaaatgctgcctcatttcctcacaagctagagatgttactttgctccaacttattatttcttctttttcaagtaaatgttgctgaaatagatttgtaaagatttctgattaacccaattactttaaccccaactcactcttcaagacacaagtctaacttttttgaagataaagtaacataagactacaaacatttttccggttttagcagttgccaaaattgtgatcatgggccaggtatttgttctttccatatctcagttgcctccaatataaatggaacttaacaatagtagatatcatctatagcttttgagtggattcaatagcacgtgtacacacacatacacacacatacactcacatacacttaaagactatgccttcacatagtgaaggcaattgccttcgtgtgatagtctttaagtaaatctaaccaatgcttgattgcaataatgattaatagtggtagttttagttgtgtgagttaagacaagatgatcacgtaagtagctataacaaatatttagtgaacagttactatgtgcaagacactttttatgcttgacacgtgtcattttatttaatcatgtaacaacacaataaggtaaatgttattataattatccccattttatggataaggagagctgggatacagagattgagacagacaaatgaatataacaccagagagaaataagagagacctgttttagaaggcaagaaaacaagttaggaaataaaaacgtatctttcagatgctatataaaaatggtctagattcgaagcaatttgttaatcaagtgtaaaacataagggtaattaatgaaaataatattttcatcattagttttaagtttttaaaggtttttaagtatgttaagtattaagtatttttagttttaagtatttcaagtagttttaagtatttcaagactttaagacaagactgattttttggactcctagatacataattatgtgagttaaaattgggattatccatttttataagaaactactcaaaaattaaaatataaaaattttggctgctagccaatccaaaaactttcaatccttttaccatgtcataaagcaaatgctaactcctacttcctaagcatcccgacagggccaaactcttcatgctttcaaggatgttatctataagcatggtccacaggatagtttaaaatttctgattctgcttccaaatttgaactgcactcacatctcactcactctcatctcattttccccagcactttcttctccctcatcttcctatttctgaatggttccctggccagttctccagccaaaaagcctttggttacctagttttgctaaggactttcacaactgaggccaagtggcagtgtaattgcctgatgggtttgtatgatagttacatttcttctatatttttattttcaacttcagtagcattgagaaatttcatattagtatatttatgtgcaattggcattctttatattctattcatatcccatttatattatttcgtgtactgtattttttccattagactttttgtcaaggcagcctgaaacctagtaatgataataaatctgtgaccccaagagggtgggatgaacctatattacttttatttctcttgtgtcttcctggtgaaattgcctttacaaaaattatgacagtgaaataaatctgacctaagtgactccatcttgcttctaacccccaagctgcccttgcacattcctgggtgtgggcctagctaactacgggagaaacttagtttatggcctaactttggaacaaagatgataacagctccttcttggacaaaacccctcattgcttggagatcagacttcctttgtaaaactaacaaagtagccacaagattagaaattatttctcagaaatcatgcagccagaggccacaagattcctaacttctctgttcctgtgaataacattattattgtaaaacttaaggttgatttttgaggtattttttaggccctgccttctgatggaccaggtggtgccacccagactggtaaaccaacttacctgatctcacggcccccaggaactgactccatgcaagaagataagctttgactgcctataatttcatccctgacccaactaatcagcattccccatcccctagccctgtgtctgccaaactactcttaaaaatccgagcctctggctgggtgcagtggctcatgcctgtaatcccaacactttcagaggctgaggcaggcggatcacgggttcaggagattgagaccatcctggctaacacggtgaaaccttgtctctactaaaaatacaaaaaaaaattgtcaggtgtggcggcatgcacctgtagtcccagctgcttgggaagtataggcaggagaatcacttgaacctgggaggcagaggttgcagtgagccgagatcgtgccactgtactgcagcctgggcgacagaaggagactctgtctcaaaaaagaaaaaaaaaaaaactgagcctccaaattttcagggaggctgacttgagtaataaaactctggtctcttgtttagctagctctatgtttattaaactctctattgcaataacactgtctcagtagagcagcttttctgggcagcagacaagataaacccattgggcaattacactgccacttggcatcagttgtgaaagtccttagcagaaccaggtaactaaagccccagctttttggctggagatccggccagggccagggaaccatcagaagtaggaagatgagggagaaagaagtgctagggaaaatgacactgcaatgttgattgtgaacccctggcatcaactccaaaccatgcttatgtggatctgaatgtaatcagcctaatcgaaggaacagaccacctctcaggtcagagactaataaccactaacattggacacattggaataacacagcaaatgctttaaaaattgaactgacattggaaccacagacaataggatgctagatgtaattatcaactgaacttaagcatgttgattgcctgataaaacaacaatataagcattctccatagaaggtaaacaaagcctcttaatataatattaaatacctgtagatactttagtaggcagaataatggctccaaagatacccagattgtcatcctcaggacctgtgaatatgttaccttacatggcaaaaatggatttgcagatgtgattaagctaaggacctaaagatagggagcttatcctgaattatctggatggatccatagtcatcacaggtgaaagagagaggcagaagagtaggtcagcgtgatgagttgtgagaactcaaccagccattgttggtttggatgatggaggaaagaggccaagagccaaggagcacacaaaagtgggaaaaggaaatagattcccccctgcagtctctaggaaggaacacagccttgctgacaccttgatttagtcctgtgtaactagacttctagactgcagaactgtaagataataaatgtgtattattttaaacaactaagactgtaacttattattgcagcaataaaactgaaaagtcttttaaatgccactaaaattgataagactctagcaagattgtcaaagaaaaaaaggagaaagccaaattacaataatatgaatgaaatagggaattatcaccatagcatcataggcattaagaggatactgagagaaaactagaacaattttatggccataattttacttcttaaataaaaagaaccaaacactttaaagacacagattaccaaaattcaattaagaagaaatatatactctgaatatttttaaaaccatgaagggacttgaattcataatttaaatcttctcaaaaatgtcatctttggtgatgatgtcaattgttagtttctaccaaacatttagaagtaatgccaactctacaaaatctcctccaaaaaatagaagaggtaacactttccatttcattttatgagaccagcattacactgatatcaaagccaaagatagtataaaaatgaagatgaaggaggaggaaggagaggaatgagaggagggagaggagggggaggagggggaggaggggaagaaagggggaaaaggcggaggagaggaggaagaggataaaaaaatataaacatcatatattagcatgtgtgtatgtatgtctgtaccacaaccaaatgggatttattctaggggtacaagtctggccaatattttggcatcaatgaaatctgtattaatagtctaatgaaaaatgtaataattatttctttttttcaggaaaaatatgtaaaattcagtgttcattcattatagaaattctcagcaaagtaggaatggtaaggaacatcctcaacctggtgaagaacatctaagaaaaacctgtgactaatatcatacttaatgataaaagaatattggcttttctcttaagattgggaacaaggcaaggatgttcactctaacttctcccattcaatcttgtgctagaaattctaactactacaataacaattttaaaatataagaaataaaaacttaaaatgaagaaatataactgtccctatttacaagtgatatgatcatctacatagaaatcccaagaaatccacaaaagactcgtcaacccaatggagtgcagcaaggttatagtgaggtaggagaccagcaggacttattcctggtctcaacaggatgaagtgaagaaaccagcaagaatcagtagatgacaacagaaccaacctctaggtgtccccactgctcatcagcataagacactcccaccagtgccctgacagtttacaaatgcccagcaacacccagaagttactggccgttttctagagagttctgagtaacccactccttaacatgcatgtaattaaaagtgggtataaatactactagccaatagtccacatgctgctactgtggatgctcaggctctgggttagtgctgctccacaaggagctgtcattctgcggtacactgacacttcaataaataggctttctttcaccactagctcactcttgaattatcttctgagcaaagtcaagaacccttctggactaagccccaattttggggctcacctgccctgcatcaacaggatacaagatcaacatacaacaaaacaattttatttctgcacaatatgaatgtaactataaactgaaagtttaaaagaaataccatttacaacacctcaaaaatttggtataaatctggcaaaatgtgcagaatctgtatgcagaaaacaacaaatgctgattaaaagatatcaaagggccaaataaattgagacatatgatgttcatagattgaaagactcaacatagtaaaatgccatttcttcccaaatttagatttattgaaattccaaacaaaatcccagcagaactttatagatatagataagccaatttgaagattaatatggaaattcaaaggaattatcatagctgaaagggttttgaaaaagaagaataaaattggaggaatcaccctacctaaatttaaaatttactgtaaagctactgttatcaagacaatgtggtatagatcagctgatcaataaagcagaagatagtctagaaatatatggccaagtgaattctgtgcaaaataatccaatggggaaaagacagtctttgcaacaaatgatgttggaaaacctgaacatttatatgcagttaaaacaacctgacctggagtttgagaccagcctggccaacatggtgaaatcccgtctctactaagaaaaattagctgggcatagtggcacatgactgtaatcccagctactcaggaggctgaggcagaaggatcatttgaacctgggaggcagaagttgtggtgagcctagatcacgccactgcactccagcctaggcaacagagcaagactccatctcaaaaaacaaacaaaaaacacaaacaaaacaacaacaacaacaacctgacctaaacctcactttatccaaaatttaactcaaaaaacattatgatgtaaatatgaaatgaaaagccatggaactttttgaaaaaatcagccaggggtggtggctcatgtctgtaatcctagcactttggcaggccaatgtgtgaggactgcttgagcccagaagttcaagaccagcctgggtaacatagtgaaaacccatctctacaaattttttaaaaattagctgggtgtggtggcatgcactggtagtcccagctacttgggaggctgaggtgggaggatctcttgagcccaagacgtcgtgtctggaatgagctttgattgtaccaccccactccagcctaggcatcaaattgagaccctgtctcaaaaaatggaaaaaacaaaacaaaacaaaaaaacctttacaacttggtgttagtctaagagttcttagagataatagcaaaagcacaatcaataatttaaaaacagatcagttagattttgtcaaaatgtaaaacttttgctttacaaaagacactattaggaaaatgaaaagctaaacttcaaaattggagaaaatattttcaaaccacatgtctaacacagaacttgtatccagaatatataaagcactctcgaaactcaataaaaagaaaacaaacaactcaatttaaaaattcatgataatatcaaaaggctggtgagaatgtgcagtgactagaacactcctacattgctgttgggcactctcttgtttacacttcccatatgcctcagcaatactattcctgggaatttactttagaaaaataaaatttatgttcacagaaagatatgtacatgaatataaacacagctccattcataattgctgaaaaacgaaaacaagccaaagttctagcaatcaaagcctgacacatttgactggttaaaaaaaaaagtttatgttatatttagacagtttattacttagcaaaataaaatgagcaaaaatgccagatacccaagccccttatctcaaaggatgacactgaaacaaaaatagcgagtaatgtgatgatgtatcatcagtagtgggagcaacctgctgctgcagatccaattgcatcttgcagataagcagctttatactttgcagttgtgcccaaataacagagaggcagagagcctcaggcctcttcaaaacccatgaagtgatgagtaactgtctcatggcagcctccttggaagataggtagagggggtaggctcttcaaagcctcccacactctcatgttccaggaatatctcagagcattttaccaaaacttagatcagctgtagttaagccttggccaaatagcctctctagagacatgcagggaagatgtttatcataagcccagaaacccctctcctgggattagagagaccttagggagtgaaaaatgttgatcacacaaaacaattgtatgtcaatgtttgtaatagctctattataatcacacaaactgtaaacaatccaaatgtctttcaacaggtgtatgaacaaattttggtacattcatatcatggcatactactcagctctaaaaaggaaagaattattgatatactcaacgccataaatgaaatcactgtgttgtaaattctagatttgtatttcatttaatataatttcttcacttttaaaaagtgttaaacttatattttcttttgactattgaggtaaaatatacgtaacacaaaatttatcatgcaagtcatttggatgtgtacaattcagtggtattaagtgcattcacattgtttcacaaccatcatttctattcctcttcagaactttttcatcatcctaaactaaaactctgtacccattaagcaacaactttccattctcccctccccagatcctggtgaccactattctattttctgcctctacggatttaactattctaggtgtgtcttattagtagaatcagacaatatttgtccttttgtgtctggcttatttcacttagcataatgtcttcaatgtttattcatgttgaagcaatcagaattttattctttttaaaagctgaataatagaccattgtatgataagccatattttgtttaaccattcatcccgtgaagagcatttgggcggtgataatcttttggatattgtacataatgctgctgtgaacattggtgtgcaaatatctttttgtgtcctggctttcaattattttgctcacacagttggcccttgaacaacatgggtctgaactgcatgagtccacttatatgcagatattttcaataaaacttacactgaccattcctgtccctcctgcctccccttccacttcctcatcttctcccagagacagcaagaccagctcctcatctttgtcctcctccttagcctactcaacctgaagacaacaaagatgaagacttttgatagtccatttccatttaatgaatagtacatatatgttctttcttattattttaataacattttcttttctctagctttctttaagaacacagtatataatacatacaacatacaaaatctgtgttaaatggctgctatgagtaaagattccagtcaacagtgagtatgtgtagctaagttttgagggagttgaaagttaaatgcagattttcgactgcacacgggtcagcaatcctaacccctgaattattcaatgatcaatcatatacctagaagtaagatttctgatcagatagtaatctatgatgctttttacagtggctgtactatttttcattcccactggcaatacccaagggtttcagtttctcgacatcctcaccagtactttattttcttttctttaaaaacaaaataacagccatgcatcacttaatggtgggaatacattctgagaaatatgttgttaggtgattttgtcattgtgcaaacatcatagtgtgtacttacacaaacctggatggtatagcctgttgcttctaggctaaaacctgcatagcatgttgctgtactaaatactggaggcaactgtaacacagggtaagtgtttatgcatttaaacatatgaaaacatagaaaaggtacagtaaaaataaagttttataatcttatgggatcattgtcatatatatgttccatcattgacttaaacactatcatgtaatgaatgactgcatttagtaattatttatttatttttttaatttcttatattgttattgaaacaaaattttggttctttattttaaatggaactcactttttgttatgatgtaaatgacagatctaacatttttttcttccaaaatagacagccaattgccaaaacaaatatattatttttctagaattatccaaaatgctacctaaaattcctattccaaatggatctgattatacgttctgtactgttttccatagatctatttgattatttttgtgtcagtactatactgttttaatcatgatggcttttatgcttagtttaatagctggtacagcaagccttcactcacactcttctgtccaattgttttaaacagtttaatttaatgctgccctcaggctgagaaacttgtgccagaatgtaaattaagtacagcacttactataccatctactttacctgatagcaagacttttttcacaaattaactggtgcattgacctatattctgacacattctgataatgaactagttaaaaaataaaacagttcatgtaagttgcgatgggtggactgcacttgagttatattggtttagacttcttggctatgggtaatctaaagccagggaaccatgcttgttctagaaggttttttccccctgccctcctacccctcctaactttctatagcatgcacatccctgcaagtccctttcttgcattttctctctagtgtttctgatgacttttctcttcccatgctgcagcccatagagcgactgagcattaggactttctgaagggcttaggcagcatggaatcccataaaatctctggtatcatctctcacttaccaactagttaaaatttcatcttcttcctgagtggtgcaaaaactattctgaaatcaaattatgcattctttcttgctttattacttatagtttaaactctggctccttggaactcacaaatcttttttttctctcaagaaagttcactttttataataaaggcttgttttagactactgttgtggttattggcttaaaacattattcttgtagattttttaattcctgaagtttttctcagtcttttaggaaaaaagaaaaaacacaaaaatgtgttcaatgttagagtctgcttcgatctctacttatggttgaagtaatgaagacagagaagttgtagcatgggaaaataattatagtctggtaaaaactggtcattagaggagcctggagttgagggaaggaacaagagaatacaagtacaaagtagacatgcttgcaggatgtgcgcatttccccaggaatcactggaaacatttttggagggtatctgataaagactgagcattgtgtactcataatagatgagttatggatagtcagaccatgctagatgagcccgaaagggaagggtgactcctcagggtaaagaagttacagatatttgaattgcatgggcagtagaaacttacatgcagcatattattttaaaacagttcatttattcatagctattataaattgcataataaaaagaagtaaaaagtgaattggaagtatgtttctgagtgattaggtaatatatttcctacgaaattaacaactgatgagtagaagaggactcaagtagtttcggatccatccctgcttcttgggtagtgcgtcaataagactcttggcaggacacttcttaagggattattaggtgtcggtgcttataatcagcatcttatataataaggagatatcattatttcacatgtagagcttcagtttgcactcacgttatatatatatgtatatatatatatatatatcaagtggaatatattagtaatatttcaaaagtactgcaaatatttcctcatttcaaagagtgctcttctcttccttctactgctgaagtaatatccttgtatatctccaattttttttttttttttgagatggagtctccttctgtcacccaggctggagtacagtggtgtgatcttggctcactgcaacctccgcctcccaggttcaagcaattctcctgcctcagcctcctgagtagctgggattacaggtgcgtgccaccacacccggctaattttctatatttttggtagagacaggtttcatcatgttggccaggctggtctcaaactcctaccttgtgatccacccacctcgtccccccaaagtgccaggattacaggcatgagccaccacgcccagccatgtgtctccaattattaattctagaaaaagataaaggcttattttatataaattccctccatatagataacctttttatccctcagaaaatgtacttataaaggagcagaaatggggcaaaatggtttcacatgctacttattgacaggaaaagacttaaagttggggtggaaaagaggattcaatatcatgttacacaattcttcataagatttagtttgctttttcttggaagcacagattaatttggagtcttttacctttacatatggatttcaataacctttttttattcttagtgtataaaattgcctgccatttccctcccacaagtaatatcattataattttaatctaattagtttgcctacatacttgcattccttcatcttcttcctattccatttattaatatcattctttcctctctttattacctattttgtcataggaatatagttcaatatcaagtcagcatttacctgacaatgatactaaaaataataatacaacatttcttgaggacttattagctcccagtgtatatgttaagcatcttacaatcttacacaaattatttcatttcattgtcaaaacaactttataatatagatactaatagtatatttcatttatgaggaaactgatatttaatgatggagtagtatcatcaaggtatcacataacttgaaatggaagaatcaggatatgaactgtctcagttcacagtatcattataaatttaagtgatattttttaacttaaaagtaacatttatctcctataaacctttttattttctgaagtgtttttaaggatagttttctaaaattaaagttcaaaatgaaataattcatttacattcttggaggaggaatgaacgataggcagtttattaaattgatatttcctatcaaaattcttttagcttccatgttcatcttcttttctgcattgctattacttctaaatgatatagtcgaaatgatattctttcaaatttgaccgagtttagctatttatccactgaaaaatctcttgttgaaatttgatgtccaatgttggaggttgggccttgtgggaggtgttgagtcatgggggcagaaccttcatgaatggcctggtgcccttctcaaagtaaagactgagctcttgctctattagttcctttgagaacggattgttaaaaagaggctggcatctctctccctttctgaaaccatgtgatgcctgctccccttcaccttcctccacaagtgggggcagcctgaggccctcaccaaatgcagatatcagtgccatgcttcttgtacagcctgcagaattatcagctaattaaacctctttctttatcaattacacgctctcacatattcctttatagcaatgccaacagactaaaacaaaattgagaaacttcccaaatagatcactctgggctaagttgtcagtagaataacatgcagaaaactttaccagtaaaactgcatagaaattaccagaaaaacaataatatatgaaaaatcatttccatgactaaagtaagctacaaaagttatgagactcatgtataccctctattctggaaagaaatgaaataatcccctatactgatagggcagatcaggagaatcagccattccctcccttgctgcagcctcgtcaaaaataggtctaatgtaggctttgggagagcttaaagtcagaacagagaacgatgctctggcaaaagaggcaaaccatgtggtctgaacagagggagcagtcactttccaattttttttttttttttacaaataagcgtaagaaagaaacaagtttcaaagacagtagggaagaggaatggatatttaatagcttggtctcaggaccactcaggttccatctacaaattgtattgttggcatttgattaaaacttacttattactttttaaattaaatgactttattaatatgtctattttagatactcccaagagttacgggaaagggaaagtatgttcgttaggcaaaattccatgaaataaatccctagggaactttaaactttgtttcagttttttccaatgaacatgtattattttacaatggaaaatttcaactaaaattatttccagtaagatcataataagtctaaatttttcaactaaagaatctaaatgtagttgttattcagcaactactcttcctcctgctaggtttaatgctactggatcaactcaatcttttccacaatattgtcactcatacttgcttctttctgtgagtctttattcccttgacatagttgctatttcctcctccacagggagcaactgtatctcaggcagttacaaaatcaaaaattttctgtcaaacagcaaaatagggttgggcacggaggctcacacctataatcgcagcactttgtgaggtagagatgggtggatcactagaggtcaggagttcgagaccagcctggccaacatggtgaaaccccatctctactaaaaatacaaaaattagctgggtgtggtggtgcgtgcctgtaattccagctacttggaaggctgaagtataagaatcacttgaacctaggagacagaggttgcagttagctgagatcatgccactgcacttcagcctgtgtgacggagtgagactgtctcaaaaaataaaaaaaaaaacaaaaacacctcaggaaaataagattattaaactggaattaacaatttgtctcttacaggctaattggaatggagaatttttctgaagttggcggccagcctcattaaaaaaaaataagatctcaacttttaaacataagctctctattcagctagattacaaatatgaacttgtaaagtggtaatgctgattttcttccttagttccatatggtaattagtaatgagagtaaatgaaatagggtgcggacatagacaaatgatagcaaaatttcagaaacaagagactgcctaatgattaaaacagattttaaagctacagctataccacaaataaattgcctgttagaagctaacaaaatgtcccaatagatacattgtaaaacttaaccacacatagaacatagtgtgtgacaactcattttaagatttagtgtaacagtgactgatcaccaaacctaatgagtggtacaccatgaaatatccctcttgggggatcactgtgagtgtccttaaagggaagaaaatctcttctgagacttgtagttggttataaaattttcaaatgtttgaatcagtgttcagacttaggatcacttttgatgtgacaaaatacattaggtctatctttcagaaattacccagcactttgacccatgccataaaatttctatatcacattagaaagtcccattaggatacattgcagtgagaatctggttaagacctgcactgaagcgtgtttttcaatcttactgtacatgagggcaaatttttacttccttgcctctgcaatgctgaggcaagttaatttttacagccaaatctcatgtcactggtctactggttgagaatcagactcaggaagcacatcctgtgcattctggactgacctgctacaagaccctggtgacttgccatctcctgatgggaaaggaaacatcagatggatactcagaacatcactgggcattagtgtggttcctaaccagaattttgttcaatctgcacatggtccaagagattatctgatagggatcccacagaattgtgagattttaaaactgaaaggaatattagaaatcatatagtttcacccaaatacattatagatgtgaacaaaatttattgaatggagatagtacaatgagacaacatatctacatgtcctttgtgatggttaattttatgccacagtactcagatatttggctaaacatgtctggatgttgctgtgaatttatttttaaattgaggttagtttttaaatcagtacacttgagtaaaacagataaccctccatgatgtgaatgagcctcatccaataaattgaaggctctagaaaaatgactgacatccccaaggaagagaaattttggccaaaagcctgccttcacactggagctgcaacatcaactcttccctgggtcttaggctaccagcctaccctgcatattctgggcttgccagtctccgaaattgtacaagtcaatcccttaaaataaatttttctctctccacccacctacacccacacacacacatacacgcacccacctatacacacacacacacacacacacacacacacacacaatctattggttctgtttccccggagaactccgaccaatatactttcatccctgcaaggacctctcatcacagtaagtcattgaaaatccataacgtgacctataaattcctcatgatctgactgctggagacccctctgacttagtttactaccatttcccccctcactcattgtgtccagcaacactgaccttctgggtcagtttctatgttgagcttttgcatgtaaccctctcctgtggaatttccttccccagcaagagcacactctttcatttcactgaggtctctgttcaactctcactctaaatcctcacaacacaagtgggatttatgagctagtagcattgacatggcccaggagcttattaaaaataaagaatttatcacagatcttatcctagacctactgaatcaaaatctacatattagtaatatgccaggtgattcatgtgcatgtcaatgcttgaaaagaatagatgtaaagtgtcacctcccattgctctttggctctttgcctgcttcttcttcatggcattcattactaattgacattatattattttttatttacctgttgattgactgtttctctcactgtaaatcctaaatggcagggattctaatctcaagactggaatctgacctagcacacagtaggcatgcaatagatatttttactaactgaagaaataaatgtcaggcttggcagaatcttctttctcattgtgttttatgtctatagcattctttatcaactctatgttcctttaactcctacttagaatttaggtctcagtcaaggcagtgcttcttttgggaaagtcttttttgatccctccggtggtgactgggccctttggtgtgcattcatgcactgactcatcacagcacttaaaacacaagagagtaggtcctccatgaagaattaatgagtgaattcatgctggtcataacaaataattcttgactgaccactcaacatcctctacttgctcctttctatgcaatgactgatttttgtgcagatatctaatatcctccaatatgctgtgctacaaaccatatctcttacccactcccagggagtatgatctgacttgcccaagacaaaaaatggcagtccccttttccttgccagtgactggtttaagaacgggcaagtgctacagttctcattaaggagagaggagaccatgcccaggttcttagggagaggcacaaaataaggcaactcttttctccctctgaaaacttttgttgtgtatgtgtgatatcagattactataaccatcatgctaatagctattaagatgaagccaacccgcataaaagggtttagaaaaaacaatagcagagaagtgaaatcagaacttagattgtcctgctcttggactttgtatcatagcgtatggtaagtgaaattagcattgagttatttgaacctggaagcatcattttactttggtgatatgagtgtaaacttaaaaactacctccatagtggttgaaaagcaaaagtaattattagtctctgttaatgtacatattttcttttttttccccaactagaaaatttaatagtagtaggaggatcttcttagcgtaatagtaagtaacagacccttaaatttataaaacttatttgttactagacattaatcaacaagcatttactaaacgtataactattatactataatagagaaaatagcgattttaattttgaagcaaatcaagaaattcttatttgttgttggctgtccgaaggagcatgtttaggtcacttagttaaattctttaaacagtgatagaatcagtaaagatgttgaaatatccaaaatctatgatctccgaactcccaaaagaaaaaggaattaattgcgatgtatttcaaaaagtaagtgtacagagagattacaccaatttgttatctgactaaattgttgcaggactctgtgtaggaacagtacatacaacaaggcatcttttaaaggacagagtatttcctgaactacatattaatgttatttagacagattttttaaaagtttgatatgtacatcaatataaaatttaaaagggagtcatgggtgggggaaatgggaaaatgctggtcaaggtgtacaaagtttcatttaggtagcataaagaagttctggagatctaatgtgcagcatggtggctataattaatgatattgtattgtatctttcaaatttgctaagagagaaatcataacttctcagcacacacatgaaaataataactatgtgaagtaatgtatatgtttattagcttgattgtagtaagtattttacaatgtatacgtatatcaaacatcatgttatatactgtaaatataaaaaatatttgccaattataccttaataaagctgaaaaataaataataagaagcacttataacgccacagtccagagataatcacagtcgaattttctggtattttttcaatagttttatatgcatattttatgactttaagtataaatctaccacaatttaatcttcccatattttttgatatatattttgtttgactattataaatagtactgtaatgaatatgctttgcataaaactttaaaaaataaataaaacagtaaaaaagaaatataaatgaaaggagagtcaataaaaacctggatccaatgcacaaatgcatggtggcatctattaattcatttaatatttattaaatagtttgtgccaggtattgtacttgacacagggagtacaatggtgaacaaaactagaaacagtctctgaccttttggggctcacatattcaagaaggaaaacacttaaatagtaacacaaacatatgtttgaaagtatgaaaaaacattactggaagctgtcaaggaattttcaatgagtgcagaatatttgaaaagcttgagatataaaagatgaacagaagttgtaaggtgggagaagagatatctgagacaaagggtagagaataagcagaggtcctaaagtaggagcatttttggagtcttgtggaagtaaatgatttttttcgctgtaacccagagaacaagagtggcacaagaaaaatatggaagtatagtaggatattggaccctgaaattgtttgcaaactatgttaaatgtatgttatttatcgttaaaaaatagtgagatatctacttatattaagcagagggtgcaaggggtgcataaagaggtgagactgaagtctgtgcatgagaagttcaaatttgcattttagtataccctgcactacagacactgaaatacagataagcaaaaatggatgtaggtgcaccagttgagggctgttattgtgattaaggtgaaggataatggaagctttaactatgatgatagtaaaaaatgagagaagtgaacagaagagaaagatatctaggaagtagaatcaataaaatctggagatgagtttaaaagcagggtagcactgaatggaggcagatacgagacttaattgaaaacataaaacaggaagagaggaaatgagggtagtatcttttcttctatgaagtttgactataaaataaaaggagaaagacaatgagatagcttacatctaaaggaaattttgtttaagtgagggagacttgtgcatgtttaaaatattttgagaaggatccactttaagtagtaaaacacacatgacatataaaaatataatgaataaagtaagatttttgagaccaaaaatcaggaccagagtaagctggaaacatgggctttggataggaggaacaacaattcctctattggaactggaagaatgcagaatatattataagtgctagattttattgagaatattgctgtttgctgttgtttttaatctgtaaattaagagacaaggccatctgtcaaacatgaaaggggaacgcacgaacaggaagtttgaagactgtggagaaggtttgaaattgtaattgcaaggagtcaacatgatcagaatagacaaaatatctataggatttgtagataagatgaggttcaaatgagattggcaagcattaatttatagcaatgtcaatctgcctgttgtgctttgtctcttgaagctcttggccacctggctctagacatggaaaagtggatagttggaatcatccaagatggaagcatttgaatgaagcattctaaagcagttataaacatggattttggtggaaacctgaggcattcattgtattactcaaggagaatgggtagactaataaagaaaaaggaagaatatattagagttggacaagccagcaaaagagacagataagtaggtagaagtaggaagaaagccaagagagcctattatcatgcagaatgaaggagagaaagcaagaaaggtcactagtcagccgtgtcgatgtgaaagggaggtggaaaccagcactgaacatttagtaattaaaatgtcattaattctcttgaaaagaatagactgcatgaggtaaaaaaatatgtatatctgaaggactaaagtctgagcaagacaatttcaagaaacttgtactggaagaaaaaagtgagagaagcttgccatcaacttaacttttaccagcttaaaatggattgtttgttattcttccatctgaaaatttaaggatccagataaaatggaaggagaaaaaacggtcatcatcaaactgctaataatgataaattctggagaggaaatggcgttggaaatatgcaacatcccccattgtttattgtccatggttctctgttccttgaaaactgtcattgaaaaaagtagcattttttgtaattataaagtcaattaaaaattctagaatgcttctaataatttgacactttatttctagtattatctctatcatatttttataatgtatatctatgtcttacaacatatatcaatgcatatctagtattattatatctttcttatttttacaatgattcataaagaatacagctatagtaggcattccttcaaattgctcaagactgttttgatttctaacttaaatttaagttttcaaaagttcttcagcatattgagatgtttttgtcttctttttagcacagctaaaatattgcaaaatccctttctaagctaattttccattaattttccatgtggatatgagtcttttatgttttgttttattttacatcaacaattttcacgccagtgaattaaatacagctttttatttcactgctgaatgttcttcagttgtctgtaaaactgaatacattaaataatttattataatttaattaacaacatatgcttacctagtgacatcacatataaaggtcggctccaccgtgaaaatgctccaacttaagacatgctcagaagtcattttaaattttggttgtttttattgttgtttgactattcaattctgggtgataaataaaacgctttcccatgctgtccttacactgattatactcaagattgctttctacctaactcaaacaaaaccccccaaaacttacaaatatatattggttgctgaaaatgctcatacactcaatttgaaaatattccaaatcttttatgggttagacttttgtttcttgctcaatttcacactgacgtgtgtaaaagtattataagcatttgctatttagttcattatgggcaaaacagcagattgttttgtattttgaaagcatcctccctgggcttttaactaatctctcaatcacatgagaaaagctaaagaaagaataagatgctagcctatatacacatcatagaagcttgaaattggccaagtaccttggcagaaagaagggtgcttttattctagtgaacagaacaaagtagaatgaatttagatttttttttttaggagagaaaagtgtgatttacacaggaagagccatttcgtccaggtttgttgagatttgggcagtgtgttctacagcaaagacatctcccctgtagactctggaacattctgtattatcctataacagatgatcagccatatggtgaagggggaggaaaatcagggatataagaatctgctgtactagtagatgcatgaatgagaaaacaaaggttaaagccaaatttggggactgtggctggttttctcattttattttagagattttttattgagtagcacttcttggcatatgccaatatatttttaaagttatatttatgtattaagttttcttataaaaatatttttaaagttctctacaataacaaaattgagataaagtctcacaatttgttataatttggatacctctgaattattaaaattaactataaaaactcaaaaagtctagcgtttcagagatgttataaaacattttgaaatacttacatgaaataatctaattattccagtatgcaagttcctgctggtagtaggttagtaagttgttttagaaatctacagtaattctttcaaaacacaaaaatatagtgtggtagtaactcatgtaattttacctcagctgtttaaagtcaaaccaacttcaacactatctcaatatgttatgcaatcattcatatagcctaagagataaaaaaaagttttataaaatgacattggtagaaaagagatctgacacttgcctcccactttgcaaactttctccatgtttttggtatttatttatttaattaacatacaaattgtagatatttatggagtacagtgagctgctttgatacacatatatagtgtaataataaaatgagagtattagcctatccaacactttatacatttatcatttctttgtggtgagaacattttatatgcttaggctttgtgtccccagtcaaatctcatcttgaattctaatccccataatccccacatgtctagggagagacctgatgggaggtaactggatcatgggggcagttctcccatgctgttcttgtgatagtgagtgagttatcatgagatctgatggttttataagaggttcttcctgccttgctcctcatgcttctctctcctgccgacatgtgaagaaggtccttgctgcccctttgccttctgccatgattatagttttctgagacctttcaaccatgtgaaactgtgagtcaattaaacctctttcctttataaattatccagtctcaggtatttctttccttttttattattatactttaagttttaggatacatgtgcacaatgtgcaggtttgttacacatgtatacatgtgccaagttggtgtgctgcacccattaactcgtcatttacattaggcatatctcctaatgctatccctcctgcctccccccactccacaacaggccctggtgtgtgatgttccccttcctgtgtccaagtgttctcattgttcaattcccatctatgagtgagaacatgcggtgtttggttttttgtccttgtgatagtttgctgagaatgatggtttccagcttcatccatgtccctacaaaggacatgaactcatcattttttatggctgtatagtattccatggtgtatatgtgccacattttcttaatccagtctatcattgttggacatttgggttggttccaagtctttgctattgtgaatagtgccacaataaacatacgtgtacatgtgtctttatagcagcatgatttataatcctttgggtatatacccagtaaagggatgttatagcagtgtgagaatggactaatacaactttcaaaatcctctcttctagctattttgaaatgtgcaatacaatatagttaatcatagtcacccgtctgtgcaatagaacagaagttattctgtctatctaactgtaactttgtagccattgacgaacgtctctttattgattccttcccctctacactccctagcctctggcaaacactatgtctatgagatcaacttctttagatttcacatatgagtgagatcatgcagtatttgtctttctgtgactggcttgtttcactttatcttccagattcattcatgattttgcaaatgacaatatttcattttttgaatggctgaatagtatcccactgtgtatgtataacacattttctttacccattcatccactgatggacagttaggttgattctaaatcttggctattgtgaatggtgttgcaataaacatgggagtgcagatatctttaacactgatttcttttcctttggatgtatacccaatagtggaaatgatggatgatcccatagctgtatttctaattttttgagagacttacattctgtttttcataatggctgtactaatttagattctgagtaacagtatgtaagtgttctcctttctctgcatccataccagcagttgtcattttttgtcttttagataataaccattctgaggtgaagtggtatctaattgtagttttgactgaatttccctgatgattagtgatgccgaacattttttcatatacttgttagtgatttgtatatgattgtatatggtgtttcttttgggaaaactctttccagatcctttgctcaatttttaattagattgttttgttttgctttgttttttgctattgagttcagttgagttccttatattttctggatattaaccccttgtcacaagtgcagtttgcagacatttactctcattctgtaggttgtctccttattctcttgactatttccactgctgtagaagagacttggatacccatgtcttctagtttcatgtaacttaagttgttgatttgtttttgttgtctgtgcttttgaattcttgaccaaaccaaagtcataaggcatttggaaaagtacagtctcttcaataaacagcactgggaaaactggatatccacatacagaagaacaaaactaagctcttatcttttaccatatacaaaatcagctcaaaatggattaaagacttaaatttaggaccccaaaaatataaaactactagtagaaaacataggggaaatgctttatgatattggggtcatttattttttctcttgtacatttgtttaagtttcgtatagactctggatattagacctttctcagatggataggttgcaaaaattttttcccattctgtaggttgtctgttgctctgataataatttattttgctgtgcagaagatacttagtttaattatatctcatcaatgaacccattaaaaagtgagcaaaggacatgaacagatacttctcaaaaaaagatgttcatgtggccaaaaaacatatgaagaaaagctcaatatcactgatcattagaaaaatgcaaatctaaactacaatgagatatcgtctcacgccagtcagaatggcaatcattaaaaagtcaagaaacaaaagatgctggcgaggctatggaaagatagtaatgcttttacacagttgatggaaatgtaaattagttgaaacattgtggaagacattgtgacgattcctcagagacctaggacaaaaaacactatttgacccagcaatcccattactgggtatatactcaaagaaatataaatcatcctattataaagacacatgcatgcatatgttcattgcagcactattcacaacagaaaagacatggaatcaacgcaaatgccatcaatgatagactggataaagaaaatgtggtacatatacatcatggaatactatgcagcaatacaaaggaatgagctaacatcctttgctgggacatggatggagctggaagccatcatccttagtaaaccaaggcaggaacagaaaaccgaacaccacttgttctcactcacaagtggaagctgaacaatgagaatacatggacacagggaggggaatgacacatgagtcttatcagcaggaacgggggatgtggggagggagagcatcagaaaaaatagctaatgaatgctgggcttaatatttaggtgatgggttgacaggtgtgacaaaccaccatggcacatgtttacctatgtaccaaaactgcacatcctgcacatttaccctgaaactgaaaataaaattaaaaagtgagagacagaacacaattgacaacagatttcaatagtatattttattacatttttgcaacagcattcttcttggcttttccttcaaaaatgattttccaaattttgtactgagataattaaaaggcaattgagttttttctaaaatagttgattaaaacttgtttccattagtgtttatttttgttatgtatttatcttatttgttaaataatgaaaactatttactttttatttttaatatgtattattttataacatactgcagaaaaatatatttcatcttcattttataattcacaatgttatataaaacctctctaccaagttctgtcataaatgagctgaaaaatatcagaacatttgaagctgtcttctgctatgtctaatcttaagcatccttagaattgattattctctaactagtttgatattaatgactccttagagtggcagatttttctttgtgttatttcattgatatttgtgtttggtgtcaaattagcaagaaatctagatatttttctcatgtcctcctaagtcacattccttgtcactgactatcaaacattcaaaatgtatccattatttatgttaatatttaactctttctccaaataaattcctgctttgatatagtctgatattttattacaattggcttgcagataactttttgttgattttatcattcatctttataaattatatttcataatctatgacattaatgtcagtactctgttatttaaccaataaaagtaaagatgatgaaagataatatatttgatatacatcaatttttatttctacaaattttcctttgtgttatttgaatttagaacatttcaactaaaatggcatttctgggccttatcaatagtttgactaaatttttgaaatcttgtttgtatttgggtttatcttttgaatcttttatataatatttcagagcttttaaaatgttgatgtatctatcatgcaaaaattggacagaaggggttgtttttgacagaatctggcttagaggaagtaaatttgggaatgcattaagtttaggtttagtgagttctacttatgtggttgacagtaatttcaatgaatgatgtagaaatggcttccaggaatatttctacgacccactctgaaaattcactcaaactcatggcaggagagtacagaaacacatatcgtattgtaatatgaatgcattctacaaccccatcaactccagcaaacacaaaggaatgtgttgatggaggggaaggtatagtttatagtcatctttataggtctgcagaagcatttcttgcctggatcttagggcaatacaaactataacttcacacatcaggaggcccttcatatcacaaatactcacataaaatatttgttagataaattatgggcaattctcaaccaggatctacattcacagctgatatagtgcaactcctaactttaaacatccactctcataagtaacatcaacaggccccagggaaatacttctcatatcttgccttaacttctcgaaacaaaaggtagttaattttgaatgccttcaagacttgtgtgagtcagacactgcttctaagttcataaagtgtttgaatagataaagcatttaggtaaaagaagaaacaaattaaccaaatagtcaaatcttcctttcaagtagcaataatgcaatagattcttacataatgcagcattattttccagcaatgctccagcatgcacttttattctttgttctatgttccaatttgttgtttctaggtattcaaaaagttgtgcagtatgcccaagatgcaggctaagaatgatcttacagtattaaataatggacctgaatcttaaatttatgtacatgtgagtgtctattggtagtatgtgtgaagtatatctttacactgacaatgagatggacactaaacatttgaattgcaaacagattttacacttgaaaatatttaatcagatttaataaaatcttcaagaatattaagcatgttcagctttattaagataatttttattgaaaattttgaaatacataattggtatttttaattgaataaataattgaaatattttaaggactatattattttaaacatgtgtaaactaatttcatatgtaaacaaatttcactgtatgaaatttaaatttttgatgaaaaaatatagctaattttttaaaatttggaaaataatcatgcttttaatcctttagatcattattagtaataaagcttaacgctattacaattttatttcaacaatgtaactagtaattttgcaaatataatgtaattaaaataaatttcatgaaatatataattatttagaaatatctatgtcattttattcctcacccaacatccactggcccatctactgtactcccagacatgcagaataatgataatatttagtaattggtattctgcagatttttagttatatataattcatagctgtacacctgtgatttcttgctaaacagaatttttcaattttaaggtagatgaatttaccattttcccccttatagataataattcttatgtctggttaagaaatttttttcctaacccaaggtcataaagatattcaccttttttatttcctaatattatatagattttgtttctttatttagatctttatgtagaattcgtttttgtacagtttttgagatttgcatctagttacattttttaatatttctagaatcatttattgtaaagcctaccctttcccaacatctcataagaaccacctctattatctatcaagtctctacatatacttgtatctatatattggctcttaattctctttcattatctatattcatattgaagtctatatcctcaatttgtatgccagtaccacacttccttaaatactaaatctcatgctggctggtagggcaaatatgttcaaattattgttctacctcaagagatttttggcttttattgactctttgtactttcatataaaatcttagaataagccaatcacttttcacacacaaatcaaaaacatattgtgatattaatttaaaattctttaaatcaatacacaaatttttggaaatgtgacatctttacaatattaaatattataatcatataacatggtctattagcccatttattttttaaatgtctctaccagcaccccttagtcacaaataattatattttctttcaaaagtgtattaaaattgtgaatcataagtactttgaaattaaataaaattcaacacatatgttgatctcatactatattgtaagtgttgtggtaagacaagagtacggaaccaaggaaaggcatgcttattatgacagtgttttttaggtgtgtttttaactgcatcatttttgagtattgtttattctttttcgaaatactttagctgaatttgttatctggtttgtgttttatgtgccctacaagatacttatatcaatcgaacatctttctgcacattctcatcaagagatcaacagaaagacttcaccacaagataattaaaaataccaaagcattcacacacacacacacacacacacacacaccccagaactttcaactcagcccagattatgcaaattattaagtaaagctaatgaactgaaatctaatatcaatctggaaatgacaggctaaaactgaagctgatttagaaaacaatcccaaatggaaaatagatctgtttcaagacagttttcatttccaaagctatttactccttgtttgagtaaataaactagagaaattcaatttcttctctatttctatagctcatttagctatatatctcacagttgtagtcattttcaaactataattctggaggtggcaagatagaacagtatgttcctaactatgacttacttatttaaatttaagatttatacttttcttggaaattatgaaaagaagtaaaattatttatttgctaacttgatgttcccagctcctctaatcaatcatgtatttctgtgtcagtgtatttctttcagtacttttcatttgctcttttaattattcattcacttatttaactagtcatttattctttcgacaaataggcactggatatatgtcattataaaacagaaacttagcctctgtgatcagagactttacaatgactccaatgatattacataattttcagatgttggcaaaataatttatttatttatttttttttttgagacaaagtctcgctctgtcacccagtctggagtgcagtggcgcaatctcggctcactgcaacctccgtctcacaggttcagctgattgtcctgcctcagcctcctgagtagctgggactacaggtgcgtgccaccatgcccggttaattttttgtattttttagtagagatggggtttcactgttagccacaatggtctcgatctcctgacctcgtgatccactcaccttagcctcccaaagtgctgggattacaggcgtgagccaccatgcctggcctaatttaaatattttctaagtatacttaagtattattgcagaggcatgtcataacctttgaatttcatactaattcatgaatgaaaactgacttctaacaaattcatagattaaaaactattctcaaagcatacacagtgagtaaataaaggagaacaccaaaattagaagagaacatagaaaaaattccatgcagttcacaaagtttatatgtataaattggtaggcgtaaaggtatatgtctgtatatatgagtatatgtgtgtttgtgagagagcaattttcactacaaattcagggttactgtattaaaaattcatagcactgagagggtatttaaaaataaaatacactttacagttttttaatgcaagtttcccattaatttgatttgctgtagattatttaaaaatcagatattattgacaaaactaaaaataaatgaacaaattcattattcatccattcattcaacaaatacttactaattattataagtatatgctgttttaggtattgggtatacagaaacaaagcaaaaaccttattcccttgtttcttttttttttttttttttttttttttttgagacggagtctcgctctgtcgcccaggctggactgcagtggcacgatctcggctcactgcaagctccgcctcccgggttcacgccattctcctgcctcagcctcccgagtagctgggactacaggcgcctgccaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgttgtttcttgcattaaaatatcaaacactaaaaataataagtaatagttgttatataatcacgacatggtaggaacgacatgtgttggtccacgttggtccattttgattttatctttaaacagcacagcaacacaggtatttgtatacccatgttagaaagatatgaggatgatagtttttacatgcttgaaagaaaaaaaaagagagacatgagaaaataaatatcaatagggatgttatttttcatccaaattaggtctaaatttatgtgtatgtttttgtatgtattgggggaggaagatatattctagctgaaagtaagatttttgttaatagtttgaaagaacttcaaaatgctaacaatttttaacatctaagactggaacttaattttatgtctaacgcagactgtccctttgtgctggaaaaccaacacagttgagcatatcatattgaaaacaagtattcattgtttttggagaaaaaccaaaaacaatgtaacacgaaattctgactgaaaacttaactgttttgttttctaaatgtaaattgagtatgactatctttaactaccagtacctctaataactaaggcttactgagtgtagggcattttactgaggctttaaataaaatgcctcatttaatcatgacactatccctccacagtttttacagacattggatagatgaagaaaccaaagcttaggggaatttcagtttatcattggccgcactgcttttaagtaggagatttctgagctgatgcgttaaaccaatatattataataataatattcttaagataatatttcctttgtacaaagtatgcactaacaattcagtttacctgtatacgattgcttttttttaagtaaatatatatgtgtgttcttgtctgaacatttttcacaggaaaatggacatcacagtagtcaaaaacttcagcaaatgtacaggcctagtttgttttgttttgttttgtttttcagtcaactgaagaagaaattgtaaataaattagtaggatttggtataaaaacacagctcagttgggattgttgatgatatttaaacacagacaaaaaagcttttgcaccactttcctttgtgcaatgtgggaattaaggaggagggcctggtccaggggttgtttcatcctaaactgatggaaatcccaggaaagctaagcccaatggaatagcactctcatgatgaccagcatccagtgtggagcacaggagaggttggagataaagaaggacgttttcctaagccaatgagacagcactgtcagaaacagtctgcagtagctgggggaagacttggaggctaactatatttttcaacagacttgatggttattctaatagttaagaggacagattctgaatttgcacagcttgaatgcaaagtcttccctacttattattgtatatccttgggcaaattaattaatattttggagaagcagtttcttcaactcaagattgtggaaaacaagaatgtttatttgtactcctgagagaattaaatatcctgattttgataaagtaattagcatcgcacccaacacagatgaagtggccaagaaaacttggctttttttttatcattattatagatgtacatgtatgatttgtggccatgagctgcagcttggcattacatagaattgagggcaaaataaaaatattcatcctctggcgatcttcatttaactaagttttacttattaaaaaattatcaactacaatctcaaaaataggttcccttacattttagtctggctgataaaagagtaaaattttaaaaagggtctttatttgttgtctttacctcctacacctctattcagctttgagagatagagatgtaatgtacatgatattggagacatggacactggtttattggaggaactctgcagttcacggaattcttgcatatgttatagatcaggaatatgttaatttgtccctgaaattactctaacaccaatggcaattctcatccccactcacccttagaaatcgttaagactaagccagatggggctaatgaacactagtttccattgccaagaattagattaacttaaaagaagagaaaaaaacttaaaaaaataagatctatctgaaaaagtcactatgatattaaagactactctaatttcctcgtcatactgtactacaatactttttccccactttagtttattaaatgatgaaaaaggtaaaaaatgagaactacctctccaaggaagtaatattactctattttccttgtggttgctataagtatattagcacccttggagaccaagttaagcaaaataaaataaacaaataaacaaaaaccatgttgctaatgcaaccaaagctcctggaacttataaaagaatctgtgtccaaaattttgtgttcttatacttggaaaggaaaagcatgaagtatcattttaaaatatttcagtttatttttcttcttcaagaagcaaactacactgctagacattttttttcaaaatgttcaaacaattaaaactgttccaaattttctttgaggaagtaatttcagtttaaagttttaaaaatagccaaagaggataagtgaatgcattggtttacaaaatttcattttttattttatatatttgaaacttgtatattttaggatataaaaaagagaaaaagagaaagaataaaggagtgtctgaaaacatgcatggacatagtgtagtcccttctgagaagcaatatgataatgtgaaaagtataaaacagagaaagatatgcaatcagaaaacatgggattggttcaagaataacccttactgggaatcagaaaaactatataaataaaacctgagtgatagtgactacaacatgatgaactgcaactcctttaaatcagtaaccgaaaacctcccaaaaaagaaaagctaaggaccaaactcgttttacaaggctagcattacccacataacaaagtcagaaaagggcactgcaagaaaaaaacatatataggccaatattcctgataaatatacatataaaaatcctcaacaaaatactagtaaactgatttcaaaagctaattgaagggatcatgtgctatgataaagtggggtttatccctgggatgcagatgcaaggatgattcaacctatgtcaatgaatgaatgtgctacaccacattaacagaatggaaaacaaaaactatatggttatatcaataaatacagaaaatcattgacaaaattcaacatcttttcatgataaaaatactcagcaaattatgtataggaggaatgtaccacaacataatataggccatataaaagaagcccacaaaccccataatcaatgaggacaagctgaaagcttctcttctatgatcaggaataagaaaagtgtgcatacttttgccaattctattaaacatagtactggaagttgtatttaaggcaatcaggcaagaaattgtttttaaacaaaaggtatccaatttataaaggaagaagttaaaatatcactgtttatagataacacgattttatatatggtaagacctaaatttttcacacttgaaaacaacctgttagaaataaaaaacaaattcagtaaagttacaggatacaaaatcaatatacaaaaattagttgtgtttctctacgctaacagggaactatccaaaagataaattaagaaaacaatgtcatttcaacagcatcctaaagaggaacatacttagaaatatatttaaccaggaaggtgaaagatctgtttactaaaaattataaaacattgatgaaataaattgaaaaagacacaaataaatggaaatatgtaccatgtacatgaattggaagaattaatattattaaaatatccatactactcaaaataatctatagattccatgcaatttctatacaaattccaatggtatttttcacagaaatagaaaaagcaatcctaaaattgacacggatccacaaaagaccatgaatagccaaaggaatcctgagtaaaataacaaacctagaggcatcacactatctgacttcaagatatactacaaagccatagtaaccaaaacagcatggttggcataaaaacacatggaacagaagagacagcccaggaataaacccatgcatttacagtcaattgactttcaacaaaggtgtcaagaacacacaatggggaaagaacagtctctctaacaaatggcactgataaaactgcagaagaatacaattaggcccttctctcacaccatatacaaaaatcaactttgaatggattaaagacttaaagttaggatctgaaactttaaaactaacacaggagaaagctctatggtgttagcttaggcagtaatttttcagatataaccccaaaagtataggcagcaaaagcgaaaatataaaaatgggattacatcaaactgaaaatcatttgtacagcaaggaaacaacagagtgaagagacaactgtggaatgaaagaaaatattttcatatcatacatctgttaaggagcagatatccaaattacataatgaactcactgaactcaatagcaaaatacaaataagacaatttttaaaatgtacaaaaaaatgaatgggcatttctcaaaagaagacaaatggctaacagatatatgacagaatgctcaacatcactaattaaggaaaggcagatcaaagccacgataagatattaccttacacctattaggatggctgttaccaaaaagacaagagataagaagtatgggcaaggccatggaaaaacgggaagctttgtacactgttcgtgggaacgtaaagtgctacagccattatggaaaacagtatagaagtcaaaaaaactaaaaatagaactaatatatgatcccacaatcccacttctgggtatatagccaaaggaattaaaatcagtattttaaagagaaatctgaactcccatgctcattgcagtgttactcgcagaagccaagatatggatacaaccactcatcaacagacgcatggatgaacaaatacacacacacacacacacacacacacacaaaatgaaatatcagtcagtcttaaaaaaagaaaatcctgccatatatgacaacatacacggacccgaaatacattatgctaagtgacataagctaggcacagaagggcaaatcttgtatgatctcacttatacatggaatctaaaaaagtctaattcatagaagcagagagtagaacagcgattgccatgggatgggataaaggaaatgaggtgttgcccaaagggcataaactttctgttataagacgaataagttcagggaatctaatgtacagcatggtgacgatagtaataatactctgttgtttacttgaaatttaataaaagggcagattttttttttttttttttttttttttttttttttttttgagacggaatctcactctttcgcccaggctggagtgcggtggcgcgatctcggctcactgcaagctccgcctcccgggttcacgctgttctcctgcctcagcctcccaagtagctgggactacaggtgcccgccaacacgcccggctaattttttgtatttttagtagtgacggggtttcaccgtattagccaggatggtctcgatctcctgacctcgtgatccgcccgtctcggcttcccaaagtgctgggattacagacgccccaaagtgctgagattacaggcgcggagccactgtgcccggcctaaaagggcagattttaagtgtccccactccccagccgcctggcccaaatgctaattacaggtggtaatgaatgtattaattaatttgattgtggtaatcagttcacatctacatgttatcaaatcatcatgctttaaatcctgaatatatacaatttattatttgtcaattaaatatttaaaaacaaaacaaaacaaaaaaccttgcaatctcctgccaacagttaaacaacacaaactattcttcaccagtgtgttcaaatttattttgataacaagagactaaagtaaacgttaaatttacttaagaaatacctgaaaagagattttggtaaatactctttaaaaagcttggtggctgtctcaaaatccatctggaaaatcttcagaaacattttaccaggaattagcaaggtaagtgccgtaaaccaacctcatccaacagaagtatttgtgtatatgggtagaaaatcactgccatcagcagtcagtctgtgctcatcctcccatagctctgacacaaaattatactttaaaaagtttcccttcgaattctgccacccctccacatacttattaatatttattagcaagcaagcaaaagtcacttatacaatctttctataaattgacaaattcacagatctctgtcttttgatgcaattagaccataccttgtatgataaatcacttgaaataactatagcaatattccaaataaatgatttcattacctttatagttagcgataagaacctagaaatctccctcatgcatggacatagatgagttagagataaagcctaggcaaggctatctttgcgatagtctaactaatctatataccttgaattccacttattttaccagtgagagcccacttctaaaatccattatactaattaacaggccactaatttcaccaatgaaaacccacttctttcattttgctaattgtaaatgcctttggtgttgatcaaagataatgataatggaatggctattagtagttcctatggagtgagcatttcctgattagaatgccagtgtgaattcctgattaaccaaatgattgtccctacagtgcagcataaaccatttatacttaaatatcactgtctttaagttgaagtttttcaaattaagttataggcatcataataataaaaatattttaaacagctgtctaatagattatatatgagtaactggcacatgggaagaggtcatatgaaacatcataggagctagagatttttttttaattgatcatgcctctccaaaaaagcctagagcaaggtaggggaaagataaaattaagaagacctaaaaaacattttaagaactttacatgcaaggacatatgatctataaaagtagacttttttttttggtgtgtcaaagataaaagggtagatagggaataatggattataaatcattgagaagtaagtgaagttcctattgaaagttgaagaggagagggatttcagtcattgtggtttatccaggaaaaattaatttgatctttggagccgagaagacagacgtagtgaatcaaagactactacatacacagggtgcattgacgaaccaaggttagatcactcatcagaactgactgatatctactcgagagtttgaaaaaatccagaggtcagattatcaaaattttactcagaagctattaacctagctttataaacaatcaatgggacagagtaaaagcagctgtcaattcatctcttgtccataaacagttcatgagagagtttcagttacatttctaaatattccttggataaaaggacgttaggaattgattgaaggacagctaaatagctcaagtattctgtgtgtttttgggttgtaactcatgaaaatagatatcatggaagaagaaaaaataaaggaatggccaactggaagaattacagaaattataaaggggaggaaatttaacgcttaaagaataaaaactagtcactatttcttcctcttgatactccccaacgttatgtacacacacacacttgcgcatgcacacacacacttgtgcatgcacacacacacgtgcacacacacacaaacacacacagagctaaagaagcttcctaaatgaagccttccctctcctttactctttcatgaggctttaggtatacttatctcatgcaagttatgaagaactttgctgtgctgagattcaactagatacttcaggaaggagccagagtctccaaacccactggattctttgttaatgactggcaattacaggatgctggggcaagggattatgaaagtcagacgtagactaccatcacctactggtccaacttgtcccaaaaacttggaaaacttggccaaaaggccttctatttattgaaaaatgcctgcaacactctgggcatagggaatgctggtttccattttttgagtaaacaatgttggcgaaggcatattattgtcagcatagagtaaagccaatttatttcgatagtttctatcgagtgggaattagaaaaacggatgacccctttgtttaacacatttatatggataaacatatctattcaaattctagactaactttggtgcctcattttgtggggtctcttttctgactttggacacagccataacctctgaagcctttaccatttaacttcttaattttatattttctgaattttagctatttaccctactagaatgaattatataatattttttcataatatttttcacatagcaagtatgtcacatttgtttaatacacatcatttcaagtttgtaagacaaaagttgaggagcaatatgacatcaatctttaaaaataaatatgatgaagaagagacaagaacttgttctctcaatttgtaatgcttgaagccttttaacctgaaacagatcatcttccaacatataaaaagaagactatttaaagatagtgtaagcaatgcatgagcttatttttctatgatcttatacaggttaaatctgtaaccctattatcagagaatttatataagttcatgaaccagagataatttattagtgaggcaacaggagatttggggaacatttctacagtatcattagggcagttctcaaatgtgtcagttctctcagatgacatttctctgcccacttgaactcatgtggtagcagggccatgggaaattaaatgcagccaaaatagcaattcctagcagaagcatgtgtgtagttcgcatcttctctttacctggcctctatgcatgaggaagcaagtttcaagatatagtcttcatcagtatgggtctctgcgtgactaatacatgctgacaccccttgctgacctccaatgaacaacgaatatatgatgtagtgagaaataaaccttttcacttttcattttaagctgctgacatgtttcattatttgctaccaatcctttaatccagcttgtcccacatgatacaattctccaaatcttatgttactgatatcttgaaattcctcaaagccctttaggccctcaagtaaatggctgagggtaacagagaagaaatgcaattgaagagctgttccaggaccttagacatctagaaactcaaccatagccgctgcactttaatctattttatatagatatttatgttgctctcaatccatctcctccataaaaaattgtacaccactattgctagggatagatcttttagtctcggcctataatagcatatcatgttttattcattctacacatatttgataaggcctattgcaaacaaagataggttataaggtactgtagaaaatacaagaagaaaaaggtaacatttcttgttctccagaaccatataatccagctgaaacagtttacaaaatttctttcaaaatttctccagatggagtggaagaagcctatgaacttttaacatatttatttattcccaaagaaatgcacagaattaaatgtaatgaccattttatttttaaaattaatattctctgaaaaaaccctacatatttgcccatgagaaattagtactaatttcagatctcctatatgaagtcctttttatttcagaatccttttgcctgctcttttggtaaatagacatccttaaatggattagggaaaaatttgtctttttgtatctgaaggaggcaaaaggaattaaaataggatttcaaaaggtagccaatttcaaaatcaggcaggctaattttgttataaatagagtaattaaaaggattagaaaaagtgcttccctttgttagactgacactcttacaataagatgtgaacacacataagggcaaggaagtgtgtcataagtaccattagtggccatgatatcagtctctttgttttggatatcctttttcttcatccccattttagtcttctgagtagaatctatccatcatttcaaattctctctttttttaatgtttcctaatcaatccaccagggattgttcttattgtccctctgtacatatgaacacttcagtggttccctagttgtttcatgtgttttagcctcctttcctcaaacagaaattgatttgttacaaactcccatttcctacttttctcaatgtttcccacaagaaaatcttgactatacctaacacattgtaatcctctacacaccatccttttttgcataattcccttcatctcttaatctagaaacccagagaagaaaatacacttattataggaggcccaatttctagtgaattcatcatcttctttatgctttttgtttttgttttgagacaatgtctcactctgtcacccaggctacagtgcagtggtgcaatcatagctcactgtaatcttcaactcctgggctcaagcaattctcccacctcagcctcctgagtagctgggactacaggcgcacgccacaaggcccagctaatttttttttttttttttggtagagacagggtcttgctatgttgcccaggtcaccatcttctttgctgttcatgctcataaatgatttaaacttctattgtggaagtctgttgaagttcaacaatgatagcaatcacttatattttccccatttttttgacaacaggaagtggattttcctttcatttctccagcaccattgttattccctgtggttctgcaaaaataactgaaaatagttctacatcaacatcttccagttctctcagaattctggaatgtgatttgtctagcctagaggcttgaagtcatttaaagcagcaggtaattttactataccaccaattgggctttgattcccttaagcatagttattatactccatctagtttaaagatcattctccttgatagagaaggaagaaacaaaataggagttgaatggttctgcatttttttcctgtcatctgatttctcaccatctggcctaaacagttgggtttatcccttccttgttcttctttgacatgaaaggggactttcatgaattgtgttgaaaaaagaattgaaaactactgtgaacataccaaattgaattgaaaagcacagatcatatctagggaaatgtagtgagaatattactaattgctagatcaaatttacaaggaataaggagacaggaatgagacaaggagatgaaatattcatctggaacaattaaaagatcaatggtgatacaattacaaaacaggaaactaatgttctaaccaaagcatgttttcttcttcaattaataataatacagtgtgctgcactatataaaacagctttataatgtcagttgcatttcttttgcaaaaccacaatgcaggacagaccaaagagatggatgatttgcaacaaaggcaatgcactgaaaacaggagcttttaatagctttctaaactcataagagctgtaaaaatcctcttgaacctacatccatctactctcccaaagaatatgctaaaaaggttaagaaagcggtaatttaagtctcccttgtcatttaattctttgggagtctgtttgtgaactttcaaatctacctggcacttttaatttttttgttgttgttggggagaagggttggctaacatttaactacagtattttttttttttttttttttgagaccgagtctcgctctgtcgctcaggctggatggagttcagtggcgtgatctccggtcactacaagctctgcctcccgggttcacgccattctcccgcctcagcctcccaagtagctgggattacaggcgcccaccaccatgcccggctaattttttgtcttcttagtagagacggggtttcaccgtgttagccaggatggtctcgatttcctgacctcgtgatccacccgcctcagcctcccaaagtgctgggattacaggcgtgagccactgcgccggccttttttttttttttttttttttgagactgagtcttgctgtgtcacccaggctggagtgcagtggcgccacctcggctcactgcaacctccgcctcccgggttcaaacgattctcctgcctcagcctctcgagtagctaggactacaggcatgtgccaccatgcccagctaatttttgtatttttagtagaaatggggttttgccatgttggccaggctggtctcgaactcctgacctcaggtgatccacccgcctcgacctcccaaagtgctgggattacaggcgtgagccactgcgctgggccaaactacagtattattaatgcaaaaagtcccttcacggagacctgaagacataatttgttgctcaatagaaatccagcattttaaaaatccagaaaagaaaacttggtccgattaatcagttgaagattaaagtaatgtgtagcagatactgccaggtggtattccagggtattagaccctgttcattccatactttcacagagacagtagaaaacatagtaaaatttccaatatcataaatttcccttgtagaagctatggcttatcattcttttatttctactaaaaatattcacaagattgtgtctaagttttgtgcttgcattagcaaagaagtatgacattgggtaataggccacccacagtaatatcttccaaactcttaagactggtagcagcaaaggagtagaagatagaagagaaattgtctcacctgacacagaaattgttgagagtttggaagtttaggacataggaaatgtaatgactctacagaatggaaaagggatcaagccatttatttttaaataattttgatttagagtcaaccaataccgttgggaggattctatgccacagtcactctgttatgcactttcacaaccactgtctattacatttcaaaaattatcctgtcacttaggaattatcactcccattttacagaagaaggaatcaagggatgttaagcaattttcccaaggccaaatagttggtgagagagcacacacgatagaatgtgatttcccttgccagttgagggactacagctccccctcattgcgtattgaacgcagaaaatgcagaggggaatgggtgaatggtacccacatttcatgttgtatcgccaacccaccaatcagtgccaaatatttgccattgcacaccccatcagcctctagttaaatgtatctatttatcagtatattaacatattcaccacagtagcatggcatatgcataaaccactatgacttagaagaataaaattattctttggctagcccataaactctcagagttctttatacatcccaccgccttagcagccaaactccgggattattttataagaggagagaaaagaaaccaaattttatctgaaaaaaatcagattaataaatgtaaaggaagctgatattaaactttattttaaagatcacatatagccataacgagatataggcttgaacttggtgtaatcaaagaggcattaatttaaaggaactatggctaagggaaaaaaaaattctattgtttatatattttgttagtatctggagatacaaagatcaatgtagtaatcaatgacatagctgtgattccttacagctcacttatcaatatcataacacaaaagtatctacgtaattgggaagtttagctaagctttattgtagaaaaaggaaatacatactggaagtcattttggggtgttgttgttgttgttgttgttgttttgagacagagtttcactcactctttcacccagcctggagtgcagtggtgcagtcttggctcactgtagcctctgtctcccaggttcaagtgattctcctgcctcagcctcctgagtagctgggattacaggcgtgcaccacaacaccaagctaatttttgcatttttagtagagacagggtttcaccatgtgttggccaggctgatcttgaattcctgacctcaagtgatctgcctgccttggcctcccaaagtgctgggattacagctgtaaaccaccactcctggcctggaagtcattttgtttagcttatttatagaaactatttccaccatgcagtaatgacaacaatctaaggaaatgtcctaacaaccatattagcatagagtgatagataaaaagatattatttttattttctatatcattttcacattctccttcagttaactgaacatttagctgagcaatatatgtcatgtgtcatatattgcatgattaaaaccttttactctaaggaaacaggttttagtatcaccatatcgaacatgaaaatcattctaataccaaaatgtcaaccttgattttttaaaattccgtagtataatctgattaataggtgtcataaggaaatgactgaactattgggtacacaaaataatgttctaaaagttgtattttaaaacgatatatctacataaagtgtgacaatataattatttccagtttgattaaatgctataatcactatctcattactagaataatgaagaaaaaatatagaaatattatcacatgatccatacgagaattaaattaagtagacattacataaaccagaagattcttacgcaatttcaaagttgtcacaaataaattcaggtttgaaggacaataaagaagtaatgatgggaaggaaagcttgataattatagcatggttgctatttatttattcagtgtaaaggatcaaagaaggaattgtcttagtattctcctacttcactgaaacaaaacttttagttgacagtgaacacacgacaaaggaaatcaatttaacgacctttattgaagcagtactggatacaaggtattgtgctaggtcgttcagaacaacggtgaataatagctatactagtttgtcagtgcattcataacacagtatcactgattgatgtggcttaaacaacaaaaattcattttctcacatttctggaggctagaagtctgagattaaggtgttgaaagggtttgttttctctgaggtctctctccttgactgacagatggctatcttctccctgtgtcttcacagggtttccctcaatacatgtctgtatcctaattccctcttcttgcaaggacatcagttatattggattgaggctcatcctaatgacctcattttaacttaattacctctttaaagaccctatttacaaatacagtcacattctgagttacagggggttacgatgtcaatatataaatttgggtggagacataattcagcacataataaagcgttcttgccctccaagactttcaacataatagagaagaaaatatataaaaataactatcatagaaggcagaaagtgataaaagttatagtgcacagtcaaaattattaggatggtgcaaaagtagttgcagtttttgtcatcactttgatgacaaaaactgcaattaaatttgcatcaacctatataaaacatagaaaatgactggataattaagaaaggtttaatggagaaagtagttttctaggatgagatttcagcatattgagataaatataatgaaaaagataggaaacaacaaattaaaagaaaacactgtatagggctaatttttcatttaattataattcatttcaccatattgagataactgtagtggaaaggataggaacaaacatgattagaaaagagcactgtatagggctaatgtttcatttaattataatcaaactgtactctgattgacatggcatattttgtatttaagacaataaagatcatttgactgctgatagaaaagcagaaatagaaaatcatgttttcttcagttttcaatgtaaaatacaccacaggccaataaccagacaaataaaataattctccaccatcttccaacatatcatttgtatttatggacatttttcagaagaaataaaatagggagaaaattagaattgtaccaatcataagccagaagaagacatagataataaaagtccactagcgattggattgtccttttaggaaatctatctatcaaaaatctatgcttatagctctttgttcagagggtcagttcccaaatttatgtgctacaacagtattttaaattctttcctgtaataaaatgtcactgagattttttttaagtagaaatgtgatattttatcaccatggagtacaatgtaagtttagctgcctaactcattattcttagtcctgcttgaaaagtaaatcatatttctgacaatgacaacgaaatctcaattttgattacttctgttttaaaagagcataggataatagtaaggaacctatacaaaataccattttaatatttatagaggggaaaatactgaatttttatggaattataataaatatatacttccttatgacttcttacacgtgggtcactggcagataaacttaatatttacttactacctaaaacatatgacaattcaatggtgctcagccaggttatattaacagtgtggcaaaagtaaaggattttccttttgttcatacaacttatccaatggcacattcaagtttttctcctctactattatggcaataatttaggttcatgtcagcaaatgtttgaaagacatataaatcccacatttcgtatcacttgttagtgtctaattaagcagaaaattttgagttcagtgaattacaaaatgaaatttaaaacacatcagattttacattaggtaataaagatcttggcacgtaaacctttagcactgtgggaaatgagcttcatcttttacattggtgaaaggtgcagagtgatcattctgtgcaattacacagctagaagaagccttgatttggaaacagtgctataccaaggagaaaatcacgttgcatagttgtgcttaatttttgcagtctaactagaatagttatgctacatacatacatctggctttgctctaaagcctatgttgggcatctctgaaacataaacagagtaaattttgcccttgatcactttggacgttactcctgtaaaaatcatatacaagtttatttgagtaaaacagatttaattaaacaaatgtttattaggcatctgcggtataccatatattgtgtaaagcactgcaatgaagtaaaacctaaccatctgtacaaatccacagttgtcggttcttctctttctttgacttcattttttactaatctgatgttttgcttgtttccccctacccattcccacatgtaaattttcttctagaatcctactaacttctggtgggagaggaaagagcctcatttgccaccaaaaccatatataatctaggtcaaaaggatttttatattgccttattaaatcatgcaaaattatccagctgtgtttgcatggacagccaaagaggaagggacttcagcttttgttcattatttgatttaacagctgaataagtaacaaataaaaaactaggcttaacagtcaggtaaatatttttcctgatttagaaaggttccagatggaaaaacttagaattatgatctaaacatggcatccatattttgacattaaaaaagatacagaaattaatttgagaggaaaaacaatttttttttgacacagggtctccctatgtagctcaggctaaccttgaactcctgggacgacagggaaaatcaattttaatagagaacaataggctgaccagactagaggatatataaaactaatatcattgttatttattgtcttagagaatttgagcaattaaggaattctctgtgacagttaatattatgtgtgattatactagccaaataccttccaagtggagcaataaatgagaaaatatctatggaactcctagagatcttgggataaatggttccacacattaacagttgcatttccttttttttttttttttaacagagtatcactctgttgcccaggctggagtgcagtggcacgatctccgctcactgcaaaatctgcctcccggcttcaagcaattcacctgcctcagcctccggagtagctgggattacaggtgcccgccaccatgcctggctcatttttgtatttttagtagagatggggtttcaccatgttggccaggcttgtctcaaactcctgacatcatgatccacctgcctcggcctcccaaagtgctaggattacaggcgtgagccactgcacccggccaatagttgcatttcttaagaaaaaaagattttaaaagccacaaacaaaagtaaaaaacaaaactcacacatacactatttattataaatccataaaaaattcagctattcaaaccaaaaaaaattgatactagcaaattataaatttatttagtgaaatagtgatagtataaatatatatcatgctttaataaagtattttaattaatccagtcaccacacatgtttttgctaaatatgacagacagaagataataaaataataattggcttaccaccctagataagttttaattattccatggtagttttacatactttgaatatgatgttagcttaaaattcagtggttgaaaacaccttacagaattttaaataagtagattttctgatctagtttaagaagaaagggtcaagtcacaaggccaaggctgaatatctctaccttcatgaaatttcccatatagttaggtgaagagtatttatatgtaatttaggtatgaaacataaagtacataaatcactatcaagacagtgaatgcatatttgcaagtaaatattaaatcatggcatgggaatttaatgttgccatgtcaaattatttagatacacaaaaaggacgtatttttctttcctcccatgaccattttccacatacagtattacaactgtgcctgaaaactatgtttcacctacaactgaaagtctctgaagttgattaaattataaggttatgggggattgtagggtagttggtctggatgtcagtgaatattttaaaattaatatttataattaagacagattttatgaagtgtcaaatatatcattttttctggtttagaattttaatagttatattctactgttagcatgtggcagttactgccctaatgcgatgaaagcctgaaatctcaaagccactgattccctacaagaaaatctgacagagaaaacaagcatttgcaaaattatttataaatgaatgtaaagtgttaacttatttataaattcctggtaattacacattttacaaacttatgaagaaccagattgaaatttgattattatacatctgtaattactatagagatgaatgaaatctatcacagtgaacatggattatgttttgcatcttatttggattgtcatgtaagtctttataatgagctactaattgccaatatatgaaatagtgatcacaaattcaaataacaatgaagaatgatgaggtttcaaagactggatgtcacagaattactttgttgatagaaagatagccttggtgtctttcccaacagaacctattttaacacactgtaattatcaggtgagggcttgtttcccccattagactatagatctcttgtgaataagtccagtaggctttatccaccatttcatctctagagtgaatagtaattgctcaataagtatttgttgactgacacaataaatgattaacttgtcaacacgaaagtgttcactgggcacttggcttcaaaggcattcattccccccatactatcaagattgctataaagatggcagaacagaatatcatttaaatcttgttgtcatgcgcctgtgagaaacttttcagctttagctttgagttttcatatactcagagtaagaatattctattgcctgagggagattctgattattttgatgccctaaatctcctaatccaatagatggaaaatgtctgtcatgcagatttgcttatgaaggggcaaaggctttcatcaaaatctttagtactaaaaaagaaaaatagtaaaaacctgagaaaggtaacacaggggacatcaattatacatgtaataacaagtatgagaaaagttaagactcagtaagacttcaccgtaagattacattgtgattctatatgctctaatcttttatggatgcttgaaatatttcagaataaaagtatttttttaatctagctatcctttcctcacactcaccaacaaaactggaatgaaaaatgacataaaacttcagaaagtattattctattagagtctgaccctgggtgataaaggtttaggtatttttcattttcacaaagcattttttaaactgtattactgagattcacagtcaagtgaaagaatataggataatcacaattcttaggtgagtttcaggtactgatatgtgttggtctggcatgatctctctgttccccaggcacagactcatctatgtcacttggctttgcaccctgacatctacttctcctattcaatatgtattttttattataaatgtttaagaaaagtagagatcataaaatatagaaaataatctatctacctcaataataacatgcactttttttcccattggattttgctctaatttttaaaggataaagcattgtagataacactgaagtcctatatgaactcttcctcagtctcgtacctccctctctaaagttaatcactgttatgtatttgatacacatggcatttatgacatcctactgtccataaaacttgctcatccactcaatattactttgaaaatttctctttttaacatatgaaactagctcatttgtcttaactactgtgtttgctgctatttgctcatttccccattgatggaaaaaaaaaactctataatgatcatacttgtaccgggttttccttatgaatatgtgcacaagtttcttcaataaacctagagggggattcctggcaacataacccaggtgccacatattgttattttgttcttcactgagattgtaacaatttacattcccagaagtattgtatgagcatactcttttaagtatatcacatctaataattgaaattatcagattttttttacttttaatatctgatagtcatgcaccctagctcttaagataattcttcagttattttggttaactatatagtctattattgggacaggttgaacaaaagtgctccttaaagagatttatctttctcatactggtttaaattttaacactggcctgccaataatgttagtaataacagttatcttttactaggccactcaatatgtcctagacactattcaaaacatttaaaatatgtaatttattcaattcttccaattgtaaaagaatgtgagctctaaggatgcagagagttttgtctgttctactggttgttctatctttaaaacagtcctatcacctagtaggtgctcaccaaatatttgttaataaatgagtacatgaataaataaattatataattaacattttcaaagaggcatttagggagtctgagtggttatttcccaaagagcatagatttttgtaggaaatgacagaattatctatcttcaagcatacataactccctccaaaaacagatttttttttttaagatggagtcttgctctgtcacccaggctggagtgcagtggtgtgatctcagctcactgtaacctctgcctcccgggttcaagcaattctgctgcctcagcctccctagtagctgggattacaggcacatgccaccatgcctggctaatttttgtgtttttagtagagacggggtttcaccatgttgaccaggctggtcttgaactcctgacattgtgatcctcctgcctcagcctctcaaagtgctaggattacaggagtgagccattgcgcctggcccagatttttctttttctatgttccacgtagtctctaaagagaaaattcactatcttcctgtcaaatctataagaattactttagcggtgaaattttagtaagaacgataggcagtttgtaagaacataattctttttcttttaaaattatttcttttttaattaacaaatattagttgtatatatttgtggtgtacaacatgatgttttgaaatatgtatatattatagaatggctaaatcaagcgaattaacatatacatcacctcacatacttaatcatttttttatagtgagaacatttacttgttctctcagcgattttcaaactgacaatatattgttattaactatagtcagcttgttgtataatagatctcttgaacttattcctcccatttaactgaaattttgtatcctttaaccaacatctccccagtcctctccctttaccagcagtccttggtaaccactattctactccctgcttctatgagttagactttttaggacaatgtaactcctagatgcattttaaaaacacgtagaacttgttcacagcacaggctctggagccattctccaagcaaaggtttttaccggtttgttaaaattccccaggatgctttctaagtccctaagtctattgcaacaacaactcgtaaaatcagatacatgattcctgttttcaaatttcctatctagacccacttggatagcaagattgatgctgttctcaccagcctaaagccccttcagctctagctgaaatctttgttctctcacaatgcccaggaacatgtcttgggctcattggtaggtaggaacgtgctgtgtggcaaggagaaaatttccctgtaatccttcatctaatctataaaatatcctaaaggattcaccatattaacgatttttcctcatccaatttatactgattataggtggttagagttgagatacacccctaaataactgaatacacataaaattgtgagacttcctttgactctctattgctttgttgaaagtctttgtcaatatatctggccattgaaaataatatggtttattaacaatgcacatacactcactgagacaattctaagcaaattgtttataaacagtatattttatcattcacagcctttgtcagtacatagcacatgcatctgaagtatttagaaactattatattgttatgcaagtctaaaatgcaaatccttagggctatttactttatcagtaagattattaatcattactctagctataccttaaagttatagcaaaaattttcaaatctgacttattaagacagtcaaaaaaggactcccagttatggcttttctaaagatctaagtcataatactcaaagaacagtcctgcagtctacttattgtttattcaaatgaaagcaccttaagtgaacttacctgttagtacatgaaatgatgtgtgataaattccagttgacatgcccaaactactcttcagtcatgtaagtacaggcagtaattcaaaacataattaccaataaagcaataatggattactttggggaagcctattcaatcatttctgaatacacactttctctctgtctttcaccatgacctacataaagccatgtgtacatttctcttcagtctccacaatgatccctgaacaatatactgtaacatgaaaatgtaatcacagatgactcaggggaaaaaaatcttacagctatgaaatcactgtctcttaattttagtcaatgttatagaagatcctggctgcaagtcatcactggcctgtcctgacaaggaagagcttcttttctcggtaaatggaaacctaggttattcggcttgagctaggatgcagttatcaaactggttctcaccttcctattgtaacatcttgaatgtgtcagtcatgtgctttcattttttggagatagaatggagaaaacgagggaacacctgttttatattggatttactttcatttctaagggccattaaggattatttagcactacatcacttacttctacaagaagttggcgtctggagatggtgttctaaaaactgataaagtatacaacgttactatttaaaatttcagatggcttactgtcttagcctgtttgtgttgctataaaggaatatccaaaactggataatctataaagaaaagaggtttatttggttcacaattctgcagactgtataagaagcatggcaccagcacctacttctggtgagggcttcaggctgcttccactcatggcagaaggtgatggggagccagcatgtagagattacttggtaagggaggaagcaaagggtgcggggtgccaggctctttcaaataacctgcccttgcaggaataaatagagtgagaattcactcattaccaagaggattgctccaagctgttcatgaaggatccacacccaaggcctaaacacctcccattaggcactgcattcaacactggggatccagtttcaacgtaatatttggaggggttgaatgtccaaaccacagcacttgccttttcctatggaagttcaggaccctatatgaagccatctgttgactttttaagctcagtaccaatcctgatgtagtctgtgcttcttttatactggccaacttgctgtccctcaaacccaccttgaattttcacagtttttccctctttatgggaggcttttccaattttctaaaggttcaattcaataatccagctgaacagctgtttctttaaaaatatttcctcagtatcctgacagtacagcagcattaattgtaaaagattttgtttacgtaacaaatacaattcttttgaaatctgattcatatacaccagattgtgagttctctcaaagcaaattctgtgtatttttcttcattgtattttctttcattccccagcatactgtcttgcacataatagatactcagtttaattttatcaaaatcattttttcaggaaatgattaacaatctccaatttaaaagatatatttgtattgaaccacttcatggcttgatgcttttaatcaaactaaattttgactaggtataggttgaagaataatgtataagtgcaatgtatggtaataggaaattggttataattatattgtataattaatatttgcatagatacatactatattggtcatcttttatcccaactcctattaaataaatatcatattgagatttaatagtgcttagttttgatgcagttaattttaacattttgctcttgctaacattattatgtgttttttggcatcagcttatgaaagaacatggaaaatcaatttattttccattttctttgtcaaatttagattaaaactttgtagaagccaaaggtcatgctcactatgatgtcatggacaaaaaggcctttgttattacattttgttcatttttctctttttttctttcaattttacttgacacataataagtgaaacatatttatggggtaccaagtgacagatacatgtatacagtgtgtgattataaattcagggtaattaaaacattcatcacctcaagtcattatcatttgtttaatgagaactttcaaaatcctctcttctagctttttgaacatatacaataaattattaactatattcaccctacagtgccatagaacactaaaacatattcttcttatctaactggaactttatatgcattgaccaacctccctctatcctccttctcccttactgttcccagcctgtaataaccagagttctactctttacttccatgagctcattgttttgctcctacatgtgagtgagaacatgcaatatttatctttccacgtctgacttattttacttaacataatgtcctccaggctcatccatgttaccaacgacaatatttcattttttaaatagctgaacaatattctgttgtgtatatatatatatattacattttctttatttattcatctgttaatggacatttaggttcattccataccctggctattgagaatagtgctgtaataaacatggcagtacagatatctctttgctatgctgacttcctttcctttggataaatacccagtagtggcactgctaaatcatatggtggctctgtttttagcattttgagaaacctcaatagtattttccataataaatagctgtactaattaacattcccactaacagtacataagaattccccttactccacatccttgttagcattttttttaaatcatttcctttcatttagattctgtggaagagtttcttgggtttgtttcttaaataactaataaaattatattagtgatgttgagcataataaattcttacaatctgatccaatctttgtccaattaagagtgtggtggtgcaggagcagctcttgttttttttttttgttttgttttgttttctgttttttttttttttaacaatttcgttgactctcagagtctaagacttcagggctgggacctttgtccagcctgcacggtagagtgaggctgcctctcccaccaggcattgggatcctatttagaaacggcgttcacttcagaaggtactttttaactgctcagtttttgactattttaaatagtttgctgaaaactcctgataacacttgcagctcttgtttttaaagttgctttcagtttgagtatggtcttaaagacttctgttgccacactcctggtgcaacagcttccctatatgagccacaattttggtacttgccacttttataatgtataaacttctgggactttgttatatataattttatactactttaactgtggctattttccttttttaaagctttcatatctgagtgagaagatatggtgtttgactttatttttctcttatttcacttaatgtcatccagttctatgcatgttacagtgaatgacaggatttaattatcctttatggctgactagtattccatgtgtatatataccacattttctttatcaattcaacctgttgttgaacacgtaggtttattccatatcttcgctcttatgaatagtgctgcaataaacatggggttgcagatatttctttaatacaatgatttcccttctttgggatagattcccagtagtgagattgctagatcatatggaagtcctatttgcagttttttgaggaacctccacactcttctccatagtggctatactagtttatattcccaccaacagtatataagagttccatttcttctgcatcaacaccagcgtttgttatttatttttgtctttttgataataggaattctgacttgtgtgagatgatacctcattgtggttttgatttgcatttccctgatgattagtgattttgagcatttttccatatatttattggctatttgtatgccttcctttgagaaacgatgtccagataaatcactcatttttaaattagattattgtttctgtgctgttgtttgagttcattatatatcatggatagtagtcccttaccagatgaatagtttttaaatatcttccctcattctataggctgtaacttaactctgttgactgtttcatttgctgtgtagaagctttgtagttttatatagtctgatttgtctatttttgtttttgtggtcttaaccataaagtctttgcctggatcagtgtcctgcaacatttcctttatctttttttactagttttatagtttcagtctgatatttaattctctaatccattttgagttgattttttaatgtagtgagagatggtcttctagtttcaatcttctgcatatgaatatccagttttcagagcaccatttgttgaagagggtgtcatttttttcaatgtatattcttgacatctttgttgaaaatgagttgactgtaaatatatagatgtatttctgggttctctatcttattccattggtctgtgtgtctgtttttatacccataccatgttgtttttgtttttgttactattactgtgtattatattttgaactatctatattatattttaactaactatattatattttgtactatcgccagttttacccttttggcttggtattgcattgggtatttggggtcatttgtggttccagacaattttaggatgtttttccatttctgtaaggaatgacagtgttattttgataaggattgcactgaatctgtagactgccttgggtgaaatggtcattttaacaatattaattctttcagtccaggagcatggaatgtttttcaatttctttttatcctcttctatttctttcatcagtgctttgtagttttcattgtagacatctttcaccttggttaaatttatttctaagtgtctttttttgtagctactgcaagtaggattgcatttttaaattctttttcacctagttcattactggtatataaaatactaattatttttgtatgttgattttttttatcctgaaattttaatgaattcatttgccagttttaagagtattttggcagagtcattacatttttctatttatgagaacatgttgtttgcaaagagggacaatttgacttcctcttttccaatgtggatggcaatttcttactttctttttcctaattgttatgtgctaggacttctagtactatgttgaataagagtagtgaaagtgagcatccttgtcttcttccagttcttagagaaaaagcttccagtatttcttcattcagtataatgttagccatgggtttgtcatatatggtctttattgtgttgaggtatattccctctatgcctaatttgttaagaattttttatcataaagggatgatgaattttattaaaagatttttctgtctattgagataatatgtttttaaaattttatattgttaatgtgatgcattacatttattgatttgcatatattgaactatccttgtatccttggaataaattctacttgattaggttcattatgtttttgacgtgctgttgggttctattttctagtatttggttgagggtgtttaaatctatcttcatcagacatattggcccatagttttctttttttgttgtgcccttgtctggttttattatcagggtaatgctagcttcacagaattaattaggaagaatttcttaatcctcaattttttggaatagtttgagaaaaaatggtgttagttatttaaaagtttgctagaattcattagtgaatccatctggtcttggacttttcttttttgagagactttttgttactgatttaatcttcttatttgttattggtctgtttgattctgttcatttttggttcaatcttggtattttatacttgtgtctaggaatgtatccatttcctttatgttttttaatttgttggtgtatagttgttcctaacagtctctaatgatcctctgtatttttgtggtgtcagttgtaatatctcattgttcatttctgatattatttatttaggtctttttcttaatctatataatagtttgttgatttggtttacttttcaaaaactaacttttttcatgaatcttttgtttgcttttttgcctctaatttgtttcattctgtgctgatctttattatttattttcctctattaactttgggtttggcgtgttcttgcttttctattttttgaggtgtatcactaggttatttgaaatctttttttttttatataggtgcttattcctttaaacttccctcttgtactattttttctgtgttccataggttttttggtatgtcttgtttctgttttcatttctttcaagaagtatttaaaatttccttcttaatttcttcattaactcatttgtcattcaggagaatgttgtttaatttttatgtatttttacagtttccagtgttcctcttgttattgatttctaattataatccactgaaacctgagaatacatggtataattgcatttttgaaaaaattatttagagttgttttgggcctaacatagggtctaccctagagaatgttccatctgctgatgagaagaatgtacattttgtagccattggaaaaaatgttctgtaaatgtctattaggttcatttggtataaaatgaagcttaagtacaatgtttctttgttgactttctgtatagattagctgtgcaatgctgagggtgaggagggtgaggtgttaaagttctcaactattattacattggtgtctctatctctctctttaactataataatatttgccctatatatctgagtgctctggtgttcggtggatatatattaacaattgttctttcctcttgctgaattgattttttaatcactatataatgacctctgtgtctttttatctttttatttttaataaaagtctattttgtctgatataagtttgctacttttgcacactttttgtttgcatttgcagcaaatatcttgtttaatctgttctgttatagtctatgtgtgtttttaaatgagaagtgagtttcacaagcagcaaatagttgggtctcagttttttaattcagccagtttatatatttcaattagggaatttaaacggtttacatttaaggttgttattgataagatgaggatttattcttgtcattttgttagttgttttgtaattgctctgtatagccttagttcctttcttcttttattatttttgtggtttggtggttttctgtagtgataaaattttattcctttctttttctcatttgcatatctgctttaccagtgaattgtatactttcatgtttttccttaattgataggtaacatctaccaatgatatagacacatatctgcttttgcttaattgatagataacatcctttcgctttcagaggttggagtcccttaagcatttcttgtaggttcagtttaacagtgattaattccctcagtctttgtatgtctgggaaaattttatgtctccttcatttctaaagaatagctttatggtttatagtattcttagttgaaagttttttcttttttttattccagcaatctgaatatatcatcctatcctctcctagcttgtaagtttcttctgagaaatctgctgttagtcggacaaagataccctcatatgtgacttgatgctttcttttggtgtttttagaattccctttttgtctttactttgacaatttgactatcatgtgcctcatagaagacctttttggatttaatcgatttgggaacatttgagctccctatatctagatgattatctcccaagagttggaaacttttcagctattgtttcattaaataagtggcctatttattttctcactgcttttccttctggaatttctaaaacaggaatagactatttgtttgcatagtgatatcccatatgtcatgtaaacttttttcatttttattcttttttctctttttgcctaattcgcttatttcaaaagatctgtcttcaagatcacaaattatttcttttgctttatctagtctattgttaaacttgagtagggtgctttggctttgtttctgggagaatgcagtactgtagtcaccatatgatttcttcagcattagtccaatcagtagtatctatggcttcacagtgtcttatgctctagttgttcctgaaagctgtgatgtgactttactggagatggggcctccaggcaagcagtccttggatccctggggagtgcacacgcacctctggtggtacacattgcatggaccagttctcaggatcctgggtggtacacaaaggtacatagtggccctgttattgctgggccaagtttgctgggttgtgatggtggcacatcccagacagggcagtccttaagccctaagtggcacgtttggggatcagtgttcatggcagtaggtcacaagcaagctggtcctcaggcccctgggcattgtgtgcaggcacatgatggcccaattgctgcagggaacaaggtcactgtcatcagggaaggtggctctcaggctcttggaagcatgtgctttggatttctatgtcctggggagagcctccctgacgtgcaggactgcctattccctgggatttaggtctctgtgtgggctcaggtaacagagaccctgtggcaccattaggttcagctggtaatgtaacactgcaaccttctgggatggtgtcgggggatgtaggctgtgcacctgtgatgtggagatgcagcagcaattaggccccagggcaggatgtagtctggtgtgacacttgttagtgcatttttgatggcattgaaagttaccttggtgttactaagccaaggtcaaagaacattgtgatgattaatgctgaaagttattttttcataatttgaagattttttaaaatattaatcctggggccaaacacattaaaggaattaagaagaaataaatctggaaaattaatgtagacacagaatttaaaatgggaataaatacttttacacattcagcaaatacctattaagagacttcaggcaaaactatggaagtaagaggtcctattaagattctacagcaacttagggaaaagaaagttacttgaactggcgtagtagcagtgaatatgggggaaaagtgaacatatttaagaaaaatttaaaatatagaataaaacacatcttcaactatccttcaatactacagttcactaaaggtcaatgtgatattataatcagaacactccacaataagggaataacattgctaattctaatttagaagtggtcaatctctttttcagaaaatccaaaaaccattgtcaatcgcttccaccaatcctcatttgatctccaccaccacagttcttttgcaagtaatctcttccactaccttttactcattgttcaatttccagtacctttcatgggatttagcactcataattatggaatattaaataaataaacgaaggaataaataaaagaaaggttgtatttttacaaacccttatatttaatcagttcttagtaattgttgaatagttcttatggtccaaatcattcatcccttctatcaaagtttgtagctcatgatgagtcagtttatgcaaactgacctctgaaaatatatgtttaactatcatgagacatttgttgatggtatgaataatttttaaatgatcattgaaaaactttcagttttaaatatataactgcaatggataaacagaagacatttgtcattagagatacccttatttcaagaatctttagtcaatattggaccattgaatcatactaaaacataattataagcaaatattttaccacatgtgatcttcctctgtggtaataacaaaaaaatagtttaaagtctaagagtcctttaccattgattttaaatttttatttgtatttacattttaatgtagagagagctgatattctgagaattcacacgttttcacaaatgattcagaagaaaatggaaatctgttttggacccttattccctatatctatctatctatctatctatctatctatctatctatatggaaaatagtctctccctctctgtctctctctctctctctatatatatatatagtattagtattgactcctgaaagaaagcccatgagaggttaaatgcttataaaaaatttgaaagtaaaattttccctaagtaattcacaacacagatacgctaagaactaacttgtcaattgatctacctgacaaaagaggaaccagaagtctctgaatacaaaacaacatatcactctaaaagatcattgtattagtccattctcatgctgctctaaagaacttcccaagactgggtcatttataaagaaaagaggtttaattgactcacagttccacatggctagggaggcctcaggaaacttacaatcatggtggaaggggaagcaaacacatcctttttcacatcatggcaggaaggagaatgagagcccagtgaaggaagaagcctttataaaaccatcagatctcgtgagaattaacctcactatcacaagaacaggatgggggaaaccacccctgtgattcaattatctctacggggtccctcccacaacaacatgtgggaattatgggaactataattcaagatgagattttggtggggacatagccaagccatatcaatcattcttcacaagtaccagataagttatttgctattaaacacatctgtaacttttctaagaaaatctgtcccctacagaagatgcaagattgtgccaattctcatcacagctattcaaactatgattaattatctggaaaaaaaaaaaaaaaaggtaacccatctattcattggttttattttggacctacagcatctaggctggtacaaaaaagatctagagggccagctagattctttctcttttgtttgactgggaaaattctgagagaagatgccataatctgtgggagcagatgttgaaaaattatgatgttacaaaaagatcactggtaaagaatcatggctaaactaatataagataagcttatgaaggcacagaaacttgagagagcagtggaaaccactcagtattttaggcaaacatgtctgcttgactgtttaatggccatttctctttttttactaacaaatctctgattttgtttgtgtagtaagtgactagtaataaaggttaaattgtggctggtctaagcctagtgttcaattagaacctgtttattccagctcacaagagccgattctatgcatttcgtaccaactcagagttcagtgacatcacattggtagcttaaaacctgcaaaggtgggggtatttatgccacagaaataaacaaatgctacaaattaggactaccactccctctggcttctagtcagttgttaatcacttatcagcaccctctaaactcatcttggaaatctaattttcttttgccggtaattggctcaagattgagagaggaaccaagttttgacctatgacaagtaagagaaactgatgaaaatcatctgggaaagactttcttctctaaagttaaagctgcaagccagcttctttttccgttttaaattgtgttgtgtaatgtttggagatgcaatgctttaagatgcaaccaagagggaacatgaacagaattcagagatgcttacacattaataaccttgaactgggccgggcaaggtggctcacacctataatcccagcactttgagaggtcaaggcgggtggatcacaaggtcaggagttcgagaccagtctggccaatacagtgaaactccatctctactaaaaatcaaaaaaattagccaggtgtggtggcacatgcctgtaatcccagctacttgggaggctgaggcaggagaattgcttgaatccgggaggtggagttgcagtgagccaagattgcgccactgcactcaagcctgggtgacacagagagactctgtctcaaaataaataaataaataaataaaataaccttgaactgtcagaggcatgtgaatcagaacaactccatcttgaataggagcttggtaaaatgattttgaaacctactgggctgcattcctagacagttaatgcattctaagtcacaggatgagataggaggtcggcacaagatataggtcataaagaccttgctgataaaataggtttgcagtaaagaagccggctaaatcctaccaaaaccaagatggccacaagagtgacctctgctcatcctcactactacactgccatcagccccatgacaatttacaaatgccatggcaacatcaggaagttaccctatatggtctaaaagggggaggcatgaataatccaccccttgtttagcatatcaccaagaaataaccataaaaatgggcaaccagcagttctcagggctgctctgttaatgaagtacccattctttcatttctttactttctcaataaacttgctttcactttgcattgcagacttacccccaattttttcttgcacaagatccaagaaccctctcttggggtctagaatgggacccctttcctgtaacagaaatattaccaaccagggcaaccaaaatgcagaaaatcatgagcagtccaccatgggcatagaaaataatgtgcgttttctgtacagaatttaaaaataataattaaacatattaaccatcagtctactttttattatcctcctgtacggacaattctaaataatgttagccatgaaaatatccctctccacatagcttaactgctcctacccaagtcctccgtttgctagggctagtaaccctaaagccaagtatatcaaacatctaggtatatgagataaggaagggtttttgttatttaagtaacctttacatgagttttctgtttcttgtttatgttttgaactgcttaagttgtccatgaaaagaagcagatccagaatatcggtatatcaggttaatctagcactaaagggaaaaactattaattcctgctttaaggacctacaatatccctggatcccaggcctcccccagctctaatcatgcaaagattggtaaattatggttccccttgttgcatgtccagagtattctccctatgtgctgtcagtattactatgctaaactacctctacattgatgaatgtaagtaggttcctttgccttttaaccaaaagaaccgagaaacagaacctactattcaacagtcaaattacaaaaggcttttccaatataaggtgttgactgaatttactttgtgaagtctatatgaaggagatagcaaatagacaaaaatatgcttaatgttgttcataataattaaaattactgtttaaatgttaccaaaagagcacataaatgaataagttcttgaataatatacaatcatgcagaaatatgcagccaaatatgtgtaaaaaggcaagtaacataaatatgcatatatacatgcatgatacacatttgaaaatataaatatatattagaaaaatggtgaaaggaaaaaaaatcagttagcagtgattattattcctgagtagtggaatcaaaggccattaattttttttcccatacattttctatatttccaaagattttgattctataaaaataaagtagtttaaaaatatgtaattagcatacatttcattttcactaatgtatcatgaaaatatagttggtttctggaataatttttcattatgagaatgtatacatacatgaaagtaatgaagtcaataggttagactggaacaaatcaggtaactttaaaaaatgaagttggatattcatgagaatttgcattttataagaaagaatattatcacattccaagaaaatccttctcttacaaaaaaggaaaaatgtatatataatttattttagacagaggattactttttgagagaataaaaaagacgaaaatgtgttcacttctttgttcttacaacacaaacaaaacttgaattatgcttctgaggatattgatttatgagtatcttcacaatcctgtgggatattattctaatttgtgatgagataataatctgggcttcacatggaatctcaaccttgtctgttgtagttagatatttagacttgtttgtttaattctttagattagcactgtcaaatacatataatggttgttgaattatcatattgcatctgtgaaaggaaaataaatcttggagccccaaaattactaagccaaagggaaaagtcaagctgggaactgcttaggacaaacctgcctcccattctattcaaagtcatctctctgctcagtgagataaatgcatatctgattgcctcctttggaaaagctaatcagaaactcaaaagattgcaaccatttgtctcttatctacctatgacctggaagcccccttcccatttctacttgtcccacttttgcttcaatttgttccacatttctagactgaacctttgttcatcttacatatgttgattgatgtctcatgtctccctaaaatgtataaaactaagctgtgctctgatcaccttgggcacatgtcatcaggaacttctgaggctgagtcatgggtgcgtgtcctgaactttggcaaaataaacttcccaaattgactgagatctgtctcagattttgtggttcacacatttcaaatcgatgatgttttctcactaatatgtttttttccatgaggggagaaaaatttggttggaaaagaagcgcagggaaatcaggatttatttgaaaatctaggaaaaacctaagattctaggtattattttctaatatgttttggccatgaataggagtttcttttatagactcagtgtaaattgttaaatttaaaaagattacaagaggtcaggctcataatcccagagtagaccatggatgacacaactgctgctaatacatagcaacatattgcatccaaaaatacaatcaattaaatgtttactggattaaataaaattaatcttatttagtattattcttttttttttttttttttttttttgagatagagtctagctctgttgcccaggctggagtgtagtgacatgatctcagctcactgcaacctctgcctcctgggttcaagcaattctcctgcctcagcctcctgagtagctgggattacagacgtgagccatgacacccagctaatttttgtatttttagtagagcgggggtttcatcatgttggccaggctggtatcgaatccctgacctcaagtaatccacctgcctcggcttcccaaagtgttggcattacaggcatgagccaccatgcctgtcccagtattattctattttataaaattgacaagagaaaataaacaaattaaaagaataaaaacataccagatacagcaaggaagtcatcaatgcttgtaatgtcatctacggcttcagtgaggacatgtatatgattctcccatgtacgcttgtacatttccatggtgtttttgaccgcttgacttttgggtcttgcagccaaagcaagtgcagcattaataatctataaagataaggattgaaaaaattacctattggttgcaatgttcactatttgggtgatgggcacactaaaagcccacacttcaccactatgcaatatattcatgtaagaaatctgcacttataattcctaaatatataaaataaataaaaaatattaaaacaataaaataaaattaattaaattatactcattcatgttaaacataaaaaatggaatttaaaaaaatctgtaaagatgtagaacatttactcagtgatttatttcaatacattaagtgtattaaaattagattatttaaattaaattatggttaaatacattcatcatcgacaataggaaaaacagtaaaatgtctccatatatacagtttatattgaaaagtacaaaacgttttatatttattagtataaattatataggtataaataataatttttatttttaaaattttcctactccctctattattgcagagtgagttttttaaatataaactttgttaccataagctccatcaagttcaagacacttttctaagtgatgatatcaggcatttaatcaatccttaactgatgattctggtaatttaaacatgccaatccagtcttttttacattattaactggtgagaaatggatgcctttaacagatttttttttcaaattagtaaacaaaaagaaatcagaaagaaccaaattaggactgtaagttgaatgcccagtgatttcccatggatattcctgaaacattgcccttgtttcaggagagaaatgagcagaagcactgtaatggtgaagaaggacattctgttgacacattcttgggcatatttctgttaaagttttggttaattttgtcaaaccactctcaaagtaagcagatgttatcattctttggccctccaggaagtcattaagtaaaatgcctttagcatatcaaaaaactgttgccataacccttgttcttgactggtctgtttttgctttgactggatcacttccaactctcagtagccattgctttgattgtgatgtcttcagaattgtacttgtaaagccgtgtttcatctcctgttacaattcttcaaagaagcaattcaggatcttggtcccacttatttaaaaattccatcgaaagctctgctgttgtctgcagctgatctgggcaaaatggtttggatactcattgagtggaatgttttttcaactttaattttttagtcagaattgtgtaaactgaaccaattaagatgtctatggtgttggctattgcttgtgctattaatcattggtttccttcaattagagcatgaataatataatatttttttaatcacaaatggatgtggatgggctgcttctgtgagcttcatcttcaacatcatctcatctcttgttaaaataagttatcagtttgtaaactgaagatttatttggggcattgtctctatgaatattttttaaagcatcagtgatttcatcattcttccactcaaactttgccataaatatgatgtttgttcttcaattttagcagagtttatgttgcctttcataggggtttgatatagtttggctgtatttccactcaaatctcatcttgaattgtagttctcataattcccatatgtcatgggagggacctggtgggaggtacttaaatcatgaggacggttacctccatgctgttcttatgatagttgagttctcacgagatctgatagtttcataaggggattttccccttttgctcagcacttctctttcctgccgctacgtaaagaaggacatgtttgcatccccttctgccatggttgtgagttttctgaggcatccccagccctgtggagctgtgggtcaattaaacctctttcctttatggattacccagtctcagttctgtctttattagcagcattagaacagactaatatagggctcttttcaaactgatgtctctgatttttaacccgtcaaactagatcctgtccacgcacgttatcacaagttagcacaagtttatttttgtgcaaaaatgttgaattctatgcataattttttcataaaacacattttcagtaaaggttttgaagacctctcatacaatgacaacaataaaaagaagctttttctactgaatatcctaaagactgtaccttaagtcacttcctgtcaccacattattggaggtagaagacggaaaaaattagttgcctgagaataatatatttaaatcctctttttttgtttcttttctacaaaagaggaacatattaaattttaaggaaacacactaactttagaaataactactgtgcagtatgccttgacttcagttttagagttttattaacctattaacttacaatgtaccttcgtgtatactgcagtggctctggtccctggtgtttcattgttcttgcaattggacagctacgtacacatgtggttgtactgaaattatgccttcacagcaaagtatacttttaaagtactggtgtaaaaccctcagtggagatatgaagttatgaatataagacaggctacattttataagaatattttcagttctgctgctgatccaatttatctgattcaacactgcacactatgaagaagctttatcctacttgactcttgtgatatttagcttaaatctaaaagaagacacaattcagaagaattcttctaaccctctttagggcagaaaaatgttcatcccaatgtcacactcctagaattttagccatatatctagagaaaataaaataaccattcttaaatcttcttcacgtaaaactaaagcttttttttaaaatgaattatgttgctttctgaggcattttgtttctttaaattatggttgaaatatttacatgtcggtcacttgaccctgataattatctagtctgtcagtttacctttgaaacagtctcttttgagttcgggccttattatatcttaactgggccattctagtagccttgtaggtttctacttccagtctctatttgctcttagacattctccttaatgcaaacacatttctttctcaaatgccgaagtgatcatgccccccacttgctgataacctttgataaaatcctagttgactaaaaacaaacaccatatttcttttcagtaattcatagtctaaaaccgtccccaggttggtccttacctacagttcattctgctgtaataatcttactcattttagtctttgttccagccacagttttaagctccatttccttatcacaccactcatctttgtacctctgtgactgtttttagagctgaatctgccttaatgcccttgctccatccctttttctgctctactccgtctcaggaaacatttttcatacttaacatatccatggaaatatcaccacatactgtgaagcctgtttaaaaaatattttgtccatataaataaatagtagttattctattgcatgattgctcgtacacatgtctattcctgggtaatgagctccattataggagggactatgtattattcatctttgcttcttggtatactaaacatgttaattaccataaatgctatacttacaaactgtccctaagagaaactattctgctcgcagcccacactgagaggacagccacaggagggcaggtttggtattattttctcccacttcaacactatttaggtcataggcaggtacccaattcaagaagagttaatctgttggctggctggtgatggttatgaggtttgacataaaaagttgtgttgtgttaatcaatcttgaaaatttgaactagaatttatggagaaatcattagttagcagtcaagatcaaagctgaaagtttctgtaaagagcagccatcttataaaatcagaaccagagggggccaatggaactgaggctacaaggaaactagagccaaagtgcaaggaagaagaaactgtaaatagactgaacctataatgtttaaaaagaaaaaaaaataggccaggtgcggtggctcacgcctgtaatcccaggactttgggaggctaaggcaggcggatctcctgaggtcaggagtgcgagaccagactgaccaatatggagaaacctcctctccactgaaaatacaaaattagctgggcgtggtggtgcatgcctgtaatcccagctacttgggaggctgaggcaggagaattgcttgaaccagggaagcggaggttgtggtgagccgagatcgcaccattgtactccagcctgggcaataagagcaaaactccatttcaaataaaaaaaagaaaagaaaagaaagaaagaaagacaaaaataaacaggcaaaagcaaagtgtggagtaaaataagccagtgggtggcaagaggagaatggggaaaatatatcaagagagtcaataacatcaacagagagaaaatgatactcagataaaagaaaaaaaaagaactaggagttgactgtttttgagagtatcctattttggattacaaggccacagaaatgctaataacgataataataaaatactaacaaagtccatactttgcatcatgcaccactgttccaaacactttctacatattcacctaatttttttaacctaatttttacaccacaatgaggtaggtaggtgttgtcatctccattttcaggtaaggttaccaagttattaaggagaagttgtcaacttgacctagacttcatgctcttaattgccacactgtactctcttctataacaatattatactaatttatgatgctgtgagtaagtgatgatccttgaaaccataaagccatcactgaaggaaacattacaatgcctggtgtaaagaaaaacaaaagagagagagtgtgtgtgtgtgcatgtgaaagagagagagaaagaatatatatataaaattcgctaagttaaccatttataaaactcagtggcattaagtacattcacatagctgtgcaactatccatctccagaactttttagcacatcaaactgaaattctgtactcattaaacaatagcttcccattcttccttccccctagtacctagtaagctctattatactttctacctcttttgttgactattctagatacttcgtataagtggaattatacaacatttgttcttttgtgtctggcttatttcccttaacataatattttcaaggtttattcaagttgtagtatgcatcagaatttcattacttttcaagattaaataatattctacagtatgtacatactatgttttgctcacccattcatctgtcagtggacattgggttgtttccatattttggctgttgtgaataatgctgttatgaccattgttgtacaaatgcctgctcaagtcttggcttgcaattatttggggtatatgcccagaaatggaattgctggattatatgacaatttttttaaaaaggggtctcactctgtcacctatgctggagtgtagcggctcaatctcagctcacagcaacttccacctctcaggctcaagcgatcctcccacctcagcctcccaagtagctgggaccacaaatgcgcaccaccacacccagataattttttgtatttttgatagagacaaggtttcgtcatgttgcccaggctggtctagaactcctgagctcaggtgatctactggcctcagcctcccaaagtgctgggattccaggcgtgagccactgtgcgaagactgacaattctaaatttaatttatgaaatggccacattgttttccacagaagttgcaccattttgtattcatatctgcaatgcccaagagttcctattttttcatatcctggccaaaacttattttctcttttgttttttcttttaatcccaaccatcctaatgggtgtgaagtggcatctcattgaggttatgtttgcatttccctaatgattaatgatgctgaacatcttttcatgtgcttattgacgaactgtttatcttctttggagaaatgtctattcaagtattttgcccatttttaaattgttttttcttgttgacttttaggagtcctttacatattctggttattaatctctgatcatatatatgatttgtaaatattttctcccactctttgggttgcctcttccctctcttgctaatgtcctctgatatacagaagttttaaattttgatgaagtccaatttttttttccattttttgtgcttttggtgtcatatgcacattgccaaatctgatgtcacgaagtgtcactctatgttttcttctaagagttctatatttttagtcactatgtttaagtctttgattcattttgagttaagttttgtatatggcacaaggtggggcaaacttcattcgttgccatgtacttgttttcccagcaccaattgttgaaaagactatcctttacccatagaattatctgggcagccttgtcaaaaatcatttgactgtaaatgcaagggtttatttctgggatatcttttctatgccatttatctatatgtctgtatcacactgatttgattattgcagtttgtaatgaattttgaaattagaaagtgtgaggcctccaaatttgttcttatttttcaagattattttggctactcaaggtcccttgagattccatatgaaattgaggatgtgtttttttctatatgtgcaaaatacattgttggtattttgatagggattacattgaactggtacattgctttggttagtattatcatcttcataatattaaattttataatccatgaacatatgatgtcttttctgttttttatgtcttctttaatttctttcagcaatattttgtagttttcagcaaaaactacaaaggaaaagacattcaggtaaaagtctttcacctctttcgttaagcttattcctaggcatttcatttcgtatgatgctattattaagtgaaattgttttctcaattcccttttcagattgttcattgttcgtatacaaagacacactgatttttgtgtgttgattttgtattctactgaattctgttattagttttaagatttgtgtgtgtataatcttcaggattttctaaatataagagtatgtcatcactgaacagtgataattttatttcttccttctcaatttggataccaccaaaaaaatatataagtttttttattcgtttaaagttggattttgtcaggcaagtaaaaagaaaggaattaattggattgattgaggttataggaggagtacacagaactccaaggaactgctgaaagcactcaccagcctccttttaaatggggcttctgttattccaaggacattccctgcccacgctcgctcataagggctgtgtttgatcctcatttctctttcctcatagaggcctgtccaaattagctcctgttagaccctgtgcattaggttgtctgacaccccagaccaaagccagtttagttagcttcagctggtcccattctatcttctttaggcttctccccatttttactggtatatatggccaagacctcaacatgcttcaggctaagcttcctcatatttttctattaaatcagatagacaacttttactacattctaaactcatttaccttgggaaacccttgaacatctaaactacgttcagaatatttaggattttcagactgtctcaagattttctttgtgtccctctaggtattagaagcttgtatttacaggcatctcatttgtacagacgccttctaagacccataagagactctagaaatgtgttcacattgtcatttattctagtaaaacctgccacaaatagttttgggatccagctaaggggaagttgagttgaggatacatttagtttgtgtttagtgggtaatttcaggtgttttacagtcacttccctatattttttaccaccttcatacttgtggtattgacatcggatcatgatagaaccaatagagactttgcctgtcctaattatatgtgctctcctttctgaaacaccccccaaacaaactatgctaaaacaaagactgaattatcttctcagtttctacatagaaagtgacattacaaaataacttgttgtcattttagaggtgatcaagagtgtgcagtgaaagacagaaaaaaagaaaagaaaaaagttttatgagggtgtatctgacacatcatttatacaaatgtattatttttctggattttgctatattttgatatttgacagcattttaaaattagtatctagttggtttttgttttctaaataaatattcactttttcttaaggccctcaaaactctgtatactttaggctccacacagcctggcctatcacaatcaatgtattatttatttattataatttttttgagacagagtttttgctcttatcaagcagactagaatgcaatggtgcgatcttggctcactgcaacctccacctcccagattcaagcaattctcctgcctcagcctcctgagtagctgagattacagatgtgtgccacagtgcccggctaattttgtttgtatttttagtagatatggggtttcaccatgttgggcaggctggtgttgaattcctgacctcaggtgatccacccgccttggcctcgcaaagtgttgggattacaggcgtgagccaccgagcccagccaaacagtgttttttttttgttttttttttttaataaaaaaacctatcttctgaaatgataaaatgaacacatattcaactgcaatatttttattctttacagagaaaaatgacttctttcccttcaccttccttttgatgtgacagtggttttcttcaaaaaagttattttgcttttactatatgtgtaaaaatggaagaatagtgtaggagttataaaaataacattactgaggacctgcaatgtgccgggcatgtttctaattacttgatttgtattgtttttcatcccctgagaaagatcttatcagtatctccaatgtgctgacaagacaatggaggcacaaagagatgaaataacttgcccaaaattatagaagaaactctagattggaagccaagaggctcaagttaaagtttcactttgctttaaactgattttatgcccataaaaaaagtcatattacctctccaggacctattttcacagaaatacatgtatgcatacactgaggtggggtgtggagacagggtttgaattagctcatgccttagaggttcttcagattttaacatttgatttaatgctgatgtatatacttctcttgaaagatttctaaaaacaattacttaaaaggtgaaaataaatctacgtaatttaatttttcccagagatagttcaatattggcattgatacaaataatcttaaaaattttacttaatataacaaaagcactttgtggattaaaaagatgatttatatgtagtatctataggtctgattacctcagtggcacggcaagtagagaaaattaaaataactagatatatgatgcctcgaatacatctaaggttgtatgtgaggtgaatttatgtaacaaccacttaaattggtaacatcatcataatttcagaattctagcaactggagtaatggcatcaaattcaatgctctaactctgttcatccttttctcagttgcttaaatgatgttctactactaccaaatatttctcactttctacgtagtttttccacatttctttattttgataactttttctattttacctgctctcatactatacttcatctatggcaaattacctttacacttcaaattacggcatgtaatacttcccaccatgaatctccatgtcagaactttatgttaaatgataaaagcatttcagagtaggggagggtgtggtgctgaggagacctaacctgccatggactccaggtttacaattaatgaaactgcattcaactttggcctcacaaccttttttgtaatcttcttactccatgaagggatgatccctgcatgatgggatcactcacacggaaacttctcacaagactctcatttgccttggataaacgtataagaaaccaagctatcctattctaggggttaaaagtattttttaagaggagaaggggacaaagtttatttctgggaggatagagctttctgtgaaagtatatgccagtataaattttcgtatctcataaaacatactgctgaagaggaaaagttcaacctaggactatttcggttatggaaaatgtaataagtgggaaaaataatgctcccgggaggtctgtaaaaggcaataattccacatgaaaatcaaaacatttattttactgtcttttacactaaatattaagattggacaaccttccaaattaaataagtaaaagaggaaaagaatataaaatgcattgcttgtgatgataaaacaaaatcaccaatacgtagggtttgtagactaataaaaatagaatttggagtgaggactcccattttaatccagctccagtacttagttttgtgtggttttagacaaattgcttactctctgagcctcaatttcctaatctgtaatgatcattaaaatgcttgttacaaaggttgttggtagaattaaattagattatggtttgttcgtttgtttgtttgtttttgtgagatggaggcttgctctgttgcccagactagagagcagtggtgcagccccaaaaattcaagcaatgctcctggctcagcctcctgagtagcttggatgacaggcacttgccaccatgcccaactaatttacaaatgattgcttctataaagataatttgaaaataaaatacaagaatgctttagggatttaaaagaatactatacacaaatatatatacacacagaatttacaattttgttgaactcaacaatcattttaatattccaatttttttaagtctgagttaaataaatataaataagaaaaattgaatctacacacaattttttagggttttcctgtaacataaaactaaaataagagaaaaattgccttaaaactatctgataccaataacacatattacagtttaaagtaataaaaatactttaactggcaatgatgaaaaaataaatataggcaacagagattttttgatccattataatttgctactcagagatttaataagtttagaatttggagtggaaaaaaattggtactatctcccaaatcatttcagttcaaatggagaaatttaaaatgaatttaatatttttgccaaatctcctttttttaaaggacttttatgtcagaaacatctacaaagtttctctttaatgtaccatccaatttcatatagacataaagtcaaaatgtaagctattcattaattgccaaagtgtgtttcatataataagaggttggcaaaagttaaaaagaaaaaacaaggcctggcgcagtggctcacacctgtaatcccagccttttaggaggctgagggaggtggatcacaaggtcaggagatcgagaccatcctggctaacatggtgaaaccccgtctctactaaaaatacaaaaaattagccgggcgtggtggtaggtgcctgaagtcccagctactggggaggctgaggcaggagaatggcatgaacctgggaggcggagcttgcagtgagctgagatcgcgccactgtactccagcctgggtgacagagcgagactccgtctcaaaaagaaaaaaaaaaaaaaggcatgtatttgaaatgcctgacagcttgggattagacatattctttgtagacttggattcagctttggttttagcactaagaagagttcacataacattaagaaatttaactttcttaattgtcaaatgatttttgctctgtgtctaccatttatctaagttagagagcataagacaggagaaactcagaaaatatttcactttaagtgttctaagggagaaaagtcacgcataaatattcaataaaggacaacacgtatatgaaatctatgtaagcaatgttttccctgagttgcaagggcatgttaagaaaatatgagtacaaggtacaaatagggtcgaaatagttagggttgacttctctttctcattcctctctcattgttcatgctcttgcatggtctccttctctctccttctgatgggttcctagaaattttattaatatccttgacctagtattttgacctccaagatactatgtccactgccacaaccccactctacacgatcattatctctcagtgacaactgaggtagctttagttctgttcctagccactctctacaaagtgatatttccaaattactaatttcacaaaattcctgcctcctcttttatcataggatcaaagtcaaagtacttaatttagcctaaggccctgaaatatttggcccctgtttatttctctagcattatttcctatcagcacccctcgatttccactcttctttgtctaggggcatttgtctatgcttttctttctgtagggatttacctcttgttaggtaactccaatttatccagcagggctcacctaaagcattattttctcacgaaaactttattaaatctaggtcagtttcctagattgtcacggttgagcatttatcacactacctcaaatatatcaaatctaggtcaggttcctggattgtcgtgggtatttatctcaatatctcaaactttatcaaatccaggtcaggttccatctagggtgagtattgatctcactatctcttctcattaacgagatgttcattagagtgatcatctgatgaatgactaatctctactttccattgttataaaaaagcagtgatcttaatgtctttatgttattttcccagggtacgtggaaagtgccaaatagaatccctcttcccatgtaaccagggctccagtctaaggctccttctactttgcaagcctactaatttattaaaggcttttcccaagtgatcaagtctatccctacagcgaactcttataccagtagctatggtgatgaaaatatgtctatatggtcaggtatggaggttcacgcctataatcctagtgctttgggaggtccaggtggaaaaatggcttgaggacaggagttcaagaccagcctgggcaacatagcaagaccccatccttacaaaagagttaaaaaattttttaatgtacgtatcattttattttatttataactctgcagtcacaaaaaatagggccactactaaagtgcatattcaacagcaaagtgttcatcaaatatccatattaagctattctaaagattattccaagtgaatcaccaggctttccttgttgatccatcctgtgctcaactctagtgagtctcgagttagcaaaaggtaaacattaaagtgtgatttcccccatggaactgttatgctcaaaaactgaccattttgctatttcttcagattttaattatattacttggttagctagaggtcagaacaggaaaataagaatgaattcaagctggaaaggccatttagaaatactgtagcaattttaccacacatttaaggtaagaaaagctctataatctatttaaattgacctgaaacaaagttctttattaccagtataggtggtagattaaaaatagagtataataaaaatagtcagatgctactattaaaagagaatattggattttcccaactaggataggattttataaaaatcatatatatatatatatatatatatatatatatgtatatatatgatttttatcatatgtatctataaatcatacatttatgtttatatatataaaagagaaataaaattccctgagaatagaataatgtctttcttaaattagaagctttgtctatagtttgggcaacccaatctttgtatctttttattttaatcagtcaaattggtaatatataaaattattcagtaaattatatcatttataataatttaataaattatagtatttactgaatagcaaagatcattgggagtgattagaaaacataaattaactatacgaacttcatgaattactatattaaaattaaattatttattttctaaagttatgaagtattaaagtttggaaagaacatattttccattctggaaatggaaaaaaaagcatgttttctcattaaataattacaaacatttccatttaaaatttactactctattggagaattcttcttggcctcaacagattgcaaaaattgctaatgtttatttcattctccaggacctggagtccttaattgctgatgcatattcactggcgcatgcaaagtactgcagtgatgcactacttattgtaataattacatattaaagaacctatggcctacattcagtcagactcactttgtgagtttacttcttaagggggaaaaaaaaaaccctgaattaccagttacaaaatgagttagttgatagacaaaaattacccaaggaaaacataatcaataatatacactggaaaagagctcctctttgttgagcacagatctgcaatttgtaatttaaagtgttatttattttgttcagggcaggttgagctgtaacatgccgtgtaagagataaatacggctatggttcttaattacagactttaattcaatgggctatgtatagaaccaggaataaggtactactgtttcctgggagttggactatgtaaattagattgagtagtaggacacaaagctatgaataagaaggaattatctccggggaaatataggtgacaaacctacaatggcttttagcatctggcaggttctatttgaagagctaatgtcattctatgtaatggattaggaagaactggatgcactccataatgcaggccaagcataatttccatgatgactgagtcttctaacatatcagacactatagctgccttcaattttctagtctcattttcaaccctgtggtgagggatggggagggagaagtctgtatttctccatagtcagctgaggctacagcagctgtgaaagcaggatttgagggataattaacatgtagaattcatagaatcatgaccagttgaatgtgagagataagaattatgaaggaatcaaggacagtctcaaatttatggcttgatgatttaattaatgattatttcagtgatgaaaataaagaacacaaaatatatggtttgggtgagcaaaattattagttgagttatagacatgatgaaattaaaatattgcagcaaatctatgttgagatacacagatatcagaaacaaaatctggggaagaaaaatagatttttagagtcattgacatagagagctatagattgttgttgaaacagggtgatggattcagtaccaggaggtgaaacgacatgagagagagagagagagagagagagacagagacagagagagacagagagagagaaattaaaaaaggtaatccttgtggctcacacctgtaaacccagcactttgggaggtcaaggtgggcagatcacctcaggtcaagagttcgagaccagcctggccaacatggcgaaactccatctatactaaaaatgcaaaaagtagctaggcatggtggtgtgcacctgtaatcccagctactcaggaagcagaggcaggggagtcgcttgaaccccggaggcagagattgcaatgagccgagatcacgccactgcactccagcctggtcaacagagcaagactctgtctcaaaaaaaaaaaaaaaaagtaattccagtattcatgaatgtagacaaataaagaaatgcatccaaaaggaaatgctcagagtagtaataatctcaacaagaagatcatggtcaataggatcaaatactgaagactagtcaaataagacaaagaaataggggttcctaaattttggtacttatgcagatactaatgcctttaacagagaagttaaaggtagaaaacctacaacagtagcctgaaagtaacatgatgagaaaaaaatggatgatagagtagattatttgtaattgaacctaagtttatttcataggtacttattcttcattgagcgttgcactaaattatacactgtagttctttgtacctctctctttctctctgtcaaactctctctcttctattatacaactgggtatataggaaggaattttatgtatcctaaaatgtttaaagtgacatttatgcggtgaaaataagcttcactcttctgggtcaactgtgaaatagcataaaaagtccgaggttaaattagaagcaaagcattttctgtcaaacacagtttttactgaaaaaaaaaaagacttacataaaatatataactatgggtggctcatttagttgtatatggcagaattttttctgtcctctttccaaataactcgagtggtttcttcagtttgacaaatagttataaaaacaagtttgcagcataaaagaaaaggtggcaatcagctcctgcacaaaaactgattattaacttaaacaagtcatagaaactaatggtcaggattgcaattacagtcacaaagaccagaccacatctttatgtcagagggcatagagttcactcacattcaaggttcaatatgtttgaatacaaacacaagatgggtgattacacagaacccagtccatgaggtgacttcattcattaaccttggaaaatcctccattgaaattagacttttcttagtttatcgatgtttatgtgagataaactcaaggcaaacttgtatgacctcaaccatttcccttgtcactcaaggaaagggaattatttatttattaaattataaatgtatttataataattataaataaattgttataattttatttttaatttatattttatattgttataaataaattataacaatgaaaacattcacaatgctttaagaatggagtcttagccaggtgcagtgctcacccctacagccttaatactttgggaagccaaggctggaggatcacttgagaccaggatttgagaccagcctgggcaatatagtgagacccccatccatatgaatttttttaaaaaacttctctgtgaagttactaaaatcagcaaaaatgggttaatattctcctcaaagcagaaaaaaaaagatctccatagttcccaggtttttctttaagaacttttactatattgaaaggataaaagatctgtcattcctcagagcatatcacaaagttatcttccaaaaacaccctccacaccatcactacatggcataacttccctatcatgaagtagtaaagaatcaatcatagatattttcttaacattggataacacactgtttctcagggactgtctgcttaagggttttctaagacactatggcctcattgcctgaaaacaaccagttcctcactggctactctttaataacacaattttttattttcctttttccctccctcttcatttaattgatgtgcacaggagagcagataagggtgatgttcggctagtgatcaaaaaaatatttttgtcataaaaatcaacagaagcctctattctagcattttcaggtggtggtttcagagtctttcgggtaattggttttcttggactcagcaaaggcagacttgctttttctggggaagatatatttccagaggttagtgcttgtaaatctgctgttaggtgctggtatatttagtgactttggatctatggaatttgaacttgagaagtccttcctgtggcaaatttaaaaatagagcagcgttgcaacaaacataaccaaaaagaaagtgcttgcctttctgacagttcagcttgagtgcttccagagcagatagatacgtgactctcctgaatcaggcatttgagactttactgacgaaccttttaaataattatcaaaaggtcacttacatatgctgttagatagactaaccattgaaagcatgagaaaaactgctgattttaagtagtctgttgataggaactgctgtggatttaaagaaaagataaatgtcttctgtcacaatactgtcttattgtaaacaaattctatcctagctagagattcactgaacagaaaaggagcatttttagagacagttaatgtatcaggtttaactgattttcataatggtgtttttaaaaaattttccctagctttattattttatgattttctaacttatcagtatcatttgttcacacattaccatctatcttacctaacctgtagaacttccgttcaagtaatatggtgtatgttaaatgactattgttgtcatcattgctgttattgtcataattatattactcatagagttgtttaaaaccttgttgttcaaagtgtcatctgctgactaatacgacattggaaatgagtctcaatcatcaaggtttattagccagctatagtgtacatccggaaaaataggagccacagacacttttgtttttccaaagaggctttatgtgggtatttataaatttccttgaagtgggagagggcaggtagaaagaggggcaggtgagcaggaaggcaaatggctacattcccatgagacttgggttagtgcccagtaaatctacatttacataagattaatgaatgtttgaagagaaaaagagagtaaaggaagaagaaattatgcagatgtctctgggtaggtggaggaatgagtcttgacattgttctgcacctgggaagataagctcatactggtctttatcagtgtgaaatccaacagactttagttttaagagctagacttacattgtagccctgaagttacaattggcattcccttgtttatatgagaggccagcaaaaattttacttttgaatgatctatagggacagtccttttagatgcttgaggccttttaccttcccatggggatctggctaaagaataatgttagtgacagctattcatttggaagagggtgtggcaggacaggcttcattctcctttttgcataagaagtttagggttcctgagattttaaattttttcctttacaaaaaacatcagcatcacctgggagcttgttagacatgcagaatctcaggttctaccccagacctactgaatcagagcctgcattatagaagaaccccaggttattcataggcacattaaatatttaaaagtactaccttaaagggataaaattacttaggtaaaatacctataatagtcctggtcaatgtttgttaaatgttgtcttccctccctaactcagaaaatggattaactcattttctgtctatcttagaaagctgaccttcttttgtttgttatcaccaaacattatcatcataaataacaataataagaagaggtattacatccttactgttataaacattgggaatataagtacaagctatgatccctgaaatagaatatataatctatttaggatggcaggacattttatagaaagtacttaaatatgaggtatctatgtagaaaaactaattctctgtctatgaaaaatagcatcccaacaaaatgactagatagctggaacagtctcacttgaaatacaggcaatttgttgtacatgaaattcactttggaagtttctagtttagacgagttaacttctcagaaagttagatggttatctgtgagatgagcagaaactgagggacagtacaggaggaccacttggccactgattgagagagacttgccacatgtatctgctatcttggacagaaaagaaacaaaacagtttctgtaatgagtcaaaaactgaaagctcttagcctggatgtcctgaagtgcagaaataaagttgagccgttttttcatgtaaactgccataaacgtgagcataaaaagcagtatctttaggtcccctcccctcccctcccttcccttcccttcctctttctcttcctttctccctttcttcctttcttcctttcttcctttctagtacagagccaggcacctagtttaaggttatcagaaatttgggagagccagggttgggtctaggtgagggctgacaaaagaaccgctgcattccaagttctagtccatgaattgataagcctgtatctaccttttacagagctttcaagactgtatgaaattagatgttattccctctcaggctttatcttttaaaagggatggtcttcatgtgtgaattcttccaactcattatattccttaactttacgtaagtcttttccatatccactataaaaaaagtcaaagtatagcaatcagatctacatggaatatttgcggaatctgataacctgctttgagtttttttctctcaaaaagaaaaaaacctgttaataataatcaactattttagcccatttgtctgcatcaatttggtgatttcaatggagaatctacagggatgctcaggtgcctccttattgttatcccctgttcaaatctcatcattgtataggtgtggcttcaattattttctcttaagccaacattgtatttataccaaaggaatctgacttgtttcatttctgctcagtcttccagagctctaaatacttcctcaaatttaattacatcaatttggcatctccctggtgttttcattctgcactttctcttctggatcatttgcaagaatattcgtgtattagaaactcaacaattttttttctgtcaagtaaagtcctgattagccttccattgcttcccttcatctgagctacttccatatatgattaaaatctttctcagtataagaagtaaagttcctatattgaatgcatttctcaccaattcctttactaatctattaaaggattttaatgtattgttaggtaaaatgttctacagaaatcatccaagcttttctctataatgcatgtttctttagatattgtatgatactaaaacttgaaagtggtctggtcttgacattctacaaagtcaaaatttattttttctaatagataaactcttagattgtgaaacatgcacttaccccaagagagaagtctcctcattcttccccttactactcagtggattctaactttacaacacgtaagagatttatactattaaatagctgttaaagactaatttaagaaacttccatatgtctgtaaagtgtttttgcaatgcgtatttaaaacttgaaatttgcataaactaaagagcttttgcacagcaaaagaaactaccatcagagtgaacaggcaacctacaaaatgggagaaaatttttgcaatctgcttatctgacaaagagctaatatccagaatccacaaagagctcaaacaaatttacaagaaaaaaacaaacaaccccatcaaaaaatgggcaaaggacatgaacagacacttctcaaaagaagacatttatgcagccaaaagacacatgaaaaaatgctcatcatcactggccatgagagaaatgcaaatcaaaaccacaatgagataccatctcacaccagttagaatggcaatcattaaaaaatcaggaaacaacaggtgctggagaggatgtggagaaataggaacacttttacactgttggtgggactgtaaactagttcaaccattgtggaagacagtgtggtgattcctcaggggtctagaactagaaataccatttgacccagccatcccattactgggtatatacccaaaggaatataaatcatgctgctgtaaagacgcatccacacatatgtttattgtggcactactcacaatagcaaagacttggaaccaacccaaatgtccaacaatgatagactggattaagaaaatgtggcacatatacaccatggaatacaatgcagccataaaaatgatgagttcatgtcctttgtatggacatggatgaagctggaaaccatcattctcagcaaactatcacaaggacaaaaaaccaaacaccgcatgttctcactcataggtgggaattgaacaatgagaacacttggacacaggaaggggaacatcacacatcagggcctgttgtggggttgggggaggggggagggatagcattaggagatatacctaatgtaaatgatgagttaatgggtgcagcacaccaacatggcacatgtatacatatgtaacaagcctgcacgttgtgcacatgtaccctagaacttaaagtataataaaaatatatacattaaaaaaataaaataaaacttgaaatttgcagactttaaaatagaaattctacttttagaaatgtattctaatgaaataactaaggtaaacattgaaatttagcttaaaaaggctacagtattttttaataaataaacaccatatagtaaattaccaaaatgtatatccactaagtaagttagagtgcagaattttgtttgtttgtttgttttttcttgctgtgctgcccaggctagagttcaatggcgcaatctcggctcactgcaatcaatccctgcctcccaggttcaagcaattctcctgtctcagcctcccgagtagctgggattacaggtctctgccactgagcccggctaatttttgtatttttagaagagacaggtttcaccatcttggccaggctggtctcaaactcctgacctcgtgatccacccacctcagcctcccaaagtgctgggattacaggcgtgagctactgcacccgcccagaatgcaggtttttaataaaatgctatgcagccatgaaaaattacattaaacaatatttaataacatggaaaggggtttaagttattttaagtgaagaaaaaaataaattaaaaatatatgtgatacattttatagagacaactacctacacagaagaagctgaaaggttatacaccaaatattattcatcatgatttctggtagagaaattacaagaaatttctactttaaaatttttgtattttttaatgaattacatttctaaagatagtagaaaaaatgaagctctcttagagctgattcaaaatctttcctattagaacctctgttcatctctgaatcttatttcaattataaggaaagctgtgaatagcttgtaacaacatccaattcaccattgtgagttaattttttaaagtttcttctcccactgtatatggtgaaataggtgaatgtattaaaattgctaaattttgctttttctgaatttagctaatccttcttgagatgtgtgtgtgtgtatatatatatatatatatatatatatatatatatatatatatttgttcttcagcatttttctttattttattctatctccttttgagctaaatggatgacctatctgccagctccattagtaattttatttactgcttcagcctttgaaacaagttaatgcagaagattgaatagtattttagaatttacttcacacagtaatgtgactcaaggcttcattggctattatgtcccctttggcattaaatattttaatctgctaactatgacagatacaggatggccaatttcccagtaaatgtattagcctcctagtaaattaccctttcccaccttataccatgcagcctattaacctataaaatcccttctcttccaatataggcaagatgtcttaactgaagacttaatgttgaacacatcctaaagcttgagaagaccttatttcagagggttgggaaaggaaaactaatcattgcaagcaaactttaagttgctgagactacagatgtcactttggttcatttcctattaccatcgtttgatgaggatatagcccaaaaaccaagctagatgagtattttaataaatgtggactgagattgctttaacagaaaatataagaaatttctgtgtttttagtaatatatcctaggttcaaattaataaatctcttgattattctgtgccttaaacttgtatgaccatctagtcgtaccatttgagcaaataagttaccacctcaggaaaaatgaagtcagcactcaatttatatctataggataattgtgttttgttttgcttttatcttaagcccacactctagtaaacaaaagctatcagaagaaagctttgtaaaatattacagattgtgttgttaaataatactaagaactttcttgcatttcatggaaaagataatgcatattgtgtacttttcattattttaaatgtgtctaggaccaaataaaccaacggtgttctctgtccttctactggtttgggaaaagatttatgtaacaaaccattatcttctagttagaaatcatgaaagatgaggactgttgttcctgtaattaatcaccctatagtagaactctctcacagtgacttaacaaaatacacttatgtatgaatcttaaatatgcagaaggaatactaaagttgaacgggtaggatattttatcttcttttaagctttcatatggttaaataaaacaaaaattaaaagtctataaaacagaatgtatagctttacaaataattataaccaatacccaagttgtggaaaagaatattatcataaattacacacccttatatgctaatttttctttttaatgttaccgcataaacgtccctttctaaacagtataattttatttctttctgaaatttacaaaaacagcagctttatttcttgcttattttagtcaatactacacttgtgagattcatccagattgctatatgtacctataaatcatttattttgttgttccttttttcattatataaatataacacaaatccattctactgtcaaacatttggattgcttctaggaaattacaattaatgctgctattaatattttctcattcctatatgcatcagtgtcttcagattatgtgtctgggagtggaatggttgggtcacagagtgtattaacttttcatttcagaagacaatgctaaacatgtttctaaggtgtccatactgatgtagtctcccagcaacatatgagtatttttgatatttcacatcttcaccacttgatattgtcaatcttttaaattatagccattctggagagaatacagttgtgttttttattcggagttaccaataactaaagagattattctgttttctatatgttcattagatatttgggttttgtcatttgttattagtatatttaagtcacttgcccattcccaagtggttagcttctgtctttgtatattttgtatatctatatctacaaacatatacgtatgttttatctacataaaattatgtatgtacattatatattatatatttaaatataatatatttatcttctggatataaactcattgtcagttaagtattttgcaaatatatttttccatgtgaaggcttatactttcactctcttatggatgtattttgataaacacaggtccttagttttcatgcagtataattatctcctgtttatttttatgtttactactcttatttcctattaaaactttttcatatcccaagcttatgaagatattctacactatcttctaaaaacatatgtttttgctttcacttttaagttactaatccacatggaattggtttacatgaaagatatgagggagaactcaaatttcatttactttcacatgcatgtaattgtcacagcatcatttactgaaaagaatatattttccccacttttgtagcatcaaatcatcatcataataatcataataataaatgtatatttctgtatttttattccatttgtttatccttgattcagtacaacatggttggatcagtctgttttcatactggtataaataactgcccaagactgggtaatttataaaggaaagaggtttaattgactcactgtttagcatggttggggaagcctcgagaaacttacaaatatggtggaaggtgaaggggaagcaaggcaccttcttcacaaggcatcaggcggtagatgtgagtaagtgaaagcaggggaaatgccagatgcttataaaaccatcagatcttgtgaaatcactcactatcatgaggacagcatgggggaagccaccctcatgatacaattacctctacctggtcccactcttgacacgtggaaattatggggatcatggggattacaattcaacatgagattttgggtggggacacagccaaaccatagtcatggtcttaattactttatttttatcagatttgatatgtcccatggagtaattccttccatgttacactttgtttctgtcagagtagattatactgcaataacaaagaattttaaattgcagtgacttataacaacagagctttttgttttgtttttcttgctctctctagttgtccattttgggttgtctggagaatatacttgatttcttctaattctggagcccacactgattgaacagctactctcttgcacatattgctaattaccttagcagaaggaagtagatagagtgtggtgaattattaattggctcttaaatcttctagccaggagtcacaaatgtcactttcacatttcattaacaaaacacgtcacacgaccactcatcacctcaaccaagaggagaaaataaaatattggatagacagcactaatgattaacctaatcttttaaatgagtatataacttattcttgttcctttgatttttctttctttcttttttttttttttgagatagagtctgctctgttgcccaggctggagtccagtggcccattcttggctcactgcaagctccacctcccgggttgatgccattctcctgcctcagcctcccaagtagctgggactacaggcgcccgccaccacgcccagttaattttttgtatttttagtagagacggggtttcaccatgttagccaggatggtctcgatctcctgacctcgtaatccaccctcctcggcctcccaaagtgctgggattacaggcatgagccactgcacccagcctgatttttctatatgaaacttcttattaatttgtgaagttcataaataaatattttaaagattttggttggtattgcattaaatttataggtcagcctaaggttatttgcaagctttaaaatatttggtcttacaatccataaacatgaccatagttagattgagaaatacagatatagatttcggtcttcacacatgtttctttcaattatgatttttggttttctgcatacaggtcttgcataactttttgttacatcatttcttagtatctgatttttttttttttttaagatggagtttcactcttgttgctcaggctggagtgcaatggtgcaatcttggctcaccacaacctccacctcctaggttcaagtgattctcctgcctcagcctccccagtagttgggattacaggcatgtgccaccatgtccggctcccattttgtatttttagtagagatggggtttctccatgttggtcaggctggtctcaaactccgaacctcaggtgatccgtccacctcggcctcccaaagtgctgggattacaggtgtgagacaccgtgcctggctgtatttgatatttttgatattattgaatatattatattttataaaacttcattgcttatatcttttttctagtacatagaattgcaattgattttttaaaatactgacactgtatccagaaactggctaactcacttattaagtattataatttgtctttgcattgtattttctctacattaaattatttccaattcttcctctttctgttctttttctcatatttcatcctcaattagaatctctaggacaatagaaaagtgtgattgtaaacatctttattttatttccaattccaaaggaaagctttcaagtatcattattccattagatgttatagatttttttgtcagatgtcatttatcagctgtgaacattttccattgattcctaattggctaaaattctgattttgtcagatatttttctgcatgtattcaagtgatcatccaatattttagtattttgtaaattcatatgtttaattaaatcaattaaaaatcaattacaacaattgatttttgagtcttacagcaactttgcacttcctgaaaaatatgtatctttcttataatacatttttaaatgtttctagttggtcataacatattatccttttatatactattggatttttttgctaatatttattaaggatttttttgcattcatattcacgaagaatatttctctgtaatttttataatggaaaggttttgctattaaaattattctggcttaaaatatgacttgcctttctccatttttttttttttttttttttttgtttgagacggagtcttgctctgttgcccagcctggagcacagtggcgcaatctccgctcactgcaagctccggttcccgggttgacgccattctcctacctcagcctcccaagtaggtgggactacagtacaggcgcccgccaccacgcccagctaattttttgtattttttagtagagatagggtttcaccttgttagccaggatgctctccatctcctgacctcgtgatctgcccgcctctgtctccaccaaagtgctgggattacaggcgtgagccaccacgcccggccgcctttcttctttgaatgtctaattgaattaaccagtgaaatcatcaccactatgagattttttgtaataaccccttttctatttctgatattgattatcgtttttattattgatctgaatagttagaattttgtcagttttgttggtctcttcaaagtgagctgttccctttctcatctgttttctatttcattgatttctacttttgtcttcactgttttcttttacctgcttacttgctcacttactttcaccttgttaaggtgaaatcttaggactttagttttagattgttctccttttcttatataagcatttaaagctatgaatttgctgctaagcattaccttagcttttcctacaaattgtaatattttatattttccatgtcattcagtttgaaacattttctaattatcttgtaattttgttttaattcatgaattatttagaagtgtgctgtttaatttatagatattgggtgttttcttagatatctactttgatttctactttaattatgttgtggtcagagtgcacacctcgtatgattcttttttaatttattgagacttatttatggcctggcataggatctaatttggtttatgcactatgcacatgtgcaagaatgtatattttccagttgcatatactactctattatactaataagataaagacgtatctttaatgtcttcattgatttttgtctaaatgttctatttattgctgacgtagaggtgttaaatttactacaattatgaaattgtctatctcttaaattctatcaatttatgctccataaattgaggcctattatcaggcacatatacctttataaatgttatgtcttcctgatgaatgcctattttatcatgataaaatttttacaatctctcattatacacattgtcttgaagtctactttaactgataaactatcccctcaattctttttatgtttacagattccatgatatatcattttctttttacttaccttcagtctgtctttatagatctgtatctttatacttgaagtagcttagagtaaaatcttattttattttatccactttggcattctctatcctttaattggaatgcttaggcaagggatatgcaaaataggctcacaggccagccacctaatttagcaaaaatcgttttaaattggacacaaccgtgaccattcatttacatattttctatgactgctttcatgcaaaggtgattagctgagacagacaccatatggcctgcaagatgaaaatatttactctttggccctctaagagaaagtttgccaactgctagtttacatcattagcactcactgtaattactgatgtggataattttagatctaccgttttattattattttgttgttcctctattcccacttctttgttttctttttgattatttgaatatttttattatctcattgtaatttctgtctactggctgacttttttttaatctgttgattttctgcttataaatctctgatttttttttcagtttgttctagagattacaatatgcatatctaagctgtcatggtttactaagagttaatattgtattagttaatataaaacgtagaaatgctgctactttataaatccttttgccccattgaattttaggttatactttattgcttttatatacattgaaaaccccaccagataattattttttctttattaagtgaatttaaagagaaaaataactgttttctgcaattactctaatatttaccctttccaattgttctcaagacatgacggaaggtccagatatcactttggcatcattccctttcctttagccttttgttagccaatgttcggggcagatctggaaggtaataatttttctcaatttttattttacctcccttcctgaatgatatttttagtggatataaaattacggcttgacagttctattctttaaaatgttgtttccctgtcttctgaccttcattttttctgatgagacattctcatcagaaaaatcttattcaaatcactgcattcctgtaagtaatatacgtatcagtttcctctagctgttttgaaggtttttcttcatcttagagttttaggggtttatgatgtgtctatggttttctttggttatactgtttggggtttgctgagcttcttgatgctataaacttaagacttccatcaattcaaaaaaatttaagaccactgtttcctcaacttctgctccagtcactctcttgtttcttgtattgttacattagtaattccttttgatattgtcttataaattatcaaatttggaattacgtcttgtgtgtgtttgataaaatactttgtaacatgtggatcttgtaatactctgaagaatgttgatatttttattttagtaggcatttaactcaagttccgtttgtaagttctgttttaccttctgagaatgatagggattaaatttcagtttagctctcagtaggtttgatgtactgttttggagctgtccgtacatgcatagctcatggtgatcctgaaaattgtacaggttcattcacgggattagggaatcttttcttttccttttttttttttttttttttttctgagacagagtctcgctctgtcgcccaggctggagtgcagtggcgctgatcttggctcactgcaacctctgcctcctgggttcaagctgttctcctgcctcagccttccaagcagctgggattacaggcgtgtgccaccacgcccggctaattttttgtatttttaggagagacggggtttcatcgtgttagccacgacggtctccatctcctgacctcttgatccacccgccttggcctcccaaggtgctgggattataggcatgagccaccactcttggccgggattagggaatcttcttatcagactttctctatgctgggatttcccctcactctccagccttctggagcttttctttttggttctctagacagaaacatgagagttgtattggagttttagccaaagagaccattaccaccatctatatgatgctttacaactgggcccactttggggagcaatccacaggagagcatttcaaacacacacatgcacacaacaggaaaatcaaccctgtaaaattgcttctccaagtctgtactctcctccaaagttgacatgctttttctgcttttccaattaaagtcaggtagtcatttttgcattttgtcagcatattcagttctgatccatgagacatatggtctctagtgagcttacatcaccatgccaaaactaaaactgctattttctaatggttctagactccgatattttgtatttttttctagggattttgtatatgtgtttatttcagaggttggagtataatttttctttttgaaaggactctttaggtgcactaaaattttttatatatctctgaaaaattaaacctttatctttatgaagtgactatttctagcctcattatttttttccttgaagtctatcttctctgatattaatatagcttctctgggcacattttcctttttttccgtttagcctattttctttgatatttgttaaaaaaaattctgttcaaaaatctattttctctgatagttgataagtattttaaaaatatgctgagtgatttttttgcactaaaatcaattttctttgacattaatatgtttttatgcatgaagtctattttctctgatattggttatttattcatttattttgctgccttaaattctattttctctatactagcagtatactggtatttaatatgcttaatatttgcatggtatatattttgtaatccttttatcttgaaaattctttatcctcatgttttaaatatagtttttaagtagtatggtttttatcttttaaaaaatgagtctgacaaactttgctatatgactcattttttaatacatttatatttggtggaattactggcatggctgaattcaaatttaacatgttggcatacactttatactctatatttgtcctaccaaatatatgtttattttattttttgcttccttttggttgatcattgttattgttgtacattgttttccacagtaagtttggaaatgaagcatatctttttttttttcagtgattaccctagaagtgacaacatgaattattcaccaagatctaatgatgaacaatacttttctttttttttttttttttttttttttttgaggcggagtcttgctctgtcacccaggctggagtgcagtggcgcccatcttggctcactgcaacctctgcctcctgggttcacaccattctcctgcttcagcctcccgagtacctgggactacaggtgaccgccaccacacccggctaattttttgtatttttagtagagacagggtttcaccttgtgagccaggatggtgtcaatctcctgacctcgtgatccacctgcctcagcctcccaaagtgctgggattacaggcgtgagccactgcgcccggccatgatgaataatacttttactctccttttgaacaataaaaggtccttcaatcaattaatcctatgttttgccaagctgaattataggctatttttgtcatatattttattcaagttataatttaaatttggcaaaacattattattattttattgtgtcactgctcatttacctactttttgttactcctcatttttttcccacacagagtcatttttcttctgtctgaaaacacttcacaattttcctttgtgcttgtctcctggtggtgagttttcttattttctttctgaaactgttagtcctccatctggaagaatattttcttgagatatgtaaatataaattggaaattattttctttcaacagattgaatatattataaaacatagttcagcttcccattgtttttgttaataagtagttgccttttttcccctgaatacagatattttatctttgatttagctttatacagtatatcagtgatatgtcaaaatagggatacatttttatttatccaccttgaaatttttttagactctttaaatctattatctactatcagtgtggggtaaatcttagtcataatttttaaaaaaaataattctttttgcctaattctctctgttctccttctagagattccaatggcaaatatgccagaacttctcctatttttaatagctgttactctttcttttgcattccagtcctttgtatctttgcattttttttctggagaataccatgcagcctatttcccagtcctctgtttacctgtatataatattctatttagcccattcactgagttatcattttcagctatttttacccttctaggatttctatttggtccttttaaaaaatgtagtaaatgtagtatatcactttctataaattacagtttccatattttgtctttttatctcattaacagaataagtataggcttcttccttctttcttcattgtttccttcctgtcttcctcctttcttcatttttttcagtctctcactgacactgttaatatctggtgtccctgttcttctactttttggttattttttctctgctattttttgttcctatgaatttagttttactgcatacttggctctctgattatatgttggatattagttaaataacaattgtagaaataatttcagatctgggatgataattccatttaagggattttcatggtgttctgggcattattaacacatgactgtcttagtccaagttcagggtgtggaaattttcatgatttctcaaatgacttgaaaaggggttctagtcagcgtagtctggtttcattttgcttcacttttattcttacatgtagttcttcaaggtcccagccaaaaaacaaaacaaaacaaagttgtggtgatcttccctttggcagttccttgtttagacttttgcttcaaattcttgagatgttgccaaaagttctgttcatcctctcaactgcttcttccagaactgcaaatgccattagattaaggttgctaaatgttaaaaaaacagaatgcccagttacgtttacacttaagataaaccttaaataagtgtaagtatgagaatgtcccatgcaatatttgggacatacttaatacttaaaaataatcactgttacatgaaattcaagtgtaactgtgcattccgtattttatctggtacctcaggccaaaagtgaccaaaatgactggactacctcctgatttccattttaacctagatcttagcccaggcccgcttcactgttcggttagcattttgatgcttttaaggtgatattttaagcaatattttttccagctattttagttctcttcatgagaagtttagtccaaattacctagtccaccatcaacataatcaaaaggctaatattccattttcttggtggctttaacatcaaatataccaaaaattacatcaagaagcttaaagatagctccctgacactgaccctggaaataacttttggacagtacagcaaacaagagcacaaataaacaagtggaactatatcaaactaaatagcttctgcacagaaataaaaaagagcaataaaatgaaaatgcaacctatgaaagaaaaatatttgcaaactaggcatctgataaggggctaatatccaaaatatacaaggaattcacgtaactcacagcaaaaataaaaaacaaacaaaagcaaaagcataagcaaccaaatagacattttcccaaaaaggcataaaagtggccaccaggtgtatggaaaggtgctcaacgacactgataatcagggagatgcaaatcagaaccacaatgagatgatatctcacacctgtaaggatgaatattatacaaaaaatgaaagattataagtgttggcaagggtgagcagaaaagtgagcccttccacactgttaatgggaatggaaatcagtatagccattatggaaaagaatatggaagttcatcaaaaaattaaaaatagaactaccatatgatccggtaatccctcttttggtatatatccaaagaaattgaaatcagtatcgcgaagagatttctgtacccctatgtttattgcaactttattcacaacagccaagatatggaaacaacctatgtatctgtgaatgcatataaggaaattatgatatatgtgtacatatatcatatatatatacacacagtgaaatatttagccttaataaaggagcttctgctattttcaacaacatgaatgaacttggaggacattaagctgagtgaatgaagacatatacagaaagcaaaatactgcatgatccacttatatgtgaaatacaaaaatgtcaaatacatagaagccaaagagtagaaagctggttatcaggggcagaaaggtgggggaaatagaggaacattggtcaaagggtacaaagttgcagttatataagatgaataggtctagcgatctaactttcagcatgatgactataattaataatactcttttataccaaaaatttctgagagaatagatttcaggtgctcccagcaggaaaaccaatggtaactatctgaagagaaagatctgttaattcacttgactgtagtaatcaattcattatgtatatcaaaatatcatgctgtacaccttaaatatatacaattttattaaaaagtaaaaaagtgttagcatttaaaataatacaactgcaattttttttcattttcatagtcatatctttgtggctactaggtgcttattaagcattgctttcatgacttgctcaattcagaactaagcatctgaaagaacatacattctctattttttgttgaattgaacaacgtgctttatatgtgtgcatattgggaaaaggcacatatgctacaaaatggggaaaaacaatatccatcattatttctagcatatcaattttctataagttctctgaaatacaggtgacaccataaacaaggcccaataaagttgttgactaaatgactactataaataaatgaccattatcaatttcccatgtatcattcacacaggtgatgataatggtgtcatcattaactattccatacatgctctgatatgataacacaaaaattggtatataccatgttcagtctctggtcaaaaacattgtgaatatattaagcatgcttcagtgagggtttgttaaaatgatgacaaagacagaataatgagtgaattttaccatttccaagggaattttctgcaacggtaggatttttgtttctctcaatatcccatctgattgatcacaatgtctaagtgaagtaacagacaggacttcgtcatttctggctgctcacacataagtatactcccacaactggagttcctatatttatctccttacttggttttcagaattgttgagctcctccttttcctgattatgcatgaaatgttcttagtctttctttttcataagacactaagccttacaatattctgattatctgattctgattaaaaatattttttacatcacttttttcctgttaccaattttgagttggttttatatgtttcatttatttctggtgattaaattcttgtagaaatagtcattagatataacagttcactagtaattgagtctgtggaggtatttccagtatatatatttaaaataattatgaccttcaaggacaatcatactccttacccttgaaaatgacatggtcagtgatactggaatgccagagaactgtgaatagaaggtgtaaaatgagagaataagcactggggaaaactgggatatggataagcacatgccatcatttggaaaaggctgcaggtacatttggacaaagcagctaggtttctgggcttgacctcccagatcctgctgtcagacatgaagccttcagttatgcttgtaagagccatctctccggttgccaactccaatcttttacaaaaagctgaagcacttctactttctatatgaataatggttttaatttaaatgtctttctttcctactcttgccaagattttgttcatattatcattttcttttggggaaatggcaaaaaataacttatactctttaaagaggtatattgggtattggaaatctttgacacttttctgggattcactgatggcctgcaggactctagatgaaaaatttaagtagtacttttgtcttataataactaggtatcacatattgcataaattcctacatggaaataaaggccaaaatgccctgatattgatggtttctacttcattatttttcacaccttgtgggtgtgcacaagtatgtttgtgtgtactgatttgtgtctatttcattattggaataagatagataaatattttaaatatatgacaaattcatcaatgtttatggtacacctgtcagcaagagtctgaaaaggagttgaaactgctgtgggggaaatgactggttatgactaaaacctctttcagggtagagaaaacatccaatttcacattcacagttttaattagtatctattcaaatctcactaaataattctatcagtctctcttggagctgctgatccaaatccaaatgtctttttatatttcaccctaattttagaaaagtcactaaaaaacaacatggtcttcactcttcacatctgttccataaatcagtaaatggcatcatcatctacctatgtgagcaaaactaaggattcatctgtgacaactccttttccttcaggttcttatatccaacccaaatatctctcatatctatgttcatttttcctttgcaccagaacctccctacaaatattagttattacctatacaaatcatctccttctagctattcttcttctccttgcagccaatcagacccttctccactctgtttctattctgcagtgactctgatacttttaacacaaatctggtcttgctccctttcttaaaaataaggacaaaaggacttgacatggctacaaggccaggcatgatctggtttttacccacccctcccaccctaacctacaccatttttttcctcacttgttctcaatgaggcacaatattgcctccttccagaggacattttgcaatgttgcagcttttttaaattgtatcaactctgggttgggtatttgcctttagcatctagtgagcagaggtcagggatgctgctaaacatcctacaatacacaggaacaccccccacacccacctccaattagcagctgagattctgcttcatggagaatttggtgtacaacattgagtttctttcagtttcttatgccaccatgcaccccccgctcgggtatcacgacagacttttatacatgctcatctctgggtctgaaatgttctttcctcatttactgggttagcatgtactcatcttttagaacacagtttaaaccaccaattcctcagtgatcctcttctaccctcttgaccaaatgaacatctctccatcccacgccacccccttttaagctcttataatactacatagtaattcatttttagtgtttctcttatgcaattttactttcactgaaataatatttgggaagtgtctgtctccacttctacatcataatctatttctgttcatcattgtatcctagtgcttaatctgacgctcaacacacaataggcacgaaataaagacaagtgggaagaatggagagaggacgggattgcatgactcacagggatttctcagaaatggtggttagagaaaaaagccataatatgcttttcatctttgttaaaagtgtaaactcaacaatgagaattactccttaatatttctactttttattaagctggtcataataaaaactccttgtgttccatcttctaagcaaaacacagcaggaagattttgggttttgtagtcagattattcaggttttgaatttggagatagaaacgtgagcgaattttataactttttgagtcttggttttcttatctgtaaaacagtaacctacctcatggcactgttgtcataattgaattgcctacaaagcacttgattcataatagttgtacaataaatactttagtagctattattccactgataccaaagctaaacgagtaagaaaatttgtctctgtatcttgcaatgtatggttattgcagaaggtgttgcaacacaggtatcaagagttcacagctacaccattgctattgttttatcatgacttttttgtacttttatcatttgggaatctacagctttatgtcctagcctatttgcaaagctaaatggatattagtttatgaattcattattccaaaaacttcattatattctcggtcttgatctataatggagtgtggtatgaactgaatgtgtcctccaaaattcatacgttgaagtctaatccctaatgtgatagtatttggaggtggggcctttgaaagggcatgaggttggagccctcataaataggattcatgcgtctataaaaaaagaaatgagagagcttgcctgctctctctctctctccctctctctctgactctcttttctcggccatgtgagaaactagcaagagcacagccatttgtaaaccagtaagtggaccctcttgagacattggatctaccaacaccttgatcttaaacttcccagcctgtagaactgtgggaaataaatttttgttgtttaagccagccagcctaaggtaatttgttacaacagcccaaactaagacaaggtgactctttaaaaaaataaaaataaaaactttaaactcaagaaaaagaaaataccagtaacatcactacaagttaaacattaacaagttataaaacagagttttacaggaattttatctttttatctaaaatcaagaggagtagaatcctgaaatttatcaatgtacttcatctttaaaattctttttgttcctttgacatacaatgcacaaatgtactgagagggcaagacaatgggcaaacatactggaaaaactgtatttgtgaatttgttacatctaacaattattattaaatgtttaccgtgtgccagacactatacttagtaccttacatatattgtcttaattaatgctcacaggaaagacatatcacaggactatttctcacatttttatcggatacattaataaacttgcccaacatcacttggctagtacacaataaaaccaagttctatgtaaagtgattgggtaagaaggatctaaccaggggaataaaggagaattacagtttgcaaagatgagaccagggttggatgatactcagtatcacaagagaggaagttaaaggactctgatgagaggagacattcaaaacaggaagcaaggagattgtggacctggatgaacagactaaataagcaaaggaaaatgctgcagggctttaaaaactttacctaatggaaacttttgagaaatctttagcatgagagtgaccataggatttatgagaatagggatttttacacccatttttttgttgtttgcatgatctcaaatttcacattatcctacatgatttgaattgctctatattgtcaataacctttagtcaggttggcaatatacatcgtgacgatggtttgtgagggggagatcaaagataagggatcgagtaccacatatgagatggctcagagaagagagaagataacaggtgagaggtaacagctaagtatgattagaagttcaatgaatagaactaggagtcagaaattactatgaaaacctaaggcctggagttttgtaaaaatttatacacacgtgcatacatattagcaaagacataggacattgtgcatctcacagaatgttggtgctagaacaggtcaattttactgaaatctcattgttcaaggaaaacttcagctaacagcttgactttgttttcatatataaggtaactgacaaatttctcttatttacattctctttaatccttattttaatcatataaatgtaaacattattaccctcatttcaaaaagaagaaactgagctcagataggttaagccaactggctgatgttcacacacctaagcagatagcccagctgagatttctaactcccaagtccagctttacttttccagcagcacgtttatctcctttaagtaatgctaagtcctcctctatcctttactctttgagagcctataatacaatcatgtgaggaaaattttaaaagaaagccaccaaaagcacaagcaattttactatcctcgattactcaatatttaagactacattaagtgatgtcaggtagataagagccttgcccagtggtctgagcatagaatatactcagttttatttttgtggttgtcattggattatgctaatatgtacagatcaaaggtaattttaggatctcttttagtttattgattgtaaaatagtctaataactatatttattattttataaaataatacttttaagtatataaatattttgttctaagaagtttgaagcatttcactggaaatatctttatactatttgttcaataaaaccaattacagttcatcctaactccaacatagcataactcctattaatgatcacttttattgcatttcaggaacattaaaataatttttcgtgaaaatatgtaatataagcctgacccacacattttaagggaggatggcttcatgaatacatcatcaattcctattgctttttatgtgtcagtgtagaactgtcactgccaaagaacagcaggtgaccacatagcactcaacttcccttagtgttctatagactgtagtatctttgtaattgcaaagttaataattatattaaataatgcagtatagaataaccactgcttttttctttcaaatctctatcattagtaaatatcagtcatacatacattagtcaccacagctgtttcagattggagcactgttttacaaaaagagaaacaaatcaaatgaaatagccatttctcctttattttgcaaattacagaagaattaaaagtaattctttttatcaaagacttctttttctctatgaatacaggcataccaaatcctgatttggttttctttgctgaaaatatgctgtcattttgcaattcacttaaaaagattaaaagaaaaagttgttccattacagaaaaaaagattttttaaagatataattacataatctctttgctagttgtttcatatgagaaagaaaaataaatcttggggcccccaaaatcactaaaccaaagagaaaagtcaagctgggaaccatgttgggcaaaccctcctccgattctattcctacataagatagttacaaagataaaaggtctacatacccccctcacaatttgcccacaaggaaattccttgtggacaaaggacagacagaactaagtcatccctctgctcaaatgagacaaatgcacatctgattgcttcctttgccctattgtttcacgaagccagactaagacataagtgactattccaataaattgtgtattcagtgaaaggataatcagaaactcaaaagaatgtctcttatctacctatgacatggaagccacctccccactttgagttatcccgcttttccagaccaaaccaatgtacatcttatatatattgattgatgtctcatgtctcccgaaaatgtataaaaccaagctgtacctccaccaccttgggcacatgttgtcaggacctcctgaggctgtgtcaagggcacctccttaaccttggcaaaacaaactttctccattgactgagacctgtcgcagatattttgggttcacaatactctcctttataggaataatcgatacagttttatgcgcttataataaggaaaagacttcgccaaaagttgtctacttggtgctatgttcatatttccagaactgaaaagcagagttaaataatgagcaaagtccttattgctgtgcctgtgacatactacagatcttgcctctagccaggacccataatgagcagatgtacaatggccagactaccaggaaaggcttcagtgtcatacaggtttcagcagggctatggtctagatggctactcttccctgtttacctcatgggcccgcttcatccagattacaattctcttcccctagcttctccaagcctctctgcaaatagaaagtgatgatgccattgggatttgattgccccattgcttaactactggttggcaaataaggagtgctagatcatttgttaagtgagtcgacaagtgagtcacatgtgaatgctgaggtcttctctttctgattttgaggggacttgaaaagcacggactctttcattctcagtaacctacttatgctatcatatcctgacaaagttaccaaaagtgccttttccttgaaggacataaaaggtgaggaagggacaaggaagagaactaacatataatactgagcttgaattatttgagctaggcaatttatggatgctaattattcgacgtttacaataaattagtgggggaagggttatttgtattttattttttcaagtgaaagaaatgagttgctcttcagttaaggcacttgctcaagtcataaagctagtaaaagtcagaaatagcattagaacctatgtatctttggctatttccactgggcagctctgcctttcgtatgcatatacaggaacgaaaaataccattctaccttccttccctttgggaaaatgcattccaagtttcaaattactgagtcataaaacaataattgaaatatttcacttccttataccaggagcttcttggagtaatgacattgtaaaaaagaaagacacaatctgtaaatatttattatctaaagccaataaaattgacagcacctataaaacaatcacttcaccaatttgttgttaggtactacttgatccaatggagatactgagtttttactgttctagcaccattttacgttctgggaatacaaaggatacataagagatggagagagaaataagtaaaatgtgtaggtaacaatgagacagatgtcaagtaatagctaatttatataaaatgatgtgggaactgagagatgagggccatggggctcaagaagagaggccattagcaatgtcagggaagctgcacttagaagtaatacgtgagacggatcttaattaatattccataaagggaaggataggggaaatataattaaacagacttttaccgaacatcaaatgaagtagggaaaacctgaggcagagggtgaggaaaactcacagcaggttgaaggatggcaggttgcctgctgcagctagcatggagtcgcgcctgaggttgctgcaattcattctccagatctctgttttagcgacataaactcaggaaagtttttcagagccccaagaatatgtcaggtctctcaggtataggctttccgagctctgagctccttcctctcattgcactgatctctccttgtgaataaacattttcattatttgattgtttgctccctctcccacatgggcagaaaacattaggagaaaaggagatctatctggtgttgcttttcattatatcccagcacctagtattgtatctgacatattagcagccactgaaaagaaaaaaaggaaatgaggtaaataaatgttgaaagaaatcctgaggtcaggacgagtaggttgaaaccagaacgctaacggattcatagacattgttctgtggagagtgggaaacactaaattttatttattgactttcagtgggaggaaaacataatcggggctgtttttaaaagttagctttggctgcaatgtggaggactggtaactaagagtagagcctgcaggcattaaatgaatgtttcagtattctctccaagagataatgaagtcccaaaatggaacagtgataggacttggagaaatgaagaaagacacgagttgcacatattcaaatgcccaggatttggtgactgatgggggagtggcaaagagaggaatcagggatgattatcactagtgtcctagatcatgacaataaatataaaactgcttgaaatttaaagaagagaaactggttcttctcaacaggaacattttgatggtaagtctgtgcccagattgaaatgcagcttagcttacataattgaaataatcacgtctgaagtattcaaacaattcaaaatcaaacgcaaaagcaattttcatgaattgagtgggcgtatttatttttgagttgaatgaaaatgtttttgactagttgacacatggtaagaaaaataataacagaaccaagtatatgcagtacaatgtgaatctccttcccatcgctgtctccttgtcctcttcatgctccaagaggcaacccctgctactaggttcctgtgactcctgagtaggagtctggctaatcatccaaaaatgtcaaaagagaaaccaaggtgaatttctttcccaagctgagatttgaaataaactgctagaagttgtcactgaatgtggatattagcaaataactttaagctacagaaacatcacagatttctgctttactacttttctgaatttgtaaaacacaaagagagggagagaaaaagagaggtggagaggtgggagggagtgggctagggtgagggcaagagcagggagcggggagaagaggatggtagggggagggggagagagaggaagtgggagaaaagggacaaagggaaggggagggggtagggagaaagaggggaagggggagggagggagggaggagtggggaggggtttaggtggcttttgaagtctaaagttcatttttcaatatcactatcactcaatattatgaacagggaactcacaggcagttgacagacacaggcaaggaatcatatgattagactaatcagtggaaggtgcaatgacagaggatggcatgggagcctatgaagaaagagatgatgtttctgtatattatacattctccagaaactaagagctccaatagtctatcgagacttcatttccctggcctggcgaggtggatcacagatgtaattccagcaatttgggggccaaggcaggagaattgcttgagcccaggagtttaagaccagcctgggcaacatagtgagaccctgtctctgtgaaaaataagataattagctgggcatggtggtacatgcctgtagtcctagctattcaggaggctgaggcaggaggatcatttaagcccaggaagtagagactgcggtgaatcattattgcatctctgcactctagcctgcgtgacagagcaagtctctgtctcggggaaaaaataaaataaaaataaacgagagagagaggaaaatttcatttcccttaacagcgaagggcttcactaaaaacaaatttatcatcctgccattttactaagatattgttttcacacatccccctttcaggtcattgccactcaaccatgttcaatctttaccctcctcatctctgagctggcatccatccatcttggttgatgattttttccagctcagagactcagtgccccagcacagcagttctccaagttacaataataaacttcatttgctcttctgactactctgggtcctgaaaatgttataactgacacagttgcagagccatccattggaacaactacactaaaatatagagattgtgttcaaacatgtatacttcacatttacagtaattactatggctttactttcatttgcttctctcagttttccttcatcttgcaacaagacaatcaagaaaaagcaggtagtaggtagcttctaacagaagaacagacaaaagagagcataaagaagatattagccaagaagtgatgcttgacatttttttcaaatagaaatctattaaggaccttaaaaaatcatctattatagccaaactggtgcctaactgaagtagtagctgagagtgcttcattgaaaatcaattagagtccaacctgattgtagacagtgtcccttcaacaaaactgacaagcattctatctctactttgataacatttgtatccaaaatgagaaaacactagagaaatatgaaaataaggcaatttcaatgtatgagttatatcccttaagttcatggatgacattaactaagttctgacaccaatacccctagggtgtctttatttcactcccccttctggaaatgattgaataatttataaaggatatatcttgggggtggccacttctacttcctgagctgcatacagaacataacatttttagagctcagaattgggttcaccaccttccattgcacagttaaagagactgcagtccaagaagggtaaggggtttgcctgctgtcacaaagctagggagcaatagaaccaaagttcaaatccagcaatgctggctgcaactctggtatcttctttgcattcttctgcttgtaccaaatcagatgttagcagaaacgcatggaatcctaggaatagtaaacaaagagaaactgataacaggacaatttacatacatggggcagaatgacaaaggaaaccaacctgggaagcgaagtctgccagggctggcagcagagaaagcctttgcttcctatctctacatcctaaaggaatgaggaggaggaagagagaagtaactgaaatccagaaagtactctgactatagcaaaggatctgcaggagctgtggccttggaaaggaacatgccctctgataaactgtggctttgtcaggaagaagctagagaataaaagctagacatcattttgctcctggcctctaatcacctcctagtgcctctcattagccttgcccaaccagaagccagagaacaaaggaggctgccccatcgatgttctcctaggaccataggaggagagaaaggggatgtggagggacaaatggaaaatattcagccaatatttcttagctgcgccagccttttgctttgcaatttagtcttccttaccctcctctattttctttcattgggacaaacattatcaaggttaataagagataatggcccatgtaaaaagagtattgtattcttttatggactttatctaaaatttactcaaatataacagaatcctgtagatgaagcataatatgcaacagatatactttgcaatatttaaaaatgattaatctcaaaagtaatcatctcagtactatgactcattagctggaagaaaacagtaataacatgttttgtgcacagaacaattttaattaataagcaggacatatttattcaaaaattataataagacattattattctcagaacatgaactttgatggtaggtgttagcatcctgttgggtcccagagaatgcacttctggatattaaacatgatggctttgagacctcaaatatatcagcttgtacagtcagctattatctacactgacaattgtttatggctacaaatcacccacgcttgatgtgatatctgaaagtacctcagtaagatattatgagcaatatcaggagtgggtggtgtaaaagtcatttcagtaataaaacagtattcaaagagttgattcaaaaggcagagccattactaataaaaataatataggtagatatttgttaaatgttttctttcttttgaagggcaatactatgaaaggagagtgagcatagggaagttgtctgcaacctctgagccacacacctttctttggtctaccacatatctgtgcagccattaagaatgactctcatctcttgcctttccaaaatgaggtgtaagagaagtcattctggtatagacaggagatatgttaccaaaacagtccaatggacccttttagggatacttcagttagaagttttagctctgtgtgggttcagtgtctctccacattacccctgagacctaaatcccacagaaaatcttaaaggcaatagatgctagttttccttatacctttcaaaaatatgatttgttttgttttgttttgttttgttttgttttgacagagtctcgctctgtcgcccaggctggagtgcagtggtgcaatctcagctcactgcaacctctgcctcccgggttcaagcgattctcctacttcagccttcccagtagatgggattacaggcacatgccaccacgcacagctaatttttttatttttagtagagtcggggtttcatcatgttggccaagatggtcttgatctcttgacctcgtgatccacccacctcggcctcccaaggtgctgggattacaggcgtgagccaccgcacccagccgacaaaatatgaatttttaaagaccaaacacatcagaacaaaccagctaacttgacttttaaaaaccacttgatttcacacaggtctcagatggagcaaaagtaaaaaaaaaaaaattaaaaaataaagacatcccacttgaattctagacaaaattttatattatctaatggaaatgttttttaaaccacataaactgatgagacatatcctttatcctctgaaagaaagaagaaaaaaacaatatttactagctgaacaaaatgccttgagtgaaatatctgtgagcatacatttttaatttcctaagatgaaaacagttttgagcaaggagctctcaaaaaaatgtcctgatgttctcctaatacaccaagaaataaaatctgtcaaagtgctgagattcttataggttttggtacatgttcccagttgatttgatctggctccagatgaaacatattatttaagcaagatagtaatcaaggtaactaacaattttaaaaattacttcaaagcatatactaaggcttgactagtgtgtatttattctctttccattatttctagacggagaaacaatttcattatattttaagttgtatcgaagcatttgttctggaactttctgatgcattagcagattctacctttaatatagtcatatgtgtaggtgtattatcatgcctgctagaccagaagaagtgaaagcctgaattggttatcgcattcccttttggagattaaaaaatagcattacaactatctgtgttgcatttcaagctaaacccatactttcatataaattgtttcacttggtctacataataatcctgtgaggaaaacagggcagcaattactgccccatttcatggatgaggaaattggcttagaagagttaagtggcttactcaaaggcacatggctgagcagttatggacctctgactcataactaagcccagttcaagaaaacacgtatttattcagtgttttaaaattatcaccctaagtcttttgggttcaaggtagtatacatatggcagactaatgaacaaaaagaaaagtaacatttatacagtatttattatacaagagtccctctcataagaactttatagataatagggtcattatagatttatctcatttaaccccatagcgaccttgttaacagtgagataaatctgtaatgacccataacaaccttgttatgcagttaaataagataaatctataatgaccctatgtcattgtcacgtcacagatgaagccgccgaggcacaatgcagatgattaatttgtatagaatcactgacgcattttttaaagaaattaaacaattaattagtgtgtattcatactagttgtacatatttatgaggcaattttgattttagagtccatgttcttaaccactatacatatttgcctccagagattccaaaacttacggacatcttttcattatgctacacagtctcccatgagcagagtatgaaaaaaatccagatatgaggccgggagtggtggcttatgcctgtaatctcagcactatgaggggttggggcaggtggatcacttgaggtcaggagttcaagaccagcctagccaacaaggtgaaaccccgtctctactaaaaatacaaaaaatagctgggtgtgggggcacgtgcctgtaatcccatctactagggaggctgaagcaggagaatcgcttaaacccgggaggcggaggttacagtgagccaagatcgcaccactgcactccagcctggttgacagaggagactctgtcttaaaaaaaaaaaaaaatctgaatatgaatctaagcaaacatatacacacaaacaggcatacatacctagacaaactatatgtctatctctacatctacctatctatacatacaccttatgctgagggtcttgaatatgattgataatcacattctgtgtggctaattgcatttaggccaggactcaaaaaaaaaaacaaaacatgaaataaaccaaaataacctagatgagtgagaaattctaagtttgaattttaactggggaggaaaaaagataaagaaaacttcacagattggaggccacttatctccacatttaactttcaaaacctttctcaaaatatctttgtatttaaaagaatccatcagtctttgcaaagagaggagagaaaatagacttgaggaagatgtttccttctgtgtgctgtgtgactcaggacacatgcttcttctgtgcaatgctttaccatcatctgccaaagacgtgtgtgcaaatatcagtcttgcaaacagacaatatttgcactacattgaggctaacctgccatctgcttatcagatgttcggagtccaaattgtacagttttccttgtgtttcccctaatgaaaaatggaatgctggggctctgattacaagtgtctgtgcacaggactaatactacatccctaggtagagtaatggaaacagtgcatctaggggaaatggcttatatattgacattgtttaaagaaaacagaattattttctgtggctcaggttcacatgaaatataaacctcctagttcactaaagtgtgatatatttttctcaaaatttggagaaccactgatgttctggacaactgtatttcagtgttaggcctagccgaatatatcaactaaaaatgcaatcacagtgaaaaattctaatgatatgcattatttctgaataagcaaatgccagaagcacaatcccaacatattatgaatgatgtgattgactaccagggttgctcgcagcccatagcttcaggtaacacagctgtctcctcccattaatgagaaaagagatagcattttctgtttaaaattaataactgtaacactccaggattataggaaaaattctaagtgtttcacacaaagtgcttcacaaaattttactgaagttcaacaaaatcattatataacaaatacatatgagaaattcttctttatggcttattctattgaattgcctattcatttttgccttcccagaatccacaattttcagcaagatgaatatgagcagaaataaaaatgccctttctatttaataccccctgctttcaattaaaagaaaactggttagtcatttagtatcttagaatatttcttacttataatgaattaggcattaattatattcttctatataaccaaaacaattttttagcaatggacaacactattattttctaattcatgttactttttttaagcatgcctttgggcattggatcactatcagcaatgtgcagagaatatcatcatcctttgaaaagctgtactactgatgtactttacagataaatagtaaaaatgtttaatgtacacctaaaacacaattgaaataaatgccatttcaggaatttgaaagtgtgttgaggttaccaagattatctgtgatccttttcaaacagcaataatttactcaaaaggctgtcatgtctgcttacaagactgtgcagatagttgacatagatgaaattagtattaatatattcattttaatttctacccatttactgtcttactaagggtaatttaactcagaaatgccgtcataatagggtgataatctgataatccggggtgcagtggaggcagggaagaaaggaagaaaaaaggaaaaacaatgacaataaatggcacaggcaagaagaaagcaataatgtaataattactaccatgttttgttcaattatcaccgaaaaatccagaaagatatgaaaggtgagcaaaggttctaccatgtttttgtaaagaaataaaagctcactgaaatattagggagaaatggaatcaaaagtaccaatgaaaaaagcaaaaataagataatttaaaaagaaattagaataagaaaaaactaggaaataacgttctttacatgtgaataatttctttttggttgagttgtaaatcacatatctgttattcaaaaatatttcctgattcatttgaaaagaaaacatattgaaaagggatctaaacaaaggttgtttttttttcccctctttaaatgttgctacctcaaacaagctgtaatctgagtattaaagtacaaaacacttaggaaatataattttccatgattactttgagcttcctgtaagtgtaacagtttttttactacagttttcctctctaaagacagaaatgcaccgtatgggcgcaaggatgctcatgccatagcctatgctcaaaagaggattcttagtctacattccagattcagctggagtctatattaactgcatccattcttttaatgttggccatcttgtatgggttggatgtcccaagaagccacttaactatgggtgtgattgtctattcaagaacctagaaaaaatggtaaactggttacataacaaataacacatcttgatctaagttgagaggactggagtcttctagctatattatttgaaaaaatgcaatcatgatttagtgacaaattgaatagcaacttcattaaccagaatttgactgtaaacccatgcaccgtcctagccagtatctcttttctccggaagagaggcatgggaggaggggagagaaaaaggtgagctatactactttagagtcttatgctagttctgtgaggtaaatgtaactactatttcctttatttaacaaacaaaaaatgaggctcaaaaatttaaacaacttgtgccaaagtcacagaggtaagaaatactagggcaggaattgctcccatgtctgtgtacctttaaaattcactttgcagctgcacagctgataagtctgctcagaagatttaaattataagaggaaaaaatgccttgcatccctggcactgtgcctagttctttccccaaactgaaaatgatacttgcaattttttgagccctcaccatgtatctggatcatttcaattaatcttgacaatgctggtcaagggactattattagtctcattttgaagatgaagcttagagaggtaaaataacttgccccatatcctacagctggtgggagacagagatggcattctcaccagctctctctaaactccaaagcctgtgctcttcccatttattccattctgctttctctccaggagtcttcataataactctgagttcagcagctgttttcaatgaggatataggctcaaagcaaatacaacataaccggtacatggttagatttctaagcctcttgccattccgccttgtggacaaggacatcaaatacaatgaaaaatgggtgccccgcaaatcaatacatctgttctttaatacctgtgatcacagctgtgaaataggcttaatacacagcctgaaaatattgttgtgaaaataactgtgtgtttggctgttaagtaaagttcagctggacacatgatctagtaagaggtgctaggctgctgcatgcaaaggaattccattagaaaagacagagaggtatgggaggaaaccgagcacaaagcagtgtgtccattgatgagagaagtcactcccacttcgcccacagatggtggcattaataaagatatcttgtacaatccaatgatgtgaatctcaatcttcagcatggataagaatcactggggagcttgttaagaatacagttttagtgtcatctcacctaagattctgattcaattaagtctggggtggtgcccaggaacctgaattttataaacatcccagctggttttttaattattattactattggtttctactttattctaggtttagtggttacacatacaggcttgttacatgggcaaattgcgtgtcactaaggcttgatgtatgaatgagcccatcaccaaggtagtgagcatagtacataacaggtagccttccaatccatgcccccccaccaccctccccaatgaagcagtctccagagtctttgttcctatctttgtgtccatttatattcaatgttgagcttccaattataagcgaaaacatgtggaatgtggttgtctgttcctgcactagtttgcttaggataatgacctccagctacatttcatgttgctgcaaagaacatgatttcattcttttttatggctgtgcagtattccgtggtctatatgtaccacaatttctttatctggtccactgtcaatgggcatcttggttgatgccatgtctttgctattgtgaatagcattgtgatgaacatatgagtgcatgcatctttttggtagaatgatttattttcctttgggtgtatacccaatagtggaattgttgggccaaatgatagttctgtttcaagttctttgagaaatctccacactgctttccacagtggctgaactaacttatattcctaccagcagtgtataagcgttcccttttctctgcagcttaaacagcatctgttgtttcttaactttttaataatagctattctgactgatgtgagatagtatctcatagtttgaaatttaatttctctagtgattagtcataatgaacattttttcacgtatttgttggccacatgtatgtctttttttgagaagtgtctcttcttgtcctttgcccacttttaaatgcaattaatatatttttgcttactgatttaagttccttacagattctggataataggcctttgtcagatgcacagtttgctaatattttctcccattcagaaggttgtctgtttattctattgatagtttcttttattgtgcaaaagctctttaagttaattaggtccttcttgtcaatttttgtttttgttgcaattacttttgggaacttagtcataaattctttgcaaaggcccatgtccagaatggtatttcctaagttttcttctagggtttttattgttttagttctacttttaagtttttaacccatcttgagttaatttgggtatatggtgaaaggaaggggttcagtttcaatcttttgcatatggctagccagtgatcccagcaccatttattgactagagggtcccttccccattgcttgttatcgtcaactctgctaaaggacaggtggttgtaggtttgtggctttatctcagggttctctaacctgttctatcagtctgcctgtttttgtacctgaatcatgctgttttggttactgcagccttgtagtatagttttaagtcaggtagtgtaacgcctctggctttgttctttttgcttaggcttgctttggtgattcagtcttttctttgattccatatgaattttagaataactttttctaattctgtgaaaaatgtattggtactttgataggaatagcatctaatatgtaagttgcttttggcagtatggtcactttaacaattctgattcttcctatccatggaataggaagaatatttttccatgtgtttgcattgtctctgatttctctcagcattgttttgtaattctctttgcaaggttctttaaggtccttagtaagctgtattcctaggtattttattctttttgtagcttttgtaagtgacactgtgttcataatttcgttctgagcttggacattattggtgtatagaaatgctactgatttttactcatagattttatactctgaaactttactaaggtcatttatcagttctagaagccttctggcagaatctatggggttttctaagcagagtcatgttgtcttccaagagtgagttagacttcctctctatttggatgccttttatttctttgtcttacctgattactttggctaggatctcctttactatattgaataggaatggtgagtgtgggcatccttgtcttatttcacttctcaaggggaatgcttccagctttcacctaattgctatgatgttggctatgggtttgtcataaatagctcttaaaatttagagatatgttctattgatgcctaatttcttgagggttttcagcacgaaggaatgttcaactgtatcaaaggctatttctttgcctattgagataatgatgtggtttttgttggtaattctatttatatggtgaatcacatgtattgatttgcctatgttaaaccaacattgcatcccaggaataaaccctacttgatcaccgtaaattaactttttgatgtgctgttagattcagtttactagtacttcattgagaaaattttgcatctctgttcattggggatattggcctgatatttttctttctttttttttttttgtttgttgttgttgttgtgtctctgtcacattttggtatcagaatgatgctggcttcaaagaataagctagagaatcccttctcaaattttggaataatttcagtaggattagtactagctgttttttgtatgtctggtagaattcagctgtgaatccatctgctctaggcctttttttttttttggttggtaggctttttattactgattcaatttcagaactgattattggtctgttcaggattttaatttcttcccagttcttgggagggtgaatttccaggaatttatcaatttctttcagtttttctagtttgtgtgcatacagctgttcataatagtctctgaggattttttgtatttctttgagatcacctgtaaagtcacgtttttcatttctgattgtatttatttggttcttctccttttattaatctagttattaatttattatttccctaaatagtcacaaacctaatttgtcaagttatagctcagttgcattacaaaagaagttcttacatcaagtattacagaagaatcagtagtatttgcttgggcagtacatgccatcagattatgaatggattataaatgcaaactgacgtgtgacttttaaaataccatgatctatccaatttgaaagagaccattaaagtggagatttcaactcctaccactataactctaaagtatgatctttactttggcagaatattacagacttagaggtattgtttttatcacttggttttgtttttatccatagcaaagccttcaataatatttcaggccacagagaaaataatacaagtttttgcattgttgatacttcaaccaagatagtcattcttttaatgtaggtctgctggtgtcaaattattttattgttccttcatctccgagaatttcttgatttctcctttatttctgaagagtatttattactggatataggatcctgagttgacaaaattttttctttcagcacttcaaaactattgtaatttttgctggcttccctggtttccgatgagagatccagtgtcatctgaacgttcttttttccacagagaatgtgatatttatttctgactgctttaaacatttgtctttaattttcagaagtttgtctatggtgtgatttcatgtggatttctttgggcttatcatgtttggggtttgcattatagtcccatacatttctgaggttgtgttttgtttttgttttctttaaagtctattttgtccctgttgtttacattgtgtaatttctatttgtattatttttcaatggactggttcttttctctgtctcctctgttcagctattgagcccatatgttgactttttaaattattattttattggttaatatttttagttctaacatttctatttcattcttctttgatttctttgctgtaacattctatttttttattctcctttggtgacattcttcccctttgcttatttttatttttaatttttatggctacataattgtacatattaatggggtacatgtgctatcttgatatgagcatacaatgtataataaaatctaggtaatttgaatatcgattatctcaaacatttatcatttctttgtgttgggaacattccaaatcttctcttcaaccaattttgaaataggtgatattttttcatttgttcaaggatgtttatgattgttcattcatttttatgatggctactttgaaatctttgtaagataattctaacatcgctgtcatctattaaatgtatttttttattcagcttgagatcttcctggttcttgatatgacaagtgatgtttgaatgagatggagacattttggttattatgttaaaagactatggatcatatttaaaattctggatcacatttctgctttagttggcttcttctgaaactgctttggcagaggaagaagagggttgcctcattactgcctggtgagggtaatctttaggggtaaaagtggttctcagttacatggatgaattgtataatggtgaagtctaggatattagtgcatgcattatctgaatagtgcatattgtactcaataggtagtttttcatttttaccccctcaccccttttaagtcttcgatgtctattataccacttggtatgcctttgcatacccatagcttagctcccacttataagagagaaccttcagtatctcgttttcaattcctgagttacttcacttagaataatggcctctagttccaaccaagttgccacaaaatacattattccattctttttatggctgagtagtattccatgataacatacatcacattttctttatccactcatcagttaatggacatttaggttgactgcatatctttgcaattgtgaattgtgctgcaataaacatatgcacacaggcatctctttgatatattcattccttttcttttgggtagatacccagtagtgagattcctggatcaaatggtagatctacttttagctttgagaaatctccatactcttttccatagaggttgtactaatgtgtatttccaccagcagcatataagtgttcctctttcaccacgtccacccgagcatcttttggggatttttttttttgactttttaataatggttattctggctcgggtaaggtggtatacattgtggttttaatttgcatttccttgacaattagtgatgttgagcatttattcatatgtttttgaccatttgtatattttttgagaaatatctattcatgtcttttgtccacatttcagtttttaagttgtctgtttactgtaatgattatttattttgctgtgaagaagctttttagtttgagtcctattcattatttttgttttgttggatttgcttttaggggtcttagttataaattatttgcctatgctggtgtccagaagagtttttcctaggtactcttctagatcttttatggtttcaggtcttagcttcaggtctttaggtctttagtcaaggtaaagttaatttttgtatctagtgagagacagagatccactgtctttcttctacatgtgactatgcaatttttctagcaccctttattgaacagaatgtcctttccccgatttatgtttttgtatgttttatcaaagatcagttggttttaagtatttggctttatttctgagatctctattatattccattgatctacttttataccagtaccatgctgatttggttacgttagccttgtagtaaaatttcaagttaggtaatgtgatgcctccagatttgttcttttcgtttaggttgctttgactatttgggctattttttggttccatgtgaattttaggattgatttttctaattctgtaaaaaatagtgttggtaatttgatagaaattgcattgaatctgtagattgctttggagtgtatggtcattttcatgatattgattgttctaacccatgagcaaagaatgtatttccatttgcttttgtcatctacaatttctttcagccgtgttttatttttcttgtagagatactacacctccttggttaagtatgttctagcatattttatctttttgtagctactgtaaaagggattgagttttttatttgattttcagcttggttgttgttgatgtatagcagtgatactgatttatgcacactggttttgtaatgagattttgctgaattcatttatcagatctaggagtcttttggaagaatccttagggctttctagatataagattatatcattggcaaacaaagataatttgactccatgttttacaaatcgaatgccctttatttatttctcttgtctgattgctctggctaggattccctgtactatgttgaatagaagggataaaagtcagcatccttgtcttatttcagttaataggggaaatactttgaactttttctcattcagtatgatgttggctatgggtttggaatatacagctttaattatttagaggtatgtttcttctatgtctagtttgttgagggtttttatcataaagtcatgctggattttattgaatgctttttctgcatctatagaaatgatcatatatttatttaaaaaaattctgtttatctgatgaatcacatttattcccttgaatttgttaaaccatctctgcatccctaaagtgaaatccatgtgaatatagtggattatttttttgatgcgctgttggatttggtttgctactattttgttgagcatttttgcatctatattcatcagagatttggtctgtagttttctcttttttgttaagtctttcctttgctttggtaccagggtgatactgggcttgtagaatgtattagggaggattctcttcttctcaatcttttggaatagattcaatcgaattagtaccaattctttggatgtctggtagaatttggctgtgaattcatttggccttggactgtttttgtttgtttgcagtgttttggtttttgttgttgttgttgttgttgttgttgttgtttttctaaattactgattaaatctcactgcttcttattggcctcttcaggatttctagttcttcctgattcaagctagcgggggttgtatgtttccaggaattaattcatttcctctaaattttctagtttgtgtgcatagagctcttcacagtagtcccaaataatcttttgtatatctgtagtatcagttgtaatatctccattttcatttataattagtcttatttggatcttctctcttcttgtcttggttttaatctacctagtgttctaacaattttatctttttgaaggagctattttttgtttcattggtcctttggattttttttgtttcaattttatttagctctgctctgatctttattattccttttcttctgctagctttaggtatgtttttttcttatttctctggttccttcagatgtattgttaggctgtcaatttgtgatctttcagaattattgatgttggcattttgcactataaactttcctcttagctttgcttttgctgtatcccagaggttttgataacttgtgtcactgttgttattcatttcaaaaattttttaaatttccaccttaatgtcattgttaacccaaaaatcattcaggagtagattgtttaatttctatgtatttgcatagttttgagggttccttttggaatcgattcctagttttattttaccgtggtctgacaagaaacttaatatgattttgatttttaaaaatttattgaacttatttagtgacctatcatataatctatcttggagaatcttccatgtgctgatgagaagaatgtatattctgtagttcttgggtagaatgttctgtaaatatctgttaggctcattttttctagactgaaatttaagtctagtgtttctttgttgactttctgctttgatgatctctctagtgctgttagaggagtgttgatgactcccactattattgtgttactatgtattttcttttttagacctggtaggaattgccttatgaatctgtgagctctagagttcggtgcatataaatttagacatgttatatcttcttgttgaatttatcctattttaattacataatgaccttctttgtccttttttaatattgttgctctaaagtctattttatttgttttaagaatagctactcctgcttgcttttggtttccatttgcaagaaatgtcttttttcaccccattagcttgaatctataagaatctttacatgtgaggtatgtcttctgaagatagcaggtatctatttggcttgcaaatttttaaaatccattctgtcagtgtgcatctttttaaagtggagcatttagaccagttacattaaacattgagatgtgaggtgctgttctagtcatcatattgattgttacttagtgactttgttttcttcatattgttattgttttataagccctgtgaattttatgctttcaggagtatttattctggtgagtaacaacaacttgtttcaagatttagtattctatttagcacttctcatagagctggtttagtattgacaaattccttcaccatttacttgtctgagaaaaactatttctcctttatctatgaaagagttttgctggacacaaaattcttgaccaacagtcattctgttcaggagactaaagataggaccccaattccatctggcttataaggtttctgctgagaagtctgcagttagtttgattggttttctgttataggttacctgatgcttttattttactgctcttagaattttttccttcatgttgactttagatagcctgatgagtatatgccttagtgatgttttgtttttgcaatgagtctctcaggagttctttgaccttcttatatttggatatctatgtcactagcaagtccagggaagttttcctccctggaaattttcctcaaatagacttttgaaatttttgctacgtttttctccctcaggaatatctacaattcttatgtttggccattttatataatccacatatttcttgagactttccttcttcttttaattcttttttgtttacttttgctgtgctgattgggttaatttgaaagccttgtttttgagttctgaaattctttcttctgcttggtctaatctattttaaaagcttttcactgcattttgtagttgccgaaatgtgtagtctttcatagaagttctgattggctttcctttaaaatatccatctctttagaaaagttttcattcatgtcctgaattaaaaaaaattatgttggttttcaactttatgttaacttaataatcaacttttttgaattatttatctggtattttatgttggttttcaactttctcttatgtctccttgattaacataataatcaactttttgaactctttatctggtatttcaaagatttcatcttgatttggatccactgctggagagtcagtgtgattgatttttttgagttgtcatagaacaactcaaatgttttttatgtttccagaattgtttttatggttccttctcatttgtgtaggctatttcttctaattattttaaaattagtttttgattcaattgggtttaaaaaaattttcctccttgaagatgtgactttaacatttatagtttatttacacttagtttcagctctgggtggtttcaagtggcaaagactgtatgagtttcttggttatagagaatcattgtgaagtgtctttctcagatgccggttgtagtggcagtgggctgggtgtgtgagtaggttcactgtctcctaaggggctggaatggcagaggtctcatgaagcttattttgttccccagtggtgtgcacctttaaaagtttttcttccagcattttattcaacgggttgagtagttcaggcttcaggccagtaggaggtgcccacagataaacacaggttgtggctaaagcgggtgggtaaatgtaatatccaacgattggatgaagtcccagctttgacagaggcagctggcaaagctctccgtgaaatacactgaggtcttttcatggggaagtgaaggagccaccccagctctccttccaggcaaagcaggaaagcaatccacctcccagtcacactgctgacctggtgttctagcttttcagatcaaacaggtatctctttctatctgcaagaatgctgatgttccctctaaagaagggttgtagctctacctcttgtgtaagtctgaacctgtatggcacacttcctgtggatagttaccttggagtgttccagaaagtctgtctacagatgcatccatgctgagctcccatgagagaagccccagctctctgcagtgttgggtgaggggaaaaagaaatcaccttctcaaacctttcatgagcgctgtttgactgttggggtagagctgcagactttccccactgagcccagcactgcacttgtgtctctcccgaaagaaacttctcacaagtgggaagttaagggactcaaggcccatggtctgctttcttttataccatgggatgctcccttaatgtggttcactactctttccccaaaaaatagtagtccctgaaagccaggctattctgaattctactgctcctctaggtctagctgtccagtggggctgccacagttcaggctgtactggagaatatctgcaagggatccagtgatgtgaactgtcctctagtttcccagcaccaggtgccagcattacctctgatgggggtgggtggggagtgacacagactctgagattttcttggttataaatagctttagtgttttggttttctcaaatgccagctgtagtagtagtgtattgggcacatagacagactcaagacgtcctatttagctaaggtaatactggcaatggcaatagctgaggttgcataaaagtttttggcttcctgagtgctgggttattgtttatgcagatgttttaatgggctgtgccggttggcctccagccagtaggtcatggcttgtagaaaagcaccagctgtggaggtagtggtagaatttgtgcttgctttatgtcactcaggggaggtattcctgtgtctcaggtaggtaatgggtagggccatggagctcccaaacatccctgtatattgcactgtgctaccagggcaggtggaggggcaaagctgggtatgggctaggtcaggcaactccttgctctggctcctcacatgcaggcacaagcagcggccccagtgaggatcataagtcaattccttggctactggggtaatatttcagggagtagcacagctgcctctgttgcacagaagaatccgcatgggatgcaggggttagcaagcagcagtaagccccactcagctcccatgcacttggcaaggcatgtatcccactcataatgttcgctaaaagcagcaggctgggttccaggtagtctgtacgtagaactaaaaactgccccaggccataagccgtcccagtggagaccagtgaaaccacagctttcaggccgcaccccttctggtctacctgtgaagcaggagtgcccagctcctgcgcccatggctatagcaaacttactacttgcccctcatttctggccaacagggtttatcctcactcaaggttataatctcatatctcagatgggagcttctctcaacctgtgactgcagcttgagttagctggtagacttctgtgaggtcccctgtgaggtaggatcaggaatggcttccctctgtccttgctggagtgtgaaagtgcaggcaatgtgcatcctgataccgcttcttctcaccccatcactcgctaaatcagctccagcactgggtagtgttaagatctgcctccatggcctgaattgcccggctctccggtgggagtgtgtgtcacggtggcagtctctccccctctcacacactctggagactcacagttttccatctggttcacagtgtaggctgctgtttcttctttcaaagggtctgtagtttctttcagtttttctgttaagttcctgtgttgcttcttagaaagaagtgcacattgtgaatctctgcacactattttgtctttccaagtgggagaggcaggctaacaatgcctccaaaccactgggccattttaaataacacataggccagattttcagttaacacaattcttaaaacacctgcaacttagcatgcttctatttgacatcatttgggggtctgttacattatttgagaagtctgctgttagtctgataggttttcctttataggctagggtatgcatttgaagactagttagcatatccactctatttcatttatctaattatcccatcactctcataatccaaaagtcagacacgaagaaaaggaagaataccagcatatttggatgggaataaaagacaagaaatttcttgagcatcaatattaggtgcatgaaatcttgggtaatctaaggtacaaagtaggagttggacttttgaggatggacaaggcaaaaattcattacaattgaacctaattataaggatattgccaagatattgctagtgggagtacagtggagataaaagaaggtctctgtgtctgaagccaacatcagttaaagtgcctttggttataaaaacccaaaatttaactcaaacagactagtaattaaatacatttgttaactcaggtaacagaaaaattctagttttgtttcttaagtaaggatagatctgacagctcaacaatgtcatttaaaatgtatcttgtttttcttttcccttgatttacattgtgctttctgagtttcactttgtcctgaagttggtttcctttatagttataagagggcttccagtgattcttaggtttataagggtcattggtcacatcacatccagagagagggggatcaaggagaagatggggataaatagaggagaggggaagcagaaaaaagaaagagggatgaaaggggtgggaagttccctagctagataatgaaattcttctatttcactttgattgtggcaatatatatccatgcccaataagggagttggtttgggttaatcagtacctgcccctaccccatgaaactgagaaagtgaaatagacatgagaaaaaccaatagtgttttctacattaacattttctctttactataaacacccatggttgttcctctacatatcattgtgcatcaacatcaaggagcttcccctcccttgggttagaaaaccagtgcacatatttgactgggtttaactcatcagtgataaaagcacctattcctttttacaattttcaagagtggaatatacagtcttaagaaatggcatacaagttgagatgttgtcatattaacagaaataatggcagctgtttaatctgttctaaaacatatgatttaacatgctttgactcatcatttgtttccattgctttttcccttagataagatcacttaaaaacagtgttaatcagataaaaggaaggaccatcccacacatttcaatgggaaaaaagccagtgggctcagtgtactgtgatatatgaattgtttttgtgattcccatcataaacgctgccttaactgtgttatttttttaactataaagtagaaaaaaataaattactttgctcttaaggagtataaagaaatattgaaaggagtaagattttttgaaaaaaagtttggtagcctaaaatatgtttagataatattgaagtttgtgaactgctaattcaatggtattgtttcaatcaaattataatgtaaaatatctgttatgtgtttaaagtatgttttacaggtataaactaagttgaaggcttcccaaaatagaatattaaatctagaaggaatattagacatctagtccaaatctacccacttacaaaggagggactgaagaatctgagagtttaaggttcaagtgacttgcttaaagccacatcattaattagtgaaagaagactagagcacccatttccagactggaagcccactgctctttcttggtttgacatacatgaaatatgaaatcacccgtaccagacaactggatactggcaaaatacatgttacatatttcattttgagacaaaagtgaaattcagattatcctaccatttatcaaagtgtataattaaagcaacatacatccatctagatacaaatctgattatgattcggttaaaacagtctaaaaagtgaattaggaaaatatacaacaatgagaaaaatgaggaccatgaatcagaaagccagctttacatttgattcagtgagggtaatttcatttattaaaattgctatggcatttatattttaacatagtcatgtaacatgtgaggataatgttaaaaatagttatagtttgccttatttctagagggagaaaaaatacttttcagtagttctaaagagggagaaaaaacagtattagaaaaattataattataaaggccataaaatatcttcctaactgataatgcatttgattaatagagggagaaaaatggcttatatatgtgcagatataaaaagagatggcattgctaatatatctaaggcatcaaagttgtttgtggaatctataaacacagggacttagtttttcacacagagtacaatttaatacggtttactgagtgggagtggttttaaatgataattattttcctgtcttctcttattaagaaaatcaaaacaacagttttgtcccattttgctgacactggtttctgtagtgtgatttctattgaagcgggaaagaacagaacatcatctgtatcattttaagaacttgagttgtctcctagaattgtttataattgcccttgcaaaagagagcagcctcagcaggttggaaaattaccaatcagtcaacaagtgtttattgaactccagctatgtgttcagaatagtactgagtggtatataaaacatatttttccccccttggggactttcagtggaaggaagattgttgggaatattatcaacgcacatggaataaagagcaattaagtaccttcataattaaatatggtctatcagtgcaattacatatcagaaggaaaagatatcattttgaataagagcagcctgaaggcaacatgagagagataataaaatctcaaaatcattaatgatggaaactgctttacttgatcactgttcttaaagcaacccattcatctgttggctgctctgactctagaagagatgctcttgacattgacctgaaacttacccctcttttacctccagctatccacccatctttagctaactctcagctgttccagccctttcctgtggtggaattttaatgcagcaataatattcccacatagtattctctctttatcctgtcagcaatgataatgatgccatcctgatattcatcatttttttgctctatactttgttaaaatccccttaaatataatattcagaaataatacaacactccaaataagcattggcgagttaataatacacaggaaaaaaatctttttcttgatctgaacactatatttctttaactacagaataagagtatgttagttttattgcccgtatataaccctatcagctcatattgagttttagcaagttttatttgacctctcccatgaattgcagtcaagcaaatttgtaaggacttataaatacaagcgatgaatttaattggaatgtagactttatagttattgctgttaaatgttccttgttgatttctgaatcattattctagcttggcaaaaaaaaaaaaatggtgactcatgactcaaccatccataacattagcttttcctcctgaatttacattaaccacaaatttaataaattagatatctggtttttcaacagacctatacaataatacttttcataggattgttgtgagaatacaaataaaataagatcatgaaaaaagtatttatcacagtttttaggaaacagaagttccataaatgtcagattattttcctttcttcaaaaaatatttgaaaaggacataagcaagttcagaatctccttcaggataaaatttacctacttaccaaaaccctttgtgtcaacctcctacaatgttccccaattgtactaacatccaacctccacttttccatcctggtcacaaatatataattgaagaccacattgataaaatgtatcattgtatcagaatgtatatgacagatagaatgcatatggggagtcaaaacatatagaattaaataaacataggccagtcctctacagagttataagcaaaagctgagacacagaaatataattggtaaatttaaaagatgaagggatggatatatgttagtgtgggttgaagaatggtaatttgtgctgggttttaaaacaataaaaggagatgggaattgatacagaaagcaatagcagccactggatgactttatgtcaaggtttggcagaaagaggtgggagacaccaaagtgtctgcacagggtaaatatattaggcatataagttagagaagactttcatggaggtaggaggtaagctactgtaataatagaggccagaagcaatgaaaatctagtttgaaataatggtaatgataaccgagtaaaagttgtgacttctgaattcacccattatggacaatgaagaagaaggcaaattcaataattttcagaatcatgccactaagaaatttataagacggaaaggaaagaacatttgagccatattatggaataaaacaaatttaatttttataattttcaatgtgtggggctttgaccattgcatcagcattatgtaagaatttattagaaaagccaattcataggatcttgcttagacatactgaattcaccaatactggtgtgttggtgatggtggcagggcagggtgagaacagaactaatctgtaacgttgaagatttctgacttttctgatttttgtactcccaccatggccagtttcaagtcactggtgacatagagttgtgaataaaagtgcacattctgctccccagactctctactaggccactcatgcacaccactggctccaggtgaatctgtagtttgcatcagaatcagctggatgatgatcaaaacacagttggaccacatcaccaaagtttctgtttctttagatctagggtagggcctcaatatttgcatttctaagtttccaggtgattttgatactcctggtctggggaccacactttgaatatcactactttaagtgtcccttaagccaccttatttagaaatttaattagcatacagagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatgctgctagaattgcttaaaagcctactgcactatgtagattctgaagacaaaaggcaatattgaaaaattaccctgataccaacaccagagagactcaacaaaaaaaggaaaccgcagaccaatatatctgacacacatagatgcaaaaattttcaacaaaatattagcaaacaaaaatcaataatacattaaaaagatcattcaccatgaccaagtaggattcatcccagggatgcaagaatcttttaacatgtgcaaatcaaaaaatgtgatacagcatatcaacagaatcaaggacaaaaaccctatgatcctttcaatagatactgaaaaagcttttgataaaattccatatccctttatgataaaaatcttcaacaaattttgcatagaagaaatatacctcaacacaataaaggccatatgtgacaaacctatagcaatcatagtgaatggggaaaactctaagccttttcactaagacctggaacaagtctacgatgcccacttttgccaattttatccaacatagtactggaagttctagtcacggcaactaggcaaaagaaacaaagaaagggcatccaaattaaaaaggaagaaagtctaattatcctcgtttgtatatagcgtgattttatatttagaaaggcctattataccaaaaaattcttggaatagatcaataaatttagcaaagcttcaggatacaaaaccaagacacaaaaattaatagtgtgtctgcaaactaacagtgatcaatctgaaaataaaaaacaagaaagcagtaacatttacaatagctaaaaatatatatcacacataagaataaatttaatgaagaagtaaaaggtctttgcaaagaaaactgtaaaacactgatgaaataaattgaagaggacacaaaaaaatggaaacatattctatgctcatggatttgaagaattaatattgtcaaaatgtgtctactacctaaagtgatctacagattcagtagaatccttatcaaatattaatgatattcttcaggtaattacaaaaaaatcctaaaatgtgtatggacacaaaagactgaatagttaaagcaatcctcagtaaaaaatgcaaagctcgacatcatactacatggttttcaattgtactacaaagctatagtaactaaaacagtatggtactagcatgaaaaaaggcatatagaacaatggaacagaatagagaatacagaaataaacccacactattacagccaactgatttttgacaagagtgccaaaagcatacatcagggaaagacagtctctttaataaatggtgctgagaatattgtatattcatatgcagaagaataagagtagattcccatctttcaccatatacaaaaatcaaataaaattatattaaaaacataaacataagatctgaaactatgaagcttctagaagacaatatttggaaaacagtataggacactggtctgggcaaagatttttttaggtaagacctcaaaagcaaaggtgaaaaaagcaaaaatagaccaatgggatcatatcaagttaaaaaagctactgcatagcaaagaaaacaattaacaaagtaaagcgacaacctacagaatggcagaaaattatttaaaaactatccatccaacaagggattaataaccagaacatataaggaactcaagcagctcagtagcaaaaacaaagaacaaaaacaaaaacaaaaaatccaattaaaaaatgagcaataatccccatgctaacaccaccaccagtgtgactgcatgcacattcgccagcaggggccccccgttcccctgactcatgctgcctccaccgctgtggtgaatgtccgcatggaggcaggtacactgacacccattagcaccctgctgcagccgatgagcgtgcaccctgccatgctgtggctgccactgctgctgacatacgcggatgaagacagatcctgctgtcaccatactacgaaatgctttggctgacaccacccatcagagagtactgaccagcattctgggagtacctcggccccctagtgtagcagatttctaacctcaaagaaccaaagaacactctcaggtcaccatactactcccccagagttacagcacccagtacaggagctgagagctaagtgttcactccctaaagtcttccagaaacaaagccagttggcagaattcacttcatagcataatcaaaccctcagggtcatcaaataggataaaagcaaaaaaaaaaaaaaatccaaaggtcaacaacttcaatgactgaagaaacattagtccacaaagatgagaaacaaccaacacaagaactccaacaactcaaaaagccaaagtgccttttgtcctaaaaatgaccacatcacctctccagcaggggttctgaactgggctgagatggcggaaatgacagaagtagaattcagaatatggataggaacaaagatcattaagatgcaggagtacattgaagcctaatccaaggaagctaagaatcagaataaaacaacagaaacggacagacaaaatagccagtatagaaaagaatgtaagcaacatgatagagctaaaaaacacactacaagaatttcataatgccatcacaagcattaatcgtagaatagaccaagttgaggaaagaatctcagaggctgaagactagctttctaaaataagacagtcagaaaagaatagagaaaaaagaatgaaaaggaattaataaaacctaagataaatatgagattatgtaaagaaacaaaatctatgactcattggtgtccctgaaagagacagaaagagtataagcaacttggaaaacatatttcaggatatcatccatgagaacttctccaacctagctagagaggccaacattcaaattcaggaaatgcgaagaaccccagtaagatacttcacaagaagatcgctccaagacatacaatcatcagattcctcaaggtcaaaatgaaagaaaaaatgttaaagctgctagagagaaaggccaggtaacctacaaagggaagcccatcagactaacagtggacctttcagcagaaaccctacaagccagaagagactgggggccaatattcgacattcttatagaaaggaaatctcaacccagagtttcatatccagccaaactaagcttcataattgaggtagaaataagatccttttcacacaagcaaatactgatggaatgtgttgccaccagacctgccttacaagagcttctgaaggaagcactaaatgtggaaagactgttaccagccactacaaaaacacacttttaaatatacagaccagtgacactataaagcaaccacacaaacaagtttgcacgctaaccacctaacatcatgatgacaggatcgaatccacacataccaatactaaccttaaatgtaaatgggctaaatgccccaattaaacacagaggggcaagctgaataaagaaccaagactgatttcacatgcaatgacacccataggctcaaaataaaggaatggagaaaaatttaccaaataaatgcaaaacagaaaaaagggaggttgcaatcctaatttcagataaaacagactttaaaccaaagatcaaaaaagacaaagaaggacattatataacagtaaagggttaaatacaacaagaagacctcactatcctgaatatatatgcacccaacacagaggcgtccagattcacaaaagaaagttctctgagaccttcagaatcttaggctcccacacaataatactgggagacttcaatacctcactgacagtattagatcattgaggcagaaaattaacaaagattttcaggacctgaactcagcactggatcaaacggacctgagagacatctacagaactctccactaaaagcaagagagaatacattcttctcatcaccacatggcacataccctgaaataaatcatacaatcagacataacacactcctcagcaaatgcaaagtaactgaaatcataacaatcactctctcaaactacatcgcaatcaaattagaaatcaagcctaagaaattcactcaaaaccatataatccatggaaattcattacatgaataacctactcccaaatggcttttgggtaaataatgaaattaaggcagaaatcaacaagttctttgaaactaatgagaacaaagatacctcacgccagcatctctgggacacagctaagacagtattaagaggacaatttatagcactaaatgtccacatcaaaaagttagaaagatctcaagttaacaacctaacatcacaactaaaagaagtagggaaccaacagaaaaccaaacacaaagctagcagaagaaaagaaacaaatcaatccaaattagagctgaattgaaggagactgagacaccaaaaagcattcgaaagatcaacgaatccaggagttggttttttgaaaaaattaataagttagatagacatctagctagactatcaaagaagaaaggagagaacatccaaataaacacaattaaaaatgacaaaggggatattactgctgaccccacagaaatacaaataatcatcagaaaacactatgaccacctctacgcacataaactagcaaatataaaagatgtggataaattcctggacacagacaccctgccaagacagagccacgaaggaactgaatccatgaacagactaataatgagctctgaaattgaatcagtaataaatagcccaccaatcgaagaaaatgcaggatcagatggattaacgacctcattttaccagatgtccaaagaagagctggtatcattcctcctgaaactattccaaaatattgaggagaatggactccttctaactcattctatgaggctaccatcatcctgaaaccaaaaccaggcagagacaaccaaaaaaaaaaaaaaaaaaaaaaaagcaagaaagaaaagaaacttcaggccaatgtctttgatgaattttgaggtagaaatcctcaacaaaatacctgcaaactgaatccagcagcacatcaaaaagcaaatgcatgatgatcaaggaggcttcatgcctgggatgcaaggttgattcaaatcaatacatgtgatttatcatataagcaaattaaagacaaaaaccacatgattatctcaatagatgcagaaaaggctttcaataaaattcagtatcacttttatgtcaaacatgctcaataaactaggtattgagaaaacatacttcaaaataataacagtcatctatgacaaacacacagtcaacattaaactgaatgggcaaaagctggaagcacttccttgaaaaccagcacaagataaggatgctctgtctcaccattccttacctaacatagtattggaagtcctggccagagcaatcagggaagagaaataaataaagggcatgtaaacaggaagagggaaagttaagttattcctgtttgcagatgacatgatcctatatctagaaaatcccacagtctcagctcaaaaacttaagctaataaaaaaacttcagcaaagtctcaggatacaaaattaatgtacacaaatcactaccattcccatacatcaacaacagtcaagtcaagagccaaatcagaaatgcaatcccatccacaattgccacagaaagaataaaatatctgggaatacaggtaatcggggaggtgaaaggtctctacaataagaattacaaaacactgctcaaagaaatcagagatgacacaaacaaatggcgaaacgtcccatgctcatgaataggaagaatcaaaattcttaaaatgaccatactgcccaaagcaatttatagattcaatgctattcctattaaactaccaatgacactcttcacacaactataaaaaaaactattttaaaattcatatggaacaaaaagagcccgaatagccaagacaatcctatgtaaaaagagtaaagctggaggcaacatgctactagcttcaaactatgctacagcactacagtaaaaaaacagcacaccaaaataaaaacagagaccaatggaatagaatagagtatccagaaataaggctgcacacctgcaaccatctgatcttcaaaaaaaaactgacaaaaaacaagcaatgggaaaggattccctgttcaataaatggtgctgagataactggctagccatacgcagaaggttgaaactggaccccttccttacaccatacacaaaaattaattcaaaatggattaaacatttaaatgtaaaaccctaaccaataaaaaccctggaagacaacctaggcaataccatgttggacacaggaatgggcaaagatttcatgacaaagacactaaaagcaattacaacaaaagaaaaaattgacaattgggatataattaaactaaagagcttccgcacaacagaagaaacattcaacagagtgtaacagaaaacttacagaatgggagatacattctgcaaactatgcatctgacaaaggtctattatctttttttttctttttttgagacagagtctcactgtgtcgcccaggctggactgcagtggtgtgatctcagctcactgtaacctccacctctcaggttcaagtgatcctcccacctcagcctcccaagaagctgggaccacaggtatgtgccaccatgccaggctaaattttttttgtatttttagtagagatgaagtttcaccatttggccaggctgatcttgaactcctgacctcaagcaatctgccctcctcagcctcccaaagtgctgggattacagttgtcagccatcgcacccagccaaaggtctattatctagtatgtataagaaacttatacaagcttacaagaaaagaaaaagcaaccccattaaaaagtgggcaaggtacatgaacacttttctaaagaagacatacatgtggccaaaaaaatatgcaaaacgctcaacatcacctatcattagagaaatacaaatcaaaaccacaatcaaatgctatctcacaccagtcagaatggctattactaaaaagtcaaaaaataacagatgctagcaaggttgcagagaaaaaggaacttagacactgttggtgggagtgtaaattatttcaaccatgtggaaaacagcatggtgaatcctcaaagacctaaattcagaaataccatttgacccagcaatcctagtgctgggtatatatccaaaggaatataagtcattctatcataaagacacatgtatgtgtatgttcattgcagcactattcaccatagcaaagacaaggaatcaactcacatgtccatcaattggcagactgcataaagaaaatgtggtacatatacaccatggaatactctgcagccataaaaaagattgagatcatgtcctttgcagtaacatggatggagctggaggccattattcttagcaaactaacatggaacagaaagccaaatacttcatgttcttacttataagtggaagctaaatgaggaacacagatggacacatagagggaaacaatagacactggtgcctgctgaagagtagaggatgggaggaggaagaggattagggaaaataactaatgggtactaggcttaatacctgggtgacaaaataatctccaggaatagacttcatgtgtatcttttgaatagcctccagtttttgtgtaaaaatacccatgggggggctatgttcctggagcaatgcttcaggccccgtgacatgagcttaccctatgtaacaaacccgcacatgtacccctgaacttaaaagtttttttaaaaaggtcagatagtaactattttaggttaggtggatggtctctttccttgttgtatgaaagcaaccctagacaataaataaaggaactcacatggctgtgtttcaataacagtttatttagacatgttggggaaaaaaaagtcccaaagacctgaataaacatttctcaaaagaagacataagaatgttcaacataactagtcatcaaggaaattcaaatcaaaccccaatgagatacaatctcaggccagttagaatagctattattaaaaggacaaaaaataacactagcaaggatgtggagaaaggggaatgctcatacattgttggtgggaatataaagtcatacggtaaatatggaaaactgtatggaggtttctcaaaaaactaaaagtagaagtaccatatgatccagcaatcccaatgctggatatatagccccaaagaaaggaaatcaatatgttaaagaggtatctgtactcccatgtttattgcagcactgttcacaatagccaaaatccatattttgttaatgaacctaagtgttcattaacagatgaataaataaaaaaatgtggcatatgtgtgtgtatatacatgcacacatacaatggaatattattcagccacaaaaaaatgaaatcctgtcttttgcagcaatacagattgaactggaggtcactatgttaagtaaaataagctaggcacagaaagacaaatattgcatgttcttattcactaaaactgtggatctcatggaggtagaatggcggttaccagaggccggaaagagaataaggggcagtgaagagaagttggttaatgggtacaaaaatagttagatagaaaaagtaagttcaggtattagatagtacagtaggaaaattataattgacaataacttattatatgcttcaaatagctagaagtgaagaattgtagagtctccaacacaaaaaaggataaatatttgaggtgttggatattccaattaccctgatttgattattacatattgtttatgtatccaaatatcatatgtacccccaaaatatatataactatgatataccaattaataaacacacaaataaagaaaaaaataactgatagtaaaaagaatggtaggactttatggtaaaaagtctgcaaggtggagcttcccagtgattctcttttccacaattaggtttacttttcaatttaagggggaaaaaatctaggaatatagcttctggcccctgccctctcctcatttctcacaatgctgctgaaactattctttggttaagatgactgctcacttcctaatttccaaattgtcagtactcatccctctggacttcactggagtatctgtctttgctgatcactgtgctgaaatgctcccatttgctaggcttccagccacacttccctgactttcctcttactttgctcattgttctttttcaggttcctcttccttttctctcccagatgtgttttcttaaggttacgcctttgattcttttatttttattttgctctttagcaatctcatcccacatttatggttctaatcatcacatctatatgaatggtcaccataatctagtggtgacatctcaagttcttgtagttttattttctatcatctcaacctggatcttctggtagtaacttaaatatattcatttctgtcctaaagtgtccctttcttaattttgtttccaatttcttctaatataaccactattttcccaggtactaggctataaacctcaaattcattccctttcacctccatcatcacaatcatctaatttgttttcagtttctgatcaatttatattgtctatttgcaatttgtcccatcttaaaaattcttattcctacatctcttattcagatcctgacttctgcatgtaatattcaattatcttttagcaggtcatgcctctcccttttcccattcagttgacacagaattttcaaatcaatcttccgaaagcacagctgtgatgatgtcactctcctactcaaaacctgtagtacctgtagtaactaaaccaaatctatgaaactgatctaaaccccttcacttggcactaagggctacaacttacctttccacagactatgccctcccactggttcttaagtggggcaacatcactttactgggaggtttatggaaatgtgtgaaggcacttttggttattagaaagactggactgggggaggtggaagttgtgtcttagtgctgattctgagctttctggcctccccagaaaaggttgatccccaccactgtgactgtatcacacaacaaataattgttccacccaaaatccaagggtgcctcctgtaaagaaacaacgtggcttagacagactcaattgtttacttttttcaatttctattacatgtttttccatctccgttgcctagaatgcccttttcgtattttcccaaatgtgcaaatcttgcttctcctttaaggcccatggaaaatgacatttttctgtgggctctccctgtgtcccctgacatgaatccaattctcatgccatttccaccgattcctcccaaacaccacttcctttctatctggataataaattttcaattttgattataaacttaatgtcagcaaggctctacctttattttcctccgtgactagaagaacattgtacaggccagcacagatcctttatgttaatgtgcttaatatcacagcacacaccatgattataaatgaggctgtaaacactttggtttgtaattcattctgagattcttgccttggcctgcatgtgaaactatgctaattctaggctatgtactttaaagtcattatctaattttttaccccactttcccacttgagtttgatggccatgacttctcctccacaaattctgtttcttctgccaggacacaccacctccgattttccttctaataaaacttaggccttaaaattcttatttctcagaactgctccactgagtaccccctaaatccccactccctgcccctgcctcaccctagcttcatggatgctcccagtaggtggtccgtaagtatttgttgaatgaagagttccttggagtaggtggaagaaagtggctgtgtaattggaacaagatacagggcagtgataggacaaaggcacagacatttatttccagtcttagtagctgtgctcatagctgcacccacgcactctctccccacatagataccacaccatcactagaaagaaactggtactaaacttacatttgaaatcaccctagtcagtcttgaggatacaccactcaattattataagctttttaaaaataaaatcacctcatttaagtcttttttacattatgacgcgactgtttgtttccaaagtcttaagagcattttgtgccattccctgaagtgaaaagaaataaattaggcataaattataaaaggcctgatatggcttttacatgattcttaaagaatatggtcattttacattgaatatttgggtcctatattgtttagttgcaaacaaaacatccatcatcatcatcaacagtagatgaaagagaatatgtttgcttcccaaagcttgatacttagaaaattaagtgctttcagttcgcagatatgacaacttctctaccagaaaaacaaataaaaaacccatacaaataagcacatagctttccattttaaagagatagtctaatgctcttactgaagtgtgtgctaaatacatcataacttaatcagaacaagttgctgtttttacaaaatagtcctgtctatgcagagagagataatgccagtcacttcacatgacttgtacttcaacagacaaagtgtcatactgggactttttatcattttgattagaaattgggagtttctacactcccagaaaacaaagaaggaaggggaatagtaatggcttccagcatttacctgccaatgaatataatctgaaaaaggtcattgaggtataatcattcactcagcaaaaatgtactgagtacctactatgtgtcaagcattattcttaggatatatcagcggaacaaaaattcctatcctcatggagtttatggctttccatgctaaaatatgaatacaagtgatctccagtgcatgccctagcccaaatactttgttctttttatatttcacatgcttctctagggcaatcttgactttcttccctacttatcaacacactcaatatatatctcttttagaaattacagattttcagtaacaacttataaaaatattatctctttatacccaaccacatcactgaaaataaattaggtatctctggaagctgttttagccctgtcaggttattggatactacttggtgagagcaacagatagatataacaaagcaatactacatagtgactcaaactagaccgtgattggaaaacttgacttattttagaaccacatattttagaaccacatttctctcttgtgattttggaaaatctaagtacttaggagggtttgcctaattgaatgtgtattcaccacagggaaaataccctaggttttcatcatgatttttgttaattagtgaatcttatttatggaaagaacacttaagaggatctaattcttctacttctcaataatgaaattctctctccaatatttttgtcaaggtacaccctattttgcttttgtttaaacacttccagtaatgaggtgatagctcactatggcttaaaacaacttattctttttctgcctatcctttaaactatgggcccaggactcagcatgaaattcttgatgtggacattcctgtgccaagtatattgaaaatttccttctatttcacaagctaagtatcataaccattttattttatttttcatgtcatatgaataatgtgctagtgtcataacaaggtttgaaggaggcacgtatcacacgtgagcatgaaaatccaatgatcaaacttacactacaaaaagatcaattatttcaatgctataagtcagtccccatatcacgctactgacttatactgttaagtcacctaaattagtacttttaactttctggacttttcaggccacaaatatttttcaaagaagaaggagacacaggaaggagaaggaactgacatagggtgggtatatttttatttttttattagtaaagtaaaaaaatattttttattgattgataaataatttatttgttgccaaaaataaaaatgtaaaaaactattatctactttattatttcataaatcaaatatttctgataaatataaagtagtaaatataaaacctgagaatgaaaagttgaataaatttcactatatgaaaaaaagctaactacactgagctacttttgctatagaccatgaaaatgctttcatagatccaggtttgaaattcattgaacaagagagcaaatgtccctctcaactcctgatgacccatgtgcttttgatgtgcaatcgtttcactatatgctcgtgcaataggttgtatttaagctaaggccctgactttatatttgcccttatttaatttcagcttatgagttttcaaacattagaccattctacctttctcagttttgtgccttacacaaatataaaatgtttactttttcagtattcttccaagtcacttgttaaagtggagcaaggattaagccctatagatcgctttatccttccaccaggttgagtataactgttcacacacctgtagtactccagcaatcatccagatcacatttctctctttcataaaacagacagatccattagaggatctaaggattgggtttcaaaaggcttctagacccacttttcacccaagatttgtttgtgccccccacaaaataccttggtcaactagtcactctccttgtgttaaatgtctgcagtgttgagaaactccaaatcctgtgttctcaataaagtccaattcctgtcaggatagctctgttaaaaaactcttctctatattgagataaaatttgcattcttctaacatctgctcataggttgtattttgcccctcggggcccttcagaacaagtcattcacatcatagtcctttaaagatataatgagagtgattgtgttcctccaggtcttttcctggctaaaaattccctattgcttttctgaggtgttcatatgatatagtttcaactcatgtcactatttcaaatatctctgctaaatatgctccaagtgacaaatcttttttgaagggtgatacctataactgggcaaagctttacagtgtggtcctttgtacacagtaagaaccagaacaactcaattcactgaaacctacgtgaattcaattgtacttaacaaatagaaactcagggccaccctattagctcctcctgacccaggacttaactgactcactctaaaatcaatctagcctatgaattcagatctcatctttggtcagtatctatacataaaatagtcactgtaaaggatttttttctatcagttacagctcaaagtaattatactgtctttttttcatcttattaaaaataagacacaccatattaagaaaaatatcaagaagctgttgccaaaatcatccctgccctctatgaatatagaatgatttatcattctagcaaccttctcactgatttatacactgaacaaatatttattgaacatccaatatatattttatttctgctaggtacaggggatattaatggtgaataagggagatcaaatcactgacttcatgaactttctgtgtgagtgtgttatatataataaaggtaacaaattaatataaaatataacttcaggttgtgatatagactctaaaataaataaatatggtaacataataagtcacagctggaggagtgatttagggagaagggagattgatctctgagaagatgatatttaagctgagtcctcataaagtgaacataaaagaagttgtccaaactgaatccagcagcacatcaaaaagcttatccaccatgatcaagtgggcttcatcctgggatgcaaggctggttcaatatacgcaaatcaataaatgtaatccagcatataaacagaaccaaagacaaaaaccacatgattgtctcaatagatgcagaaaaggcctttgacaaaattcaacaactcttcatgctaaaaactctcaataaatcaggtattgatgggacgtatctcaaaataataagagctatctatgacaaacccacagccaatatcatactgaatgggcaaaatctggaagcattccctttgaaaactggcacaagacagggatgccctctctcaccactcctattcaacatagtgttggaagttctggccaaggcaattaggcaggagaaagaaataaagggtattcagttaggaaaagaggaagtcaaactgtccctgtttgcagatgacatgattgtatatctagaaaaccccactgtctcagcccaaaatctccttaagctgataagcaacttcagcaaagtctcaggatataaaaccaatgtacaaaaatcacaagcattcttatacaccaataacagacaaacagagagccaaatcatgagtgaactcccattcacaattgcttcaaagagaataaaataactaggaatccaacttacaagggacgtgaaggacctcttcaaggagaactacaaaccactgctcaaggaaataaaaaaggatacaaacaaatggaagaacattccatgctcatggataggaagaatcaatattgtgaaaatggcatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcaaggtactggtaccaaaacagagatatagatcaatggaacagaacagagccctcagaaataacgctgcatatctataactatctgatctttgacaaacctgagaaaaacaagaaatggggaaaggattcccttttaataaatggtgctgggaaaacaggctagccataggtagaaagctgaaactggatcccttccttacaccttctacaaaaattaattcaagaaggattaaagacttaaacgttagacctaaaaccataaaaaccctagaagaaaacctaggcaatactattcaggacataggcatgggcaaggacttcatgtctaaaacacctaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaaaacaaacaaccccatcaaaaagtgggcgaaggatatgaacagacacttcccaaaagaagacatttatgcagccaacagacacatgaaaaaatgctcatcatcactggccatcagagaaatgcaaataaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaacaaacccaaatgtccaacaacgatagactggattaagaaaatgtggcacatatacaccatggaatactatgcagccataaaaaatgatgagttcatgtcctttgtagggacgtggatgaagctggaaaccatcattctcagcaaactgtcgcaaggacaaaaaaaacaaacaccgcattttctcactcacaggtgggaattgaacaatgacaacacatggacacaggaaggggaacatcacactctggggactgttgtagggtggggggaggggggagggatagcattaggagatatacctaatgctaaatgacgagttaatgggtgcagcacaccagcatggcacatttatacatatgtaactaacctgcacattgtgcacatgtaccctaaaacttaaagtataataataataaaaacataaaaagtaaaaaataaaaaaaaagaagctgtccatatggccatatgtgaaaaaaacactggtgaattaccaagtgcaaacataatataatgtttatataaacttgtacatgtgtacgtgtatttatgtttataagtatatatgaacatgtgtatacaaatatatattagacaatggaaatatttataagtccttatgggatgtgtgtgaaacaatggtagaatttcacaataattgagaaaggatcaactatttaatatatgatggtggcccaaatgtcaacactactaaatgaaatgatctctacctcatgttagacataaaaatatatttcagagggaataaatatctgtatgttgaataataatactttactcttttaacaacataatgtgggaaatatgtgacaaatttgttgatagaatgtcttaacgaggtacaaaaccacaaaccaggacacccagtaggtgctccataactatatattaaaataattaaaagataaatcatatgtttaccttaaagttcttcaaatcttctgtgactgaaaaattatttaaaaaatatttcaaaagacatgggcaacagagatatttttaacaaacctaagcaaattaattacaaaatacaacctaacaaaaatcggaaaattggaaaacgatataagcaagtcaccgaattagaaagccaaatagtcaataaatatttgcaaaaagaatgttctcactaggaatcagaaaattacacattaaaaccaatgagagatacttaatcctcttcagattgaaaaggcattttaaaaagtgataaccttgagcattattcacaatgtgcagagatgaaaacacttaaagagtgttgatgggagtatatttcattcaactactttagagacctcattgcagtattctgttccctctggagtttcatagaaaattgacatcagttgggagatctcagctgcaggtcctctagatcccacttttccagcttgttcttacttgttaatcaacattaagtccaaagaagcagtttccttcacagtttccttaatattcttagagatgaaattgtcagcaaggcaaatcaataatttaacacatgccctactttttgtagactgagaatctcaggagacgtccagagacttaaagtccctaatctttgttatttttctcatccttataacatttgtggtctttattaggaagtatccgtattatatcctgcttcttctcagataagagtgtttaaaatttctctatgtgtatcttgattcatggcttcaaaaccatttgtcatgtagaaataattccctaaaagtgtgtcactcttcagattttaagaaacatctgaattaccgacaagaaaatatttcttaacttttttcaaaccgataccttctttgataaaagaaaaaaagagtcaattctttcagctgatttgaaatttcaaaataaataattactaaaaataaatcaaatcatttggacaaagcacctttgcctcaggagattccaatatggccacttaaagaatgtcagtctttttctctactctctttttaagaatcgccttaggacaattctgtcttccatgcttcaaataaacattttggctgggcacggtggctcacgcctgtaatcccaacagtttgggaggccgaggtgggcagatcacttgaggtcaggagttcgagaccagcctggccaacatggtgaaaccccatctctattaaaaatacagaaattagccaggcatggtggcgcatgcctgtaatcccagctactcaggaagcagaagttgcagtcagtcgagattgcgccactgcattccagcctgggcaacagagcgagacctggtctcaaaaaaaaaaaaagaaaaaaaaatagtgtattttcatatgcataaaagcattaggaattatatataattttacacacaaaaagtaacttagttgtcatacctgtggacacaaggtttccaaatgattggctgcaattttgacaattttaattccatcttcatttgttgacatggaacaagcaagatttgccaccttaaatacaatccaaaataatggaaattattttagattagcaaggaaatgcagcaacacttatactgaacaagaacatgtacacattcatcaagaatctcaatgacaaataacattctcaaaatcatcactggtatctattttatgaaagaattcagagaatctattaaagcaaataacaataaaaggacctagataattgtttaaaatgaggagagactagtgagagaatcagtaaaccctatacagtctcttggtatcaacatctaacccataataagaagctattgtgagactggaaaaacaaaagtttatctgtggattgaatgctaataggtttttggaatctcatatgattgtgatttattttaaatttgtaattggtttattatttcccagaggtctattactcatatttaagttgcattaagtatgactgtatctttatacattttgtttgcatcaaatatactacaaagctgaacaaatacaagataattaacttcttcctgctcttgattttccactacaacttcatgggcactgtttgacattcctgcagtgcatttgattcaagcattagtgacacccaaatttctcttatattattgcttttgaaatttacattttcttccaacaaaatgagtgctgttttaattaccattatgtccatgacctaaatccaaggtttacaaatactttcttcagaccatgaaagagccatgatgaagagtgagaggttattttcccttcctctgcaccccactcttgttcaagattcttcttactaacacagtaaggcttatggacagaggcaatgttttctctgatctacaaaatatctcattgtctttatcattgcaaggatttactttatctaacagtaatttttctaacttttaaaatatctctgtcagttgttttatactttaacgcattgcagtttttcctgctaagatctaaaatacatccagttgcggagaaactacgcattagccacatgcagtggaaataaacaacatatgactttggatcactattttaaaagtaccacaaaatgttatttaaatggatttacagtctttgcttttttataacatttcttttaatatgccaatagtgaaataactcctcggttttcattcacatataatgaaataacagccatacattatttaactgtggaagggcattgctcactttattaatgtacatggggatggcttacttgaaaaggtcttttgttggcttgaaggtcacaatgcctcaactttcataatttctgacacataattagcacatttgtgagttgtttgaaaagggcaacagtttctgtgcccctttccactccccaaaccccaatcactaaaagtgaaacttgacagtctaattgctttaatttgtattatattaattcacactgcatttgcaaaaaatactgacctgtaaaattgagcactgtttgtttaaagtaaaaaaataaaaataaaaataaaaatcattggctcaatgtggtcaaattagaagaatgctggttaacccaaagcttagaaattataaaaaactggccctatgtagatacttttttattttacttacttatatttactgtatcctcattttcttctttttccttttgaaagtatacattcttcttctggatatttgctggccaccgaggcttattaaaagccaattaagtgactgacatagtatagaaattatgttaaacacagtgtgtgtttatattagcagaattaattttatacaaccctctaatgaaaatacaacacaactgaaagttgtgttttctactcaaagttttctgctcagtcatcatactaacactctttttgtcttcatgtattctatgcctgcacatacttgaacttctccttaccagaactgttctgtcaaagttactaggtaatagagtatatttcaagtcatgtgcagttttagtgctattgtgtacaaacaaggtcgaattttaagataagtaatatctgtgacaaaacagaaaagtgttagaaataaaatatctttacatttcaaatttgaatgattttatgacatattttctaatgttacatcagtgtgtgaataaagccaaatttcttctaatgatgattcttcctaaattctgcatggctctttagtcaagtatgttcccaagaacagtagaaatgtaattccctgctggtcaaagaatacagcctgcaaataagatgttctgtaaaaatagttttagatatttggacatttgatatcctttgtgtatctgcgcaaaatgtgggcaaagctttgttggtattcataagatctctgtagaatgtttctgctcactgagggaaacaaggatatcgggagtttttggagacaaacagatttgggtttgaacccagttcctacagttaataagcttctgattatgagcaagatattaaattatttgatcttgttttgtcacctataaaatgagtatgataatgatgacctcactgggatgctttgagaattaaacgagataatgtatggggagagtctgaagcctggtggccctcaccatgtatgaattgccttccatttaatctatctctcaactaatggaaagaaaaagaaaagaaaaaaagaaatttcatactctcagaggttttgtagaattaaagccttaggagcctaaagaaatttaacaatatgtctgacccaagagccacaaactcaaatgctttcaagagccatgcaggggatgggatacaaacattgagtctagattgaactcagtagtaggctggggttgtgggtccccagacaaaatgattatgtatgccctactgaaaggcattcattaaaacgagagaaatgaaaggaaaaactcaatgtcttagccaaactaacagtctgttggcttactttagttcacaggtcaccattttgtgacatttaaccccactctctaatcttatattgtataaataagaaaacaaaattaagcagggggatgaaacatactcaaaccaaccaatggcagggcgactattaactagcaatatgtgtatgtcctttttgctaccctgaagaaagtcttgaaaagcattctggcattgaaatgattgaccagactttttattggtattttgctacatccttaaccaagtctacaaaaagcagaatctaaattatcttaaataaatgggacaaaaggtagttatttaaatttacacatttattgaaaagaaaaacctgggacaaaatgttctttcatttttatgaaagattaaattacatccttaaaataattaccaatattgtaataatttaaaaacaaacaagaagtcttcaaacagggatatgtgtcttgttatgagaggagagtgaagttttttattagcatccctctcttgcagctctttccttcccaccattccttctgccctctaaaatgtatggtatattctaggccctttaaacatggctgaccttattgccctatttgggctctaaaaaacattgtagatgagaatgcctagccagacaattcctcagctgaacaatcatgttaatgtttgttcccttccttctggttcctagttcaagttcattttatttacttatttatttagagaccaagtctcactaggtcgcccaggctggagtgcagtggctcgatctaggctcactgcaacctccacctcctgggctcaaatgatcctcccaccacagcccctcaagtagctgggactacaggtgcgcaccaccacacctggctaatttttgtattttttgtagagacggggtttcgccatgttggctaagctggttttgacctcctgacctcaagcaatccatctgcctcagtctcccaaagtgctaggattacagccatgtgccatggcactgacccctagttccagttctgtatactagttagtatgtttctgtcatgatttccatttgctggactttgagtcttttctttcactcagcagagaacatagtatccttcactccctaacccatggtttcaggtgagaaattccctgttgtggagcctggccttgtagaatcctgacacctaggctagttctgtccctcactctctatcaaggtcaggaggatgatcaggcttgaaacaaaaggatgagtcaccagtggtagagccagggacggcaatgaaacagatattttgagatggaaaattttttcaatgaccctttaaaaaagatctaccatactataggttaagtctgcttttcatcattactttgttctaatctggtaaagatattctattttaaataaattgaatatcagagcatggtatgttttaacgttctagtattaagttttatctgaaatctcaggggcactggtagtgttctcagtcatcttagaaaactgaaatgaaatcattgttaggaatgagtacactatttggacagctgcttatcacatatcattcagtctgtcaccaagaagttcccacacaggtatttacctgtaatatgatctctccagaacacgaagcaaaccttgatgtttgctgagattttcattgtcacacattcattgtttatatattgttcatatagttaattgtaatatcatgtcaccacgtctcctagctctcaatgggggagaaaggtcactgtctcattttcatgcattttcccatctggcaattggtcatgcaactcttgtgtaaatacttccagaggcagataatttattgtcttccagggcagtctagtcccattgcaggacagcccaaagttacaaagttacacaagttatgaagttcttctttataaggagatgaaatatttctctcaacaaatttctcctacttgttctagaatacagaatggcaaatatattcaataatggaaataaaatggggcctacaaaaaatccaaatcaatagtcctcaacttgtgggataagagagatggtaagagtaatagaatcaccagtaaatagctattaaaaagaaaagtccaattcccttctgtcaagatattctgatacattaagtgtgtatacgcatggaagacagaggtgtaaggactgtataattagattttttaaaagttctcccaggtgattctgatataccacctcccccatctccaacacatacacacacacaacaacaacaacaacaacaacaacaatacacacatgacaacacacagatacatactaggattttggttaattttcatgtgtttgaatagacagtctttcccgaagataaatgtactgaggtgaaagtctaaaaaagaatgacctgaacatgtgtgggttagcgtaggaagtttaatagaaagcttcacacattagaggcaagaaataatgacttaaacttctacttgagaaatagagaaaaggctaaaaattaaaataagaaaatcaagtataggggatattctggccttccatccaaaatccattcctccctttggtaataacactgatttccctcggagaacagttctttttctaacctagtggtgtaaagtcttggtacgactgtcaatcaaggatcctggtcctcccctaggtctagcctgggcatatcccttacttactagtgccacctacagccctgaatcactctttgttctgtcgaatcttagccttctttcattctgatttatgtgcattaccttatgtcttccataaagtctttatttctttttaagtaagccaaatttattttcctttgcatacaaccagagaaccacgattcttagtaagtactgagccagaaacttataccctaagaatgtactaatctcagatggatactttcaacaaagttgaaagctggtaatgtataaccataattatttctgtgaaaggcaacttctcattaaatgcctgcctctgggtttagtcagcctgcatgtcctagtgttaggaacaaatgtaaggaaggagacagtcatatcagttcctgcacatacagataagtgtcttcctttgacgatctaattcttcaatgtctattagaacatgttacatatcaggtacaagagaacatctaattcttgaagaaaataatttatcatttttgagtttatctttcagcaagctgctcattctgtttgaaaaccacccctcacatactctttgaaaatcatacctatacttcaaggcctggatcaaatattgtctcttccacaaactcttttcagatgcccaggatccatatctttatcttcccacactctcgcattatagcgaattctccttctctctaaactcatttatgtatctatcagatggtgagctgcttgagggtaaagacgatgatatattcttttaaaaatattttcccatcaagttaaataccccgaaaatagcatttcatctatgtaaataaataaaaataataatttatctctatctggaactgaatcattgttaatataaattattgtctattgtgtctgaaattaacacatttggtgaattctattttttaaagtcctgtgtacaacttaatttgttcgttggaagctgtgtcctttcttccactccttcctaataaaaatgatcctaattctgtaccgtatgaatataaaggtaagaattattgctttaggttatggggggaaacacctgagaaaagaaagtccttaggttattaaacttaactgccccgagtggatttcagtctgactgtgtatattcattggaaacatcaagattagacaaatctgtagcaaagatacaaataaacagagaaaaactttgaatatgggtgtggaaataatctagctgaaatgtgttatttatttttaacttgtattggcaaaggagacttgggcttctttctgaatttagaaataaatggcagttcataaaagcttgtgaagaagcatgaagaaggaaaaatggtgtctatgccccttggacacagtagtaagtagcaaaactacaaagtcactagccaaatcactgatagatggaacactagaagttcttcaggttggtaggagatagcaagagttgaatcagatactttgagtttgagttgccactgagatacataagaagacataaactacatatagttagatgtgtagttaagagggggtctacagtagagatattaattaagaagttactagtttattgatggtaattagatatgattatgtgaggagaaaaagttcttggaggtatataagatattaatatttattaggcagaaacatgaggttactccttcaatgagacttagaaaaagtggccagagataagaaaggttgcccacaatactgtgatgtcatggagaccaggagaagaaaaggtttcaagaggatgatatcatatatcaactgctgagaggtcaagtaagttatccctgaaaatatccagttcagccacagagacaaccatgctaatcattcctagagtgttcaagtcaaatgatgatggttaaactagtctgacatgaacagaggactgtgtatgaggtaaagtaaccccatgagtcttatgactcaaggcagagagctacaggtcgcctggataatactcactctctcattctcccatctatccattttaaaacattttacctctcagtaatatctcaaatcatgtattaggttggtgcaaaagtgattgtggtttttgcaatggcagaaactgcaattacttttgcaccaacctatatttttgctgtcctctaccctagttaagattttgatcagttttatttattttattcttgtttccagttttagcttttgttgtcagcaaatgttctttctctacaatatgttcacattgcagccaacaaattttttcagatgcaaatttggttcccccatcatcacctttccatccccacatcatacccccatccctactacgtcttgcagtctggcctgagagtcatcatgtgtagttcttgttctctctttgcttcagctatatcaatgtacttttatgtatcaatgcttgcttctgccagaaaacatctgtacatactgttctctgttggctggaatgctctcttcctcccttttcacagccaccttcacaccacttatacttgcttaactgctatccatcagatctctgctcaaaagtaattccttggaaagtttttcaccaacactgtcctccacctccacacagaatacctgaaacttctgcccacctaagtcagatttttccttcagagcatgattctcagtttataattatatgttcactgggaagattatttgattagcatacatttccccagatttataaaagcagggaccacccctgtatttgctcatcattcagcctacagtgccagtacctgacacacagtagacagtctataaatagttctttggggagtgaatgaatgcatgaatgcctgaatcagtatgcttgagaatgtatcatcttcttgatgaacatgagatgacaaatagaagaaaaatgggttttaagggaggagtcagcagcagaaattcaggacaagaaataaagaggaatgaaatttttcctttgaaattcattttcaatattctacaaaggcttagacaactggactttcaagaaaagtacttgtttttcttctagtctggccatcatccttaacaaggcttggggggcagcttctttcaagttttaccttcacttaagatatcaaatatggaactactgaataggtcccaatttagcttttaatttatttatttttaatcaagtaaagtaactcttaaagggcccaagctggatgccaaatgttggcaagtgtggcagatggaaagaggcacagtaacttccatagacaaatccaagagcttcattgtctatttcagaatgtaatatatgctctgcttctgataattgcagaaagagctctgatctccccatgttggcaccgaatgacctctggctaacaagtcagcccttctctttctcctagtgaagcagcgctgctctgcttcccttggtagtaataagaaatgattatgaattatgggttctgtagaatatttaactaatataactgtgctgtaaaagcacatagcaaattgcagggaaacaatttcatcaactaacaaatattgattatgcacctattatgtgggctgggaactgtcagggaaatgatagaagtcaaaatcaatgaaagtgaatcccaacaagcacaatctatttaaagggacacgtgaaaggatcaaaaactaaaactctgtctccaaatactacaagaagatagaggtaggtgaacttcatagagatgactgtagtaagagtgttacatggagacaaattattacttaggaaattcatattctcttgaactttgcatctcaagctgcttcccaaattttatgaatcctcaatcacacaatccggtctctgatattagttttgctttacctctctgtctttggtcatccatctataagatgaggaacagattgacttcatttctagacctctttccatttcaataattttgttttactgcttatgtaactgataacaaaattagacagaaattagacaaaggagaagagctatcaggcaacgttcctattaatttaaacatgaatttgtagatgaaatattagccaatttaattcaactgtgtaataaaaaataataataaagcaagacaatgttgtttattcccagaatgaacaaatgactcatgactgagagatctaatactgaaattcctttttgaactggatatcaatagatttttaaaaagcattgatgacaggtttatgcctattctgattaaagcaaagcaaaactacactaaaaaacaaactcaaaaccttagcaatctatgaataggaagaataattcttaatctcaaacaaaatccagaaatttccagcaagtgtcatgctcaaaattcaagattaagataagcattcccactataagtgaggttaatcaatattttactcaaggttctagtaaatctaaatgaataaaaaaaagcaatagatgcaaatattgttaacaaataactatatttattcccaggtctcaaaattgtctacctagggaaaacaagattatctgaaaactgttattactattgagtattcggtaacacttcttcatgcagaatgaatgtgagatgaataatatatttttctatatattttaaaagttttcatgacaaaatttgttattatagcaactaaatattataaatttcatagcagtatatatctattgaaataagcacaattatagatatgtgtgcatatctatagatgtattaaattttacttaatgatataaaaagagaatggaatgaatagtgagaaatatcagattcctggatggaaaaactcagtattgcaaaatataatgttatctctcataaaatttgtctattaaatttatagagctatactgaacttaggtaaattttaatgtgcatctggaagaatatatgaaaggctggcaaataagttttataaaaatggggaatgggctgggtacggtggctcacgtctgtaatcccggcactttgggaggctgaggtgggtgaatctcctgaggtcaagagtttgagaccagcctggccaacacggtgcaaccccatctctactaaaaaatacaaaaattagccgggcttggtggcgcatgcctgtaatcccagctacttgggaggccgaggcaggagaatcgcttgaacctgggaggcagaggttgaagtgagccgagatcacttcattgcattccagcctgggtgacaagaatgaaactccatctcaaaaaaaaaaaaaaaaaaaaagaatgaagaaaagtattatgtgccagtaattaaaaacacaaaaatttagtgtttttcagggtaatggtaaaaaatattggtgatggcccaatttcctgctctctactttcaggagaaaagtgcaattatgtaaaaaggctagaatatattactacataaaaaattttaaatgtcaaaatattgaaaataaagttaaaatacaaaagataggcaaaactttgtttttatatttgataataaaaattattatccacaggtataaatagctcctaagtatcaataaggaaaaaaggccattaaaaatggacaaaatatttaaatagagactttacatatgaaatatgactaataaatacatgaaaagattctcagtctagctcttactaagcaggatattcaactaagcaagaaaatcacggtttttgctcatcagatcagaaatatgtaaaaagtttttgatattatccaatactgctgagaatatggggatacaactggaaggtaaatggccaacttttcagagagcaatttagtttcacctacgaaaatttaaaatgttcagaactgtagcaattcaatttaatggaatctgtcattcagaaatacttgcatatgtgaacagactcacagccacgtgaaaactttatttgtaaaagcgaaaatgaatctaaatatttaacagtggagaataaattatgtaatattatgattctgtaaaaaaaataaaatgttatgctgctgtaaaatatctcaagtatataattttaagtgagatactgcagaatggaaaacatgattctatttaaaattatttacttacatgaccaggtgcagtggctcacgcctgtaatcccagcactttgggaggccaaggcgggcagatcacgaggtcaggagatcaagaccatcctggctaacatggtgaaaccccgtctctactaaaaatacaaaaaattagccgggtgtggtggcgggcacttgtagtcccagctacttgggaggctaaggcaggagaatggcgtgaacccagaaggcagagcttgcagtgagccgagatcctgccactgcactccagcctgggcaacagagcaagactccatctcaaaaaaaaaaattatttacttaaaattatgtataaatgcaaagtataatgtccacagtgataattcctactgttaatttgagttatatatgggagagaaggtaggattactattgctatgaagagaagtatccccttttgactatgtttctatatcgactgaagtttttccaagtatatttttcactatattaacagtgaaattagttttctaatttacaaaaaaacgcgattgatgaaatagtcctatatgtattggtgtatatggaacacaccaatgacaagtaaaacagcatgtgtaataatctcatttatgaaagatggtaaggttttgtgtatgcatatggaaatgtgatatccaaaatgatcctccccaaaatggcaattgtgatgatctctgaggagtgaaaatcaaggtaatttcaactttccttttctatattcttaataatttataatttggcttattataataaaaatgaatcattttgaagagaataaaacctatctatacctgtatgtgaatttttaataccaatcaagaaaattgtattaatcatgacacttattgcgaagcctgaagatacagaaccatttataaataaggtttccagaaaatacacatatataatgattacatagaaaaaaatgctgctaagcagaaaatagttttcatggtctcatatgctgttatatttaaaatgatgattcacaaaaatgattgagaattcacagtagggaaacaaggcactggttttaccttgtcttaatgtcaaataatggcacaaaaacaagtcaattaaagcttcttatcaatgacaaaatcataccagccaatattgatcttaataatgaatttaaattcaacatgtttggaaaggtactctgtgcatggtgtgtgtgtgtgtgtgtgtgtgtgtgtgtgtgtgtctgcagcagatataaggtaatgattcttatgattgaataattataacatggtcctacatttcttcctttttcctatcttactcacacctccaattctattcaaatttgtgtctgaaattcttgtccctctcaaataagtcattaaagatgaaaatattcatttgtctaagtggacatatgtcaacattgttctgaaaaagaggtatcagtatgctgcgtcagaatgtgccatcacaaaagaagcaattgagatgaaaacacacatacacacaaactcaaacatatttggctgttacagtattattgcttccaataaattatgagaaatatatgttacatagctcaaattgaagtctgcaatgtagactgctctaagagtcccattttgccaaatatatttcccttttagtttggaacaatatataactgtaaatggacacacacacctcatattgctgtgtgatgtaaattataatggtaaaaccagctagatagtttattcaaggtccctctctaaattaagctattattcacctcagaatcaccactcaaaggataaaagtatgtgtcacctgcctagtaaatttaatataataaacagtaccaaataaaatatattgaagtaccaaagagatgaaacaaatctaaactataaattaaagacaggattaagtgttgtttcctaaactagtgttattctttgttgtcactgaggtcaagaataaatatgaagcatgcaggtctaataagtgtttattaataggatcattgtggaaagggtagatgtcaaaacaatgctataattagctttcattatcattgaaattgctgtcaaatttcaaagcaattttatgaccagtgacctgatttctcacatggcagaaagagaagggattttcttaaagagagatacaatatattaaagccaatataaagttttcagtgagtctatttctgaatcaacatgttttgtacatattgcactgttcaaatgctatcatgggaacagaaggtgttgcataggacaaagttaattgaattgcaattgtgtaaacttcctggatgtggatgagaccatcaatatcacctgattccctaactaatcacgaaatacacacccagattcattccttactttcacaaaagaacgggtctcttagtagaatgacagtaggcaatcaatcatctggcaacttctatcttcgaagacatcataacaataatctgtgaaactatttttttcctgtaggcatctatttattatgactttgaaggaaataggcaaagaagctttgaaatttaccataattataatcccagagaaagccccttgtctctgagtataaattgccgataatgagtgaaacaaattggaagaacactgtgtgtgtgtgtgtgtgtgtgtgtgtgtgtgtgtgtgtgtgtgtggagtggaagagaggcaagcacatttgtgtatgtatatatgaagtccgagcaaaatttacaaatatgtgcatgtactattattaaatactatgatttcatatcccctcattcttgggtccctgaatctcaggagggctccttgaatgtgttctgcatttaattatatgataaaaatgaagtatagctaattatgtaatatagaattaaaagaaaataaaatatttaggccctttaacgttagcaggggcataagctattacaggtttaatcttaactacccctgtacctctacagcacactgaaatactggacacatactgtgagtagtggccattactagaggataggataagacacttgcagtgtaatcttagtaatttttttaaatatatattatttatggttcctagtagttctagaagggaggagggaggagtaagaagggatcttgtatactaaccttccataattagagcaaaccaacatatgaattctatttgcacaaggttaaattgtgaaatccttgaagacagaaaccatcttactcctctttttggttctaagatattgcaagcagtgggttcttaaagcttctgttgaatacatttaacccaacattgcaaataaaatatttttcacgttgtcttctctatacttatttatgattgatctctttacagaggcctaaagacaacaacaaaatccacaaatatttattatctatcaggcatgttccaggcactgaaagaaaaagaagagaagatggggaaaaagtagttgccatgcttcaataaatgagagatttagatgtaaatacacaaaacatttagagctattaataatgaaaacatttaaatgacagtgtatactatgctaaacgagtaaaacactaaatgctgatgggcttcataataaggagataacgcagtgaagctttaaaaaatgttagctggatagttttaaaaagtcttaaagaaagacaatttctatatatcaattgaattgtttaataaaactctaaaaataagactgtcatataaaaatgtgttgatagaaaacatagaagttttaatattaataaatcccagtaacagaagatttttggataaatcagaaatgtttcgtttaaatacaaattctctttaagaaatagtgaatggtctaatgaaaactgttattgcaaatactgaaagttacattgcatgttattttatttctatccttattacaatacttcctatgtatttagttgttttcaattcttatgtcaagtaacatgaaacttaaatcaaaattcaagaaagcaatgctgcattcaaggtagctccatgcacatcagccacatggcactacatggttgcaccagccaggcctggattctcaccagcattgctcaaaggctctgagtctgagtcacaggagttggagggcatttgccatcaactagtccagtttttgaccctgtttcagaaggctggcttgcttgcactgcacctggagcctttcaaaccgttgtcaggctcagcctctgaagaaagaaatcccacagcattctggctttgctcagtgtatgccgttttgttccagaagtcaggagacaggttgcttccttccccagctcttgagggcagaggctgagctttctcacctatgagatggtaaccttaatgagcacctcccccttgggacacagagtacaaagcgtcctggatgctcagtagccagaaacagagaatgccaataaaagcccagttcatttttcatcacagaagttagagtcctaccctcaccttcagcctctgactactatggatccctcctgcccctggctgccagtctttggaaagcacacccacaccttgttggttaattaacactaatgggcagctgccatccctgcataaaaccacaaccatggctggattacttgagggctgattatgctgtttgtccaggcacaatgtttctcttccctaacagcctaccctttggaccctgatggctcattatcaccttccaccactggaagaacaagacaagactgtcagctgcgtcacttctcacatttccaagaaaaagcttaaatctaagcaatgccattctaggcgttctctgcaagggtttttagcttagcaaaatccctcttgcaatctttgttcatgattttgtctcaaattctgaattatcttattaagaactggaaactgttcctgcaagtgacttgtttttaaatttgcttttcagacatctctaagggttgctggcaactcaagtgcaattcgtgatttcctctttcccagcacattctatttagcctattaatttcaaatgaatgtattttccctgcatcctctagaagcggactttaattgaatataatatcctcccgccgccgcccacccctccgccgccccaactctagaagtggacttctgggcgggggcaggcaattatattcaattgatattaataggcttaatctattcacttgaaattaataggctaaaatctgttgctctttcttttcccataaatagactaatgccagtccctgctgtcttcctccattcatcttccacatcctcttttttcaaggcccacaccatcatcttcccttctctgaaactgaattcagtctctacataatcaatgtactgctgtgatcacagctggtactttctggtatctccaggaatcacagttgacctacctttgttgatttctgggctctgaactatcattcttttctcttttctcccccgcccattcgttattcttgtcacatagtttctttcccttcccactagttatcccatcttgtagaatacaaaatccctcatacttttcctctcattctgcctttttcacatcactgtctctgtggtaaataaaacataacaaacaatatgttttttttaatctttgcactttaaacatatatttatgtgcagagaaataaaaatatatttctctgttggtgaataattcatttcctgttgctttggaaatagagtctgtgagccaggggctagttttatatctacgtttagtaaattgaatagaatattttgctataatgcagtaagtgtacctgaaatcactgttttgggagccacaaattcatgagggaaaagcctcaaaggctatggtacattagttgaaccatagaaaaagaaatcaattataattgcttctccagttaaatattatgagttacagtgagtatttaagatagttttgaaaaaaacattttattatttcaagatctgcatcctagttacagtggccatttttattagtgggtccaataaagtattcgtatttatccttgctctgttagcaggtgctgatgaagtagaggttgcgctatgaatataggaagcagtatgatttgaaaaaaggagaaatggcagtataggtattggaatccagacagaatgaactttatttactgttatcttatattttactcatcttccatgaagatgactaacccaaagggattcatatttgtggtcccctcaaatatgtccagttagtggaaacacatcacatattttagagtatgactcaataatataactttaaatccttctaactctccactctttcatattctccagtaaaaagataaaacttgaagtatttatttagaagtcactatgcaacactgtgctttgggagttcataactaccttaaaaagacataatctgtaacaagaatcattctaatactgtgtgtccttttatgtttaaataagtatgcatgtaaagctaaaataacatgaataaatttaccaagtcaaagattttacttcatatatgtcacttttaattcattactgtagtcattttaaatccctaggtaagtttaaaaaaaagacttgtttctcttctacaattatactacggatgaactgtgcacctctctctctctctctgtctgtatagctacatacatgcagatatattttactttaagtgttcagaaatcttattatttcaaaaggaatatgtgcttaattaaaagttttggaaaacactgttaaatacaaaagagtaaatacacaaaatacacattttcagtgtggcagataaactcacccaatgcctactctcaactcctctttcctgtgtcttttctcccctctattgcatatcacagagctctggccatatctcctcttcatattggatacatccatctttcagctgctggggataactgctattgaccactcatggcatagtcgttcactaggaactgtcctaggttgtaggaaactaccttccccaaggcaatgtctcttcccaggggaagctcacaattaatgatggagtgagttgggattacaaaggcataggtcccttgcctctacatgtgacaattctgaaaggtcacctgagctccagagtccctaagagttcaggtaaggtttcagttgcaaccacattcattgtaagtcagctgctgcttctacccaattctacctttctcccttcattacaggcttatctctgaagattactccccagtaaatcttcaggatagaactatccgtatcaaagtatacttacggggagccaacttaagaaaatcataatacccagcaaacagaatactcattttttcggtctcctttattgctaggctgaaccatgtgccaatgagattaggcacagttccccagggaagaatttttccccccaccattagtagtcaagattcactagaatatattcctttgactttttcccctttgttctcctcccaactgggatgcagacaaaataccaagagggcagacataatcttaaaactataaagataaaagcgaacaaacataccaagcatccaaaagatccttggaaacatcattgagcaaatgaacgcatgctagcaatcaccaacccctcaactttttgacatgggagaaaaaaacaaaaatcatttttaaattgattgttatttgcagccaaatgcaatcccaagtgatacaattaaggaaccactctatctagaagtatatgtatatatgtagtagagtgttgtttataacagcaaaaaaatgaaactgtcatataagtgttaagttatggcctatccttaggaaggaaaattatagtcattgcaataattcctttgaaaaatgaagttgttgagaaatgctttttatgccatattaaatttaaagatataaattccaacacacatagatataactacatatagccaatgaagccaccaatcttgtgacacttctttgtagaaaaagaaatttccatgttgtagcatattgcattttctaaaaatggccagactaatattatgtctcaacccacataatctccctaaaatgggtctacactctttccattgaatctgggtaagggcttgtgactgctcctaacccacagaaactataagagataataaatgattgttgtcttaagtcaccacattttgggatgatttattatgcaccattagatgacaggaacagctgtgtgttatctttgttatttgatcttttgaaatatagtttaacttggaaactgaagacaagtttattcctttatttaaaacatatttaatatgtgcttactgctctttttcattgtgataaaaaactttcattgagagagaaacatctcttaatattagtttgtcaggtgttagaatccaggacccctgccctggaattgttcatgagtccaagcagttgtaactgcatctagcaaataatggtctgctttgctgtctccttgttaaaagtacttcaaaatgtatgcaaaatatgtcttatagccagcaggcttctcattccttgctagggactctgtaaatgaaaaacaaaacaaaaaacccaaagctacagcagaacacatttgaaattatgaatacaaccataaaaatggcaattctaaggtaaggtttgagaatacagaacttatctgagcctgttgccttcttctgtgcaaaagaaccattatagataaacaggcagcagatagtcacaattcaatgccatgatatgtggataaaacgaaacaaaggtcgagaaattagcttacttccagatgttctttgggtcaggctcatctatccctaacttctcatatgaaagttaaactgccacagcctgaaataatagataattgaaattctcattttcttcagaaaattctgcaattaaaatgttgatatttctttaaaatacacacacacacacacacacacaaacacacacacacacacacacacacacaaaacctgatatcaaatcttacattccctccacccagaaaacatgactaggtcatttaaacagtacttgaatatattcacagaaaatcagcaggtcaggtagaaaattactcaccctacacaccagttgtgtgagtgttgcagagtatgaaccgctgccaagatatctgtcattggcatatctccacttttcaatttgatacaatgtgtttaacctatcactgttattcagtgtactataactgctatacaagcacctgtgtgtttaccagagctttactattcccttggctagaaatatttccaaacaaggtactaaatataaatgcccgccattttcaaaaatatatatatataataaacattctccaaatattttaaaagcctacagttaccaataagcttttgtgtacataaattagagaataaggggcaaagaaaactttattagcataccattaagtacttaatttattatttttgcagtgacatccttgcaggatttcttctttaacatgaaaaagtcaacatcttaactgttgaaggctctgctttagaatcctaggggcatttccagacaagttctagcgattattgtgaaagtacctgtttctagaccaactctttaagcagaccactaaaaagaccttttcaaatcttccatgtaaaggaaagccttgaaagggagagagctagatagatacatagatacacatatatagatagatgatggagatagatacagagaggtcagatgataacaaagatcagattataacaaacttaaatgtaggtgctccagctagctaacagagaataacaaatcatcacacagtttagtgacttaaaacaattatcacataatttacaatctaaacttgtaaatcttgtcaacagcaatcaggagtccacattatcctttaaaccaaattttatttccaagtagaaaatattttcttatttaattgtatactgatctgaattcaatgtatcttgtacatgaaaatagcaacttggctctgctgggtaactgaagaccatgtttgtgactggaagcatgttattaatctacttaaaatcttcattccttaataaaatctactccctgtcaacatttattttagaaactgaaatctttgtgagcatagctatattggcatcataagctctaaatggaagactacttaagggcatcttcttatttctagtagagttaatatcattactaaccccaactattctgatgaaataggtatctagcataaacatcaatcatcttcttttataactcattgataattccccatggtcccttgctctatttttcatctgttgtaacacataaaggggttcaacaactactttattctaagctttctctgctgcaaaccgaaggttactaattcacttcattaacaattacaagtatttgtatctgtcctcacaaattcaaaattgaccattttataaaagacatatcccttctcttcattctacctttgttaggtatatttttctatttccaaatatttattttatttccaaatcatgattcattcaaataagttttacacaaagaagaaagtacaagatgtgtaacagctctagtagagaacatttcagctgtgccacaaaaagaaaacagcaatataatggtgtgctgacaaaataggccaggcatggaggctcatgcctataatcccagcactttcagagaccaagacaggcagatcacttgagcctgggagttcgagaccagcctgggcaatatgacaagcccccgtctctgcaaaaaatacaaaaattagccaggcatggtggcacatgcctgtagtcctagctacttggcggggttaaggtgggaggattggttgagcttgggaggttgaggcttcagtaagccatgatcatgctactgcacactagcctgagtgacggaataagagacttggtctctctgtctgtctgtctgtctgtctgtctgtctgtctctctctctctctatatatatatatatataaaataatactttacatatattatatatattttacatatagtatattttacatgtgtattttatattttacatatatatattttgagaccaagtctcttacttgatccaaacccccagatcccccccaaatatgtatatatatatatatgtttatatatatatatacacacatacacaatatattagacactatgtaaatgtctgaaataaattttagttgggttctttattgagataattacaaattcacatgcagttgtaagaaataatatagagacatcccttgcaaactttatccccgtcttacaaaatgttaccacatcatccccctgtggtaacattttgtaagactatattttcagggtcttgacactgatataactcactgatcttatttttctccagttttacttgtattaatttttcttagtgtggtatgggtgggtgtgcaataagtctatacaattttgtcacctgtgtaggttcatggattcaccaccgcagtcaagatgttgaacagttcccacaccacaagagtattcatgttgcctttttataactatatccatctccctccttcaaaatcccacatcctcctgctagctcagtgcccccacacaaccactaactattccccatttctaaattttattatttcaaaatgttttataagtggaattatatagtatgtaatcttttgggatttttttcataacataattcttggagatttattcaacctaaggtgtttatcaacagtttattcctttttattgctgagtagtattccatggtatatatgtacaatacaaatatgttctcccattctttagcttgtaattttattctcacatggttttcacaaagttagcattttacattttgatgaagtctaattcatcaattttttaaattcacacttcatgattgtggtatcaaggactctgcctagccctagatcccgaatattttttcctattttgttctaaacattttgtatttatattataattttttaatattttacctttgtctctgatccattttgagtttatttttgtgtacagtgtgagacttcgttcggaactcattttgctgcctataggtgtcaaattgctccaacaccatttgtggaaaatgctgtctttcttctattaaattggttttgcatctttgtcaaaaatgtgttgaatatacagatttttgtgtggggatatttatgggtcccctattccagggctccccaacccctgggccacagacaactaccagtctgtggcctatcagcaaccaagccacacagcaggattggtgagtgaactttactgcctgatctttgccttctgtcagatcagcggtggcattagattctcatacgagctccaaccctattgtgaacagcacatgcaagaaatctaggttgcacgtcctttatgagaatctaatgcctgatgatctgaggtggcacagtttcatcttgaaaacacccctgcctccactcactatccgtggaaaaattgtcttccatgaaactggtccctggtcccaaaaaggttggggatcgctgccctattctgttccattgatctatgtgtctatgctctggcaatgtcacaccactttgattattgcagctatagtgtaaaacttaatatcaggtagagtacttttccccactttatttacctctttttattatttaactatttttgctattcattgtaaatttagaccacatgcatttatatttccaaaaacttgccaggattttgaagaaattgcatataaatccttttgggaactataatgaaattaaagaaagaaacagaaatgttctaggataacagagcaaaggcagataaagttctggcattggaggaagactaataaactaatacaatatgaaaaaaattgatgtgaaaaaatagaatatccacttgaaccatacatgcggacgtgtggataggcatcagcattccagcacaacggatgggacagaaacaaaaaatgagattatagcacaaagagttaactttaactatgtagtcatcacagaatgttatgggagcaaaacaataactcagtcacagcaatagaagtgtcaattttattataatagtgctgaccttttttggggcaagtggaaggggtagggagtagaagactgtcaataaagacatgtctgtatggaaatacagacatcttttgttggtaatctgctaaaaccacatacttttaaaggtgaaagagagatgaaaatacattatgttattaaggtatactctaaattgccaggcaagattgagaaaagtgatgaggcttccctgatagagactccacaattagaaccaaagcagtacagagcagcaacctgagcttccatcattcactcactgggattcccatcaacatacagcatccttggcaagtcttgttcagatggaaaagcagtcacaagaggagtgctcttctaatcctgtgctaaccaatctaaaagcatttgtgactgaagtagtggaaactctgaacaaaattaccttgtaaattttagtttatagtagcccagatatgtggccatgctagattccaaaaacttcagagaaaaatgggtataattaatgacctcttattctgacactttgagagggtttgaaggctatcaataataattctgtgatctcaagcaaaaaagaaaaaaaaaaagaaaaagaatgcggctgcacctcagactccatgagaagcttatatgtaaatggacaaaattcagaagaaataagtgcctcgcacaggccttaacacacaagttgtgctcaatcatgtttggtaaaagaatgaatggacattgtaaaaccaaaaattaacatctaaagggttcatacactacaagccaggagagtcaaagtatatatcatctgttcatctaatcattccatcattaatttattatgagcttcttgctttcagggtcccatagtccagagtgaaaaagtgatatgcaaaccaaaaaatcaaaatacaggaaagtaactatgactaggtaattgtttaaaatactttgggaacaggcaggctggagttattaattaactatatttggggaaaagaagactacaaaagtcttcacaatgtagttaacatttaagtaattttgaagaatagcagagatagagagttataaaaattactcttttttttttttttcttgagacagagtcttgctctgtcgcctaggctggagtgcagtggtgtgaccttggctcactgcaagctccgcctcctgggttcaggccattctcctgcctcagcctcccgagtagctgggactacaggcacctgccaccacgcccagctaaattttttttttttttgtatttttagtagagagggcatttcaccttgttagccaggatggtctcgatcttctgacctcgtgatccacccgccttggtctccccaagtactgggattacaggcgtgagccaccgtgcccagccaaaaagaactctttatatatgtttttgaaaagaagaagaaaagagaagcatatgctatcaaaaaagaaattcagtgctggaatgataatgagctcagagcaaaagtaaagagataaactgcctatagattgtttggagagcttaagttgaaccctccctagccattcccaaagatgcaagccccctataaaaatttggagcacctaacactacaaagtttgaaagaatattatctttgatatgattcctccctgtctgttaacttccatgtttccatcccattggccctgcttttatgtatcctccattggcctaacagctctcaaccagaggttttaaaccctgacagctcattagcatcaccagaagaacttttacaaaagccttccacttgtgtcccttccccagggattctgattccactggtttggggtaagggaccctgtgttgcccacagcggctgatgcccatcaaaagggcattaggaaaatcactctgcgggaaatcactctggcccgccatggtgaatgagtgtttttaagaggattaaacaaacatcaaaaagaaaaaaattaatgtcatggagttccataccatcttaagacttaatgattcatatgccattacacagaaggaatttgcccaagatagctatgaattgtagccatgatctctaaaaaagagtcgaatatgcgaatcctacctaaagaccggggacaagtgatccttaattcatacaaacagtaatggggagacactaaaatgttttctgaagaacattgacaaattaagatttgcacattataagaaatattctagctacatacaagaaaaaatgattgtaaaaaaatcaaagatgattcccagacttttgtttgggaaaccagatgaacataaatacaattcatcgagaggtaatggagaaaaaagtacaggcgtggcagcggaattagatgaggacagaagttctcctttagatatgctgatttttgggtatatatattacatagtggtttatacacaggttggaaattcaggagaaaaatcattacagatgggagatgtgtatttgagatccatctgcatatagctgggttgttaaggcaaagaaatagataagcttgttctgggagggtgtgtagaattctctttaggagaagaatacctagggcagaatttaaaggaacgctaacataggcagtagaaaaacacccacaaagtagattcataggaaatggccagagaggtagaaggaaaatcaggagagtgtggcataataggtgccagaagaaaagagtgtttaaaggaggaatgattgaacaatacttgcaaacattgcaatgatttcagtggagaatgcgactgaagtttgattagagtgaattaaggagtagatgggaggtaaaataaaaagtagaaataagaattagaaaaggtttataaagatggtggaagagaactttccagtgcttatccccacagagaaacattaatttgaacaaatatccatgcacaaacaaaagttcacaagagctaaagaaaccatgtgagagattacagaagctgagtggagcacagaaataagaaagacacactgataaaggtaagaaggacagttttaaatcacctgtgaagccgcttcacaaactgtatacagcacggacacagacagcagcaatacccaacccttacgggaaggaaagtgagcaccaaacttactgtggaacccaacactgggcctgctccagcaaaacccaacttcacgcaggcacctatggccccagactccaggctgatacctgcagactaagcttccaggcccacctggattctaggatagctcccacagccctgggatccatgcctgctcaatagactcaatctctgggcctgccccactgccaggctgaccccagcagccctaggctcgggaacagccccagtatcaggcaagccctaccagccctggcccttggtcagaaccagacatcacagatgtaggcataagcctgacccaggaccaggcctgacacaggccagcaccttgggacccagcctccaggttaagccccacagactcgggcttcaggcttaccccaggtttcagacaagccggaagctaaaacatcccatgcagtcccaggcctcaggccccaacaccagattagcactcctggtctcaatagcaggggactcaaatatcccactttcagcaatgaaaaaattatccagaaaaaatatcaataagtaaacatcagattaaaactacactttagaccaaatagacccaacagacatatacagaacattcccattaagcagcagcagaatatacttttttctcaaacacacacagaacattcttcagggtagatcatatgttaggtcattcacaagagcttaagaacccatgtgggagattacagaacccgggtgtagcacagaaatattggcaaaacaagtcttaacaaatttgaaaagatgtaatcatattaagtattttttctgatcataatggtaagaaattagaaatcagttaactggaaaaatttcaaaaacttcacaaatatatgaaacttaaacaatatgctctttaacaaccaacgaatcaaagaagaaagtaaaagagaaattaaaaactattttgagataagtgaaaagagagacacaaaacagcaaaactcatgatgtgtccggaattggtgggttcttggtctcgctgacttcaagaatgaagccgcggaccctcacgatgaatgttacagtttttaaagatggtgtgtccggagttcattccttcagatgttcagatgtgtccagagtttattccttctggtgggttcgtggtctcgctggcttcaggaatgaagctgcagaccttcctggtgagtgtcacagctcttaaaggcggcgcatctggagttgttccttcctcccgtccagagttgttcatccctcctggtgggtttgtggtctcgctggcttcaggagtgaagctgcagaccttcacagtgagtgttacagctcataaaggcggtgcagacccaaagcagacccaaagcttccacaaagaacaaggcttccacagcctggaaggaaaccccaacacgttgccaccgctggctcgggcagcctccttttattcccttatctgaccccacccacatcctgttgattggcccattttacagagagctgattggtctgttttcacagggtgctgattggtgcatttacaatcctttagctagacacaaaagttctggaagtccccactagattagctagacacagagcactgattggtacatttacaaaccgtgagctagacaaagagtgctgatcagtgtgtttacaatcctttagctagacacagagtgctgattggtgcatttaaaatcctctagctagacataaaagttctccaagtccccaccagattagctagatatggagtgctgattggtgcatccacaaaccctgagctagaagcagagtgctgattgggtgcatatacaatcctccagctagacaaaaaagttctccaagtccccacctgactcaggagcccagctggcttcctctagtggatcacgtgcaggatccctgggctgagctgcctgccagtcccacaccaagtgccgcactcctcagcccttggggggtcaatgggactgggcgccgcagagaagggggcagcgcccatcggggaggctcgggccttgcgtggggaggggggttggggggcagtgctcctgcatggcaggctaagggtcccaagccctgccctgctgggagacggctgaggccctgagagaattccagcgcagtgcccgccggccggcactgctgggggacccagcgcaccctctgcacctgctggcccgggtgctaagcccctcactgctcggggcctgctgtgctggcctgcggctccgagtgcggggccagccaagcccacgcccacccagaacccgcattggccggttcccacccgcgcctctccctctacacctccccacaaggaaagggagccggctcctgcctcggccagcccagagaggggctcccacagtgcaacggctaaaaggctcctcaaatggtggccagagtagatgccaaggccaaggaggcaccgagagcgagcaagggctgctagcacgttgtcacctctcaatgagatgcagcaaaagcagttctaagatagaagtttatagcaatagacacccataataaaaaggaagatcccaaataaacaaatgttacacctcaaggaactaaaaaaaaaaaaaaaaaaaaaactaagcccaaagttagcagaagaaaggaaataataaaaatcagagcagaaataaatgaaatagtgactgagaaaatgatagaaaaaaaatcaacaaaagtggctttttggaagttaatcaaaatggacaaatctttaagtagactaataaaaaagagaaagactcaaataacattatgaatgaaggaggggacattacaactgataccacagtaatgcaaaagagtataagacactattatgaataattatatttcaataattgaataacctagaagaaatgggtaaatttctagagatatcacccacccagattgaatcaaaagaaagagaaaatccaaacaaactcataatgagtaagaagattaaatcagtaataaaaagtctccaatcaaagaaaacccaggaccagatggcttcactgcttaattttatcaaacatttaaagaagaattaattccaatccttctcaaactcttctgaaaaacattgaagaagaaatacttccaaactaatttcatgaggttagcattaccaccataccaaatccataaaaggacactacaaaaaaataaaattacatgccaatattcctggtgaacatagatacaaatatcctcaacaaaatactagcaaaccaaattcatcagtatatttaaaggaacatttatcatgatcaagtaggatttattccagagatgcaggtatggttgaatataagctaatctagaaatgtgatacaccacattaacagaataaaggacagaaaaatatgatcatgtccatggatgaaaaaagcatttaacaaaattcaatatccttttgcaataaaaattatcaaaaaattagatatacaaggaacataccttaacacagtaaattccatatatgacaaatccatggctaatatcatactggatgcctctaagattaggaataagacaaggattcccgttcttttcggttctgtctaactaaagtgctgtaagtcccagccagagcaattaggcaaaagaaaaataaatggcatccagattggaaaagaggaagtcaaattgcccctctttgcagatcacatgatcttataaatagaaaaaattagtgacctcactaaactactcttaaaactgatacattcagaaagttgcaggatacaacatcaacatacaaaaatcagtagtatttctacagactaacaacaaactctccaaaaaagaaatcaagaaaactatcccatttataatagctacaaaagcaataaaatacgcagaaataaatttaaacgaggtaaaagacctgtggattgaaaactctgatacattgataaaagaaattgaagaagacacaagtagagttatcccatgttcaatgattaaaagagtttatattgtttaaaatgtctgtattattccaagcaatctacatattcaatgtaatctgtattaaaatgccaatgtcacttttcatagcaatagaaaaaaaatcctaaaattcatatgcaagcacaaaagatgctgaatagccaaagcaatcttgagccaaaataacacaatcagaggtatcacattctccaatttcaaaatatactacaaagctatagtaatcaaaacagtgtggtactggcataaaaacgtacacaaagaccaatggaatggaatagacagtccaaaaatgaacccatgtatatatgatcaactaatctctgatgagggtgccaagaatagaaaatgtggaaaagataagtctcttcaataaattttgttggggaaaatggatatctacatgcagaagatgaaattagacccttttcacacaccatatgtaaaaatcaactcaaaatggattaaagatgtaaatcaagcaatacctgaaactgtaaaactgctagaagaaaacatagaggaaaatctccatgacataagtctgggcaatgattttttggatatgatctcaaaagaaaaggcaacaaaagtgaaaatagacaaatgggattacattatgctaaaaagtttcttcacagccaaggaaataattaacagagtgaagagacaacctatggaatggaagaaaatattgtaaaccatatatctgataaggagttaataccaaaaatgtatgtgaaactcctcaatagaaaaaaacccaaataacccaattaaaaaaataggcaaaatatctgaataaacatttctccaaagaagtcatgcacactggccaacatgtatatgaaaaactgttcaacttcactaaccattaaggaaatgtaaattaaaactgcaatgagctatatcaccttatacctgttacaatggctattatcaaaaggaccaaagataagtattggagaggatgtggaggaaagggaactcttgtacactcctggtgggaatggaaattagtacagccatatggaaaataatatagaggtttttcagaaaattttgaaaataccactacaatatgatcttgtaatctcacttctggatatatgtccaaatggtatgaaattagtatgtcaaagagattgcctgcattcccatgttcctcacagcattattcacaatagccaaaatatggaatcaaactaaatgtttgtcaacatatgaatggctaaagaaaatatggcatatacacacaataaaataccatttggtcttaaataagaaggaaatcctgtcatttgagatgacatggatccacctgagggacattagtaagtgaaataagacaggctttaccacatgatctaacttacatgtgaaatctaaaaaggttgaaatcatagaagcaaagagtggaacagtggttaacatgggctgtgggatggggtggagttggggaaataatggtcaaaggatacaacattgcagctggataagatgaacatgttcaagagatctattgtacaacccggtgagtggagttaatagaactgtattcctgaaaattgcttagaaagtattttgtgttcttaccacaaaaaaatgttaactatgtgaagtaatgcatgttaattatctggattcagcctttccacaatgtatacatattttaaaacatcatgtggtacatgataaataaacacaattttatttgtcatttaaaaaattacttaaggtttagaaagtagaaattagaatagttacctctttaaagatatttgcacaattaaaaagatttttcatgtttcttttttgaaaagtaacatatatacaatctagtactaaaccttaacagatagttattattttaagacgacagaaatgtgaacattttacttctgatgaagagaatctataagagagaaagatggtgatgctaaacaaatgagaaattataattattaaaatacaacaaggtatctgggatagaagcaagacaggtggaaagattcactcatgctttgccctgccaggagggaatattccagtataatgggcagaaaggaagaaaacatggaatgaatgcagtatgattaaaagtctggtgataggataaggatgcatctctagtctagtggcttcaattttctcagcaaagtaggaggacaattctgatagtaaggaaggaatggcaggattttaggtttgagagggtgaagcgggtgaaagcactgcagagacactgagggagataactaggaattacagaagaattgccaaagagcattgaagtctcaaaactcatcttaagttggataagtacacaattttaggagcagtgataggtaaatggcagaaagtatatacaagtattaagtaacttcaggctcaattccatccaccgaaatgttgggacttacagaaaagcagattcaatatggaagacgtggctcatatctgtcataggaataacagaagaagtagtagtaaacgtttattgagtacttactgaatcttctgtttaaatgttttacataaattttagtacacggccagtaaatagtgttattattttcagtgttctaatgagaaaaccacagcacaaagaagttgagtaattttcccaaggtcaaccagctacaaagtgcagagttttaaacagtgaatccaatgcatgtccagagaaaagtgagcaggacagcaaaggatctctgcaatataaggaagaattagataattgaggatattttgcctaaataagacaggcagcagcaaataacgattgcttcaatacttaagtagttgctatatggaaaaggaattagagttttacattatgtttcttcagggagcaaaactaaaactaatatgcagaagctgcaatgaagtagatttcatctggaaagaatgatttttgtagccatgagaaatacaggtgaagtagaaggagcagcttcagaaagtgaagttccagtgaccaaggagtttgagcccagaaagggatgttaggaaggactttatacataggtgagagaggacttgctagtttatgtaaagttcaacacccattctaacactgaaagtctgcctctagtgtgcattttattaaccccaataaacatttacttttttattttctccccagagtaagcatgttggcagatacatgaagcacttggatccatgtcatgacaatatttggatataacagataagacataatgctttgccaggactgctagacctgggctttcaattgcttccagggctataataaattcagatgttgggggaagagagaggaaaggagagagtgctttttgttgttgttttttgtttttgtttttgttttttgcaatgtagccccttcccaagagtaagaaaaaatattcttctgacaattgtaaagctgtttcctgccaaaattgtcattgttaaaacttttaaaagataatccatatgtccccacacttcatactcttgcactttcatgcaaagagctcaaataagaaaatttgaagtttttctctgagtagaggtcagtgtttctgatgcagtgccagttttaatgagaagattttattttctctctctcttaagagaatggcacgaggaagctacatgttaagaagttaagatggtctctacttggacctgatgctaaaagaaggttcatgccatattttatttgacattgtaatcttgatttggctgcccaatttattgaaaagattaatattctctacaggttttagatagcaaattttaagttttgatcctgacttgccttagagagcctttctttataaagcagctctcgttctttaatcttatagcaaccttactgtgttcttgctcctgttcttcaatgtggtattgtttgtttacctgtttgtgtagaatgttaggatgccacagttaaaaacaacacacatcccaattcattatgatccataggcatcacatgctgccactaatatgtacggtaaagcttacaccatccaatctgaagcaaatgacaaattcctgactctttatttcaggcacttctctccttgatttgtcttcttcaacagctgtcatctttgcaatttctcccaaatcagaccctatattactgagcaatgtacttgcacactttcatctttgtaaactactgcatgtctgctgctttataatttttattttattaattgagaatagatttccacccatttttcaataacatgcagcaatcttagtcactaaatattgtttaaaataaattctgcaattttcttacctgaaaatcagatagttttactttttgcttcaaattattacaaagctaccgtatgggaaggcagtcgtgcaattaaaccctggttattaagaattttgagagggaaatcgaacatggaaatatcacagctgaaatatttacacttaagtccttgtactttttttgctgattgttggaagcaaacccaatcagcaattttggcagtgagtagctatagtgtaaaacaaagatggagatgtggatacttatcatggagatgtgtgtccctttcaatttggtctgtctgatgaacagggagagaaacattgctactttattgttttggttgttattgttttcacaactttcacctaactctagtactctagtaacttgtctgggagacctgggcttgagtctgatttccatcacttgtcaatgactagaaaattctctctctctctttctctctctctctctctccccctccctctctctctctgcattcatttcttcatttgaaaatgaagagctagattggatactctctaaaatcctttccagctctaaaatcttgtttttatgagacactatttctggaatgagcaattaagaaataaataaataaaaatttaagtgatgtgataatcaagattatgtaactaaaaagatatgagagaataaattaccttttaaaattcctgaacaactcagtgggggaattattctgcctcagtgaaaatataagagaggaggtcaatgttctgtgttatcacataattttgacaaagccaatgagtgaggctaccgttaagtgccagcattggagagtttgcatgcaaacacaaaagaagtaaaaagcggaaaaaagaagaggtgtgacaaatggaaggtagcctgatcatctgcctgcagcctggccttctctctcttttctaaaatattttttggagacagggtctcactctgttgcccaggttggagtgcagtggcctgatctcagttgactgcaacctgtgcctcacgggttcaagcgatcctcacacctcagccacctgagtagctgggactacaggcacccacgaccacacctggctaagttttgtaattttagtagagacagggttttgtcatgttgaccaggctggtctcaaactcctcaagggatccccccgcttcagcttcccaaaatgttgggattacaggtgtgagccaccatacccagcagtttttttcttctcagtcatattcattcatttattcactcattcaacatgtattcactgaatgaatatttattaaatgcttatgatatacctgaaactcttctaagaactgggactatatcattgaacaagaaaattttccataccttatgaactttacgttttagttagggagacaaaaaataattaagaaaacacacacacacacacacacacacacacacacacacatacgtgtagttcaatttaacttcagatatacaatgctcaaataaaaaatgaagcactataataagatagaaactgactaggtatttagatggagagagaaggtctctctgaggaggtaactttgagtagagacctgtataagtgaggaagagaaccatacaaagatttttagaaggagctaaagttttatttagaaggagctcagttttgtaactgagatctttgcttctattatattttctaacaggttgttgtgagaaaagacttagaaagacctattgtgtacttacaaggaatatttaaatgccgaaagtggagctgctatggtctgaatgcttgtttttttacaaatattcatatgtttaaatcctaacctccaaggtgatggtattaggagatgggacctttgggaggtggatggttaatgagagcagagccctcatgaatgggattagtggctttaagaaagaggtcccaagggagcatgtttatctcttctgccatgtgaggacacagttagaaagtattatctatgaaccagaaagtgggccctcaccagacatcaaatctgcccgagctttgatcttagacttcccaacctccagaactgtaagaaataaacttccgctgtttataagctacccactttatggtattgttttatagcagcccaaatagactaagaccctaggagatttaatgaaaataaagtacttctaggatctaggagtcaaaatatcattatgacaatattgacaatattcctgggttttttttctttttcatagtgacagggtctcactaagttgctcaggatggtctcaaactcctggtcttaaaagatccttctgccttagtctcccaaattgccggtattacaagcatgagccactgtgcccagcctattcctcattctaagagagaatagggaattaacctatgcacatgggttccaagatcttacctgcccatttgctcatacaactggtgactgctcattgactaaaagaatggagaaaggggctttgctctatttctacttgtgtacctcaagatgccagtgtggttcttctgtgagatcactaaaatattagttgatagtcttttaactcactggtttttgatccatgaggcagataagatagcctaatttgtgatatgcctccaacctcttaacttgtgataactctaaggttaggtgggacatccatatttctttagggacaaccttcatactgctgtagttcttagagttgtgctagagagacaaagttatgggattgagccttgcaaaaatcagtgaccaacttgtcatctcataaatatgtggttggttacaaaaggtccctgataagaaagtatgaatgcatacaaaatttatcataaattccttcaacatagaaggtatgctttttgcccaggaattttaacttgttatttcttctccctagaatgatttctcctcagctgataatatgtatcacttctttaattcttttcaggtttttgctcaaactcagagaagtcttccttcacttccctatttaaaattgatctctactctcattatcccatatccccatttcctgctttattttctctccaaagcacttatcaccatctaatatatttattccttatttattgacttttgcctattgaaatgtgagctccatgggatcagggatttctgtatcttttattcaatattttcccaaggcctatggcaactaatattggttaagtgaattaatgagttcttagtgtgtttttgttagagtttggtatattaagtgctcagtacagtgcctcgtacatagtaaatactgaataaattatagctataattattattcataaaccaactgaaatatatattttttgatactaaacaattagatcagtcatgttagaccattcatatcactattttcattctgccaattttagaatctaatattatattagtccattttcatactgctgataaaaacatgtctgagactgggaagaaaaagaagtttaattggatttatagttccacatggctgggaggcctcagaatcatggcgggaggcaaaaggcacttcttaaatggtggtggcaagagacaaacccctgataaacccatcggttcttgtgagactgattcgctatcacgagaatagcatgggaaagaccgccccctatgattcaaatccctcccacaacacgtggggattctgggagatacaattcaagctgagattttggtgaggacacagccaacccatatcaaatgtcattttctttttaaacctcttaaaacatttatattagttaaaaataatttcataaggcagaagaagtaagtcttgaggtataaagcattgatctctactctcatatcccctcttggtctccagggttttaagtgcaccaaaacaaaacaaaacaaaaacaaaataaaaaaccaacaactatgtacaatgtacaccttggccactattgctggaaggctaacttttattagcctgaaggttgttgatgcaggctttatcaccgaagagattaatgtaaaattgctgagagtctgccaacagggtaaatgttcccagagagatggcaaaagcagcaaggtaagagatttaagtgcctcaacatttcttattaatttttagtgaaaatgttaaacagtcgaatcaacgtatggtggaattacaattcagctcacagttagtttgtaaaaatttcatgcagcttcaaaaagtctggttcaaaaactggtgcactgctcaccatccatacacattataaaattaaaaagttctggatgccgcaagtgacctctacatttgcagttgttaaatccaagaactttagaaactagaaaacatatgcttaaaaacgaattgttgtttatctaaaattcaaatctaacagagtcttctctattttatctggcaagtctaattcatggggaaaatacattctactaaaattctgctgctaaattaacttttcttaaaacaatggagacattggtatccttaacaacattaatcaattaattaagacatacattcttgcaatgacaaaacatatacaatttgcttactggtctctctgaattcataatcactaactttaagagggcgtttagcatacacctgcaatcctactacattttgctggaacttccctactgtcctagatgaccatctcctaacttttcttcacctcttaaatatgcaacaaccctaccattttcttttgtttttgcaggtacactttcttcccctttcattaacaaatagaagcaactggaagagctcttctacttactttctcaacatctattcactctctcagtctatgcccatggccttccttcctctgtcctttctgtctcagtcctaaggccaatccttcctcttaagcaccagatcccatctccttttgcctcttaggggtatttctactacaattgttgtctgcttccctccttcaagatcctcaactttatcttctctaatagattatttccatcagcattcaatcatgtagcaatattttcatctgagagagagagagagaaggaggggaggagggaaaaaacagggaaaggaaaggaaggagaaaaatgcctcctttggtctcatatctaccttcaagtataatttcatttatttgtttcctccttcacataaatcctgcttaaaatgtttacctacttactactttcaattcattctatggtctttcctcccttgaacccactccagtcaagattttgacccttcttcactgaaattgcttctgtctaatttaccactgacctccaggagctgaatccaatggcacattcttcgtcctcaccttaattgctgtatgagtttcctagagctattataataaagtaccagtcttatcttactataatctattctctacacaacagccagaatgatctgttaaaaggtcagatcatgttacttctccatctaaaacctctaatgattcccccttttttcagaataattaacaatgtccttacaatggcctaaaagctggcccctccccagtcatgaccatcaactcccaaaccaatgcaccgttccccttatgtccctttcacatacctcagaatttactcttcccactctttgggaccatcgtcctccaaatttgtccaggatattttcatgactttctcacttagtttcttacttctatgcaaaaatgtccacttaaaaaggtttttgccttttacaaaaaaaaaaaaaaaaatcctcaccagtaacccaattatgcctttcccactttgcttttcacctaggcttaagaccacctgacacattacaaatgaataaaagcaattattttgtatctctccagtttgctgcctttctctcccactctactggaaactaacttctaagaagactgagatttttatctcttgttttctattgctagtgttgaaagaatcactgaatcaatcagaacataactctaaaaagttaatcagagttcagttctgtacaccaagttaaagtcttgtaaccagtgaatacctagagcaaaattaagaaaagattgtcctttagaatgcagaaacttctgcatacttataaaatcttataaaattgttacactgtgaattaaacatagttttctcctttttaaattagcattagtctccaaagaattttttctagttggacaaagactgctattacttatattttctctcctttgtcaccttaaagagtaaaattttttgccagttattcttttgtttcccttaatataagattagaacctctgtagccatttcaacatacaaattcagcctatatctctcctgccaaatgtcttctgtactaattttatattttatattaattttttatcatatacaaaaggttaatcttttatacaaaagattaatctttattctgtgtcctgctgaatacttatcagaagtttaatctcccccagacacttttatataaatatttatagggttgacattgaataataaaatgaaagctcctgatactcttgccctgtcacatctcaaatagtttttttaaaaagtgtcaatcagatttatagcactaactaagtcacataattgagcacagcttgaagaccctaaatttaccaaccataaaaggaataattttaggaaacgtttggagctctgtatgtaagttactggcagagaccttcatgaatattggtcccatctccatgcagagaagagaagatcttggcctctgatctagttgtggggttggatgaagctagcctagtagttgtgagccttgtcaggccctttgggaaatgacagatacaggctcattatctttggtgccatgactacgacaagcctgaaatctagaaacatgactattaactgactggaatcatctaggtatgttccgtctctcctactcttcctggtagggagcagaacatagcattcagcccagaagctgatgttgctaggaagaaaaatcccatgggaaaaaaatctctctcactgatatttctcactgggaaatgctcattgaaataatgcctttcaggatcctttgataatattattcaattttgtccttacgacaatattataaagctttgctcatccaccctggctgaatatgagtcagctgaaaaaattaaaaaaaaaaaaaaaaaaaaacagagatccagaccttcctacaaactggataggacccagacatctctgttttgtaaagactctcccagtgatttaatacaaatacacagagcggataaaaaattatgtaaaaaagattggctgggccaatgtagttactctgtataacaagtaagaaaacaggtcagacaggttaagtgacttacccaaggtcacactgccaacacaaggtcttctcttgccatcatatcatggtgccctctcccagcttccccaatttctactatttcatataaattttctgccttttcagttaatgaagcttacttcagctcatttcagctcagaggagaaaaacatgaacaaaattggactaaaatgggtgtaagaattggttcatggaggataaaaagcattggatttctgccagacccttcaggatgtgaatcagtcaaagaaatcaagtcaacacataataataacaacaaaagcaacaactcttttggtattttacatagtaaagccctttgcatgctgtaatttcaataatgattcctgcaaatgcaaaagtcacacaattttatctctgtctttgtattcttttttatttcagacattctttgtataggcttagatttaaacaacataaatatctgagaatctttacccaatcatgagtctgaaaaagtcaattgatggattcttataaacattgtctaacttccccgacccatctgtttcaatgccagcataggccagtaaggccacatttgtccattgaggatttaaaggcctgatgttctaaaagtctgaaagatcctcagctgtggagagatgacagtgtcagaaattcctgactagcaatacttttatatgatcataacttctttttaatcataaaacacctcttttgttttataaattttttcccttcacctttctaaactattctcagagattacactttccaaaaaatgatatttttgtcacatattacaactcaagggccaaaacagctggtttatgacttataagtactttgtgaattgcttgagctggtggggaaggttagacaataggaacgaagttttcctactataaatcattgagtcacagaatcttagctttctagaactagaaaagataaacacaatctaatataagtccaacacattgcaggcgagaaaacaggcccctggatgttggtaaccagttggggccaaacagggaattctggacagagcagacagtagaagccaagttcgtttgccttgactcccatgtattttcctaagccagactgtctactttggagtatgagatcctctgagcacatctaactctgtcttctccttcaagattcaattcatttgctgcctggtattacggaatttcaggaatgaaagagatgctaaaatcatcctgtccattcagggtttgacttttttctaccatggtccccaccacagggtcaagtactttagtaacaaaactcctaatgaagcagcctgttccatctttggatactttggattaaataacttataatatttagctaaaatgttttcctaaagcaactgttaaaaaattgatcacttttgtcatataagagtctcttatatacttgaacataggtataataaggacaccttttttgcattttccccagaataaccattgcttgcctttaaaatttcttcatgttgtgccatcctaattgctctcctttatatgccattaggttttgaaatatgtcttaaaatgtggtattcagaattaaacacattattgtaaggactgctaagaacagaatttttctttcttctttctagaatattctctattaaataaagcccataaatgctcaacaggagtgatatcacccccaagaggctgaaaactggttcttggggaaaaaaaacttacttttttaatgtataaagcacatataatgtacataaagtacattaacagatatgttatgtacttaaatatctgtggtattcaaatttcattggggaagtgatcagaaaaaaacatttttagggactccttaaagggataatagttttttttaaaaaaaggctgtgaaacagtgatatagcctaagatcacactagcacattagctattttatcagagaatcatactattaacccctattgagtttatagtcaagcacaatccttaaaactatctatctaacctacttgtacaactgttgaaaggtattttcactaccgcgaggtttccagtgtgtttggttggttagatgattggtttgtttttgaagagtagtaattttttttttgcctaattttgttactataagagcacaaagttaaatttatttctgataaaattgcccttgttaggttttatctattcccgcctgtccagatattttggaatgtaatacattcattattttctgaagctctgattatttgcaaattttatctcctatcatcttgattgctcatgccagtaatttgcagaaacaacgttaagagaacagagctgagaatattgtcccgcacacaacttttccattttgtgttaaagtatcagcagtatgttttgactaacatttcttcatcgaggtattaatgttactaactgtacatttccttacataaaatccatagttttctatttttttttatttgtacactctgagaaagaatgtcaagtgtctcacagaaatccagattgcctggctctagtatactttctaacagcctagtaagccaagtgaataaagaagcaagatttagtcttttgtttttctttaataattctgtgctggctcactctcattacttcttcaatttatctatacttaagaggttctttttagtagtctgtacagacatctcttcccagcacagcttaaatattctattgactgcatttctccctataacagtatttgtcagttacatctagttggctcttgctctgtttgttttcatgggcatatgccttaacttttcaaaaaagattataaactcccagggttgaagcatatactcttatagtgcccacagctgcccattaaagtatcacagaagatgataaaaataaattgtttgatttactaataacaaactactcactatcaaatcagattgatgaaaggatcatgaatcattcactcacaccctagcccaggtttacagattgttttaaatgcttgcttctaataagggtgtattaaaagagttaaatgctttcttctaataagggtatattaaaagagtttctttccaacactcaatttactaatttatcactaagaaatagcgtttttgctaagtaataaggaaattaagaactgatgatggaaaaggaaactatataggggaatataatgggaaacataaaagggaaatatgtctgcaaaaagtaggattacaaggtcatgtttctttagaatgaggagcctgtttccattttcacaaattaaaatcatttgaaagcacatatacttatcaggatgggttcctaaaacttttttctcaactctcatatgtgtgtgtgtgtgtgtgtgtgtgtgtgtgtgtgtgatacacatccacatatatacatacatacacatatatattcaaagatatataatcttatatataaaatatattggccgggtgcggtggttcatgtctataatcccagcactttgggaggccgaggtgggcggatcacttgaggccagaagtttgagaccagcctggccaacatggcaaaacccgtctctactaataacacaaaaattaaccgggtgtggtggtgcacgtctgtaatcccagctatttgggaggctgaggcatgagaatcacttaaacctgggcggtggaggttgcagtgagctgagatggcaccactgcactccagcctgggcgacagagtcagaccctgtctcaaaaataaataaataataaaatatctcacatatatattctatatatatatatctcattgtgcaaagttcccaaattagacattttgactacattaaaaacacaatgactacttggataaaaactggattaccaaattatctaaatgagccatttgtgtgctatttgatggtggtatatttttatatcttggatattatccatatactgaatatatatgttccaatattctaaatctctaatataattcaattacttgaaataacatattaaataatctgagagagggcggagaacgaattaagcctcaattatttttacaatatgctgtatgcttggtgttaacacaggtgttcattcattattctcaaggcctttttgtatagctaaaatatttcatattataataagttgtgtgtcatagcagatcatgttaaaagaaatctaaagttgcccgagcgtggtggctcacgtttgtaatcccagaactttgggaggccgaggctgatggatcacttgaggtcaggagttcgagaccatcctggccaacatggtgaaaccccatctctactaaaaatacaaaattagccaggcatggtggcatgtgcctgtagtcccagctactctggaggctgaggcacgagaatcacttgaaccgggaggcagaggttgcagtgagccgagatcacaccactgtactccagcctgggtgacagagcgagacttttgtcaaaaaaaaagaaaaaaagaaaaagaaatctaaagttaaaaaataatctaaagtttccattttgccattcaactgccatgtttacccacagctcctcttttctggtagctgttttcagttaaggaaagggaacactgggtggaggatgggacaggaacactcctttcacagagggctctgcatatagcagtccccttgagcatgaattttccaagctttgataaaatctattgaggaggtaaagagaggattcatctttaaaatattgtcaatgtatagttaattaaatagagtttattctgctgcaatcttacagccctgagaggtacagaatgctgaggttcataaatgctgtcagcaacacagtgaggcagtgagggtgaggagaggaaggggggataaaaacaattgcatgaaaaatagaataaattttgagatgtcttctaaatcaaagctcatccaatatggagaattgaaaaaaaattaaacaaggaacatttgagattcatggtatagaaatctccctttccctaaacattctttaaggtcttctttcaattatttctgacagttatggcaacatattatgagagtaatatgtccactatgggggggatacgcattagttcactattgttgccataacaaattaccacaaacccaacagcctaccacaacataaatgtatttgttctcagttctataggtcagaaatctggctgggttcagctgattcctggggtctaaaaggtccaaatcaagttgctggccagcctgggctcttatttgaaggtctgagcaaagaaagtacttccacgccaaggtcagtggctgaattcaattccatgctaccatagaactgacatctcaatttccttggggctcttctccagggatggttcttaacttccagagatcaatcactttccttggctcagcgtccccttcctccatcttaaaggcagcaacaataggctgtgtccttctcacattttaaatccttctaacctccccttctacctcttctcttctaggctcccctcaccgactgatttttctgttctccgattctgcccttaaagggttcatgtgattacattgatctcacctggataatctaggctaatctcctttttctttaaacgtcaatgattagtaatattagtttcatattcaaaattccttcaaaacattacctaggttagcatttgattataaccaggaatgggaatcttgcagagacatctgaattctgtctaccacagggtgtgcccaccagattcaaacagacctgccaaccagaaattggcagtttgatttatatttctcagtctatgaaacataacatttctctaaatgaagcattcttaaatagtatttgattactcaagtggataacttcatggctaatgataaagcttttctattagaagtttccattaagaatgcttttgtttgagttgttttgtgttttaaaacaggacttggatttcttgggagaagctgtttaaacaaaggagagaggatattatttgattacaattagagatgtctttttgtaggaagcaattatcagtataaattaagaaccaaactgcaaattcaattattcctaagtatttactagagaaacattagtttaactgtaattcttctggaaattaaccccataaaatatgttataagagcattaattgcatttttatagttaaaatatgacgcaataacaatattacaaaagctatttgatccatattaattttgtacaattgctgaaaaccatctattgaaatcatttttttaatatttgaattggagtgcattaggttactcctttgaagatttatgcattacccaagaaagagaaaaccaatttttaaaaataccaattaaatgaagatactcagttaaattaaaaaataattctaatgctccaaattcttgctgtgaatttgcttattgtggaatcagaacatatttgaaagaatgaaaatggccgattttaaagtacttttgaattttctgttacttttcttgttaaaccctaaatagttataataattgtaatgaaaatgtttttagttactgacctccacatgagtggcaacatgagtttcacacagttacatatattcagctgataaaccaggtagtaaaaggaaatgattaagatcacaggactctgaagtcagactacctagatttcagtcccatttgtcactttatctgaatggcttgaggcaaattattcagcctctctatgcctcagcttccttctgtaaaacggggataagagtagtacacattactcccagggttgctgtgaggataaaataggataatacatacaagtaaatacatgtaaagtcatgtaaatgtttcatagttggtatggactaaataaatgctggttattattcttgaagtgatgtccaatgttaggccctagactgacaaactgagacctcaactcttcaaacctgtcagcattaggatatagaggcaaacagccttggcctcagtagaactgacctgtagtcaagtcagctgatcaacagagagaatggaggaaggggctgaagagtccctacagaactccagcaattagctctgtactcctactggctagctatgttttcaccgctacaaagatgctatcgatatatccctcatcctggccattcaccttggtcattcattttttatcaaaaaaaaaatagtgagtacctaacaaagttataggctctgtgtgaagaagatataaagagctgaattttaaaattataagattttctgctcttacggagttcacagtcttgcaaacaaacactagcaaccccaagccatccttccttttgactcactgatttaaattgaacaagaaagccactttcctattgaaagtaataaaaattagggaaaaaagatgaaaatggtatcatgagatgtcgaagttgaggtgctatcaatgctttgggggttatgtatcaaaatttccttaagacttttttacgacattgtcactcacagttttattaaaacagacactcaaaggaaagctatggaaaaataacacagtgtctctggttcctacaaggtatttggttatggtgggagaggagacgtaaattacctctttacttccacatacccacagagaccctccatcacatctgcttttctccacccacccgagcaacacccactatcttaataccaagtgctgtataatcaactgagttaaactattttcaatttaagctcaagaaagtttagaagagctccttaaggagtagcagtttagatccaaaaagctcttaagattgatcagccttctttcatgcagtctatattctgagggtctcagaattttaggcttagaagaaaattttaatatataataaaattattttattcttctaaatatttgaataattttctcaaagccatatggatgttagttgcaaatccagatctgggccttaaattccatttctatttcaacttctttccacatcagcatgtattataattgaatataatgggcatttactactgccaaggatagattctaaagtactgattcaatctattgctaatgaggcattaaatgtccacagctgataacaaatagcatgaaaaatatttgaaaacagaatttatcaccatttagcaccactttagtcagattgcataccacctttgtttatgtattccatcatgcttatctctttgttaaagatttttgttcgttaaatcaccatatagacatattacatacattaatgaaattataaacttgactttgaagttgatgtagctaaaaaatattgggaaaagagtaaaagattcattaagtgttgctaaattgtaagtggttctatgttatgtttccaaacaaaagaaatcgtctacattacaacattgtaaaagtaatgaccacaaataaaataacactttaatacaccaggcttgctccaatactgaaatttttcttttagtttaagatacaaaactcctagacacttgtttattaagaatatctttactggtggaaaatgatatatttaagcttccaatttatgaataattaaattcctatgattagatataccaaatacagccacatcgtcaaaggatatactacataatcttaaaggcaatgaagattagatatgggccttattatattcatcatttcaaagaaacatcaaaagacatctgaataaaataaacaggagtttttatttttatttttatttttgcttgtatcaagaactttctgagcacactgtctggcaaatttagagtgtcagattagaagttcaatggcaatttgattcttgtctttgtaaacatttttacattctaccaggaagtgtataggtttttctttttattattgaaatttagaaatctcacaataatatctagatgtgagccttctttcattatcactatactaactcagcacttgttaattttttttttggtctgaagcctcaagtctttagctcaagagagtatcttctcctgtgactattgtttctcctcaatcaattccatctattcttataagatttatgtattgggtgttagtgccaagattctctaatatttgctgagattttctaacttcttcttttaaaatctgacatatgggataactccttgggtttgcttctgatttttattgatagctgttgtgctcttttcttgtcctagtaagggtttttatttgcttttgggtttttttgttgttgttcttttattatttcttcaaaacaatggtcatcttcttttcagtttctaagtccttggtattcagtgtatagtgtaattaaggttatgggcactgaatgtaggtctttctagagccttgggttagcactttcctagctattttaccttgggcaaggtatattaactatgcctcagttttctcaccacatagagataatgtgcaataatcttcagtaatattaccctattgctcctttgcatagcagtgtgtttgctcttttacagagtgaagaaaaaaaaaacctcccaaatatcaatgaggacatcaattagaattctaaatcattatcttttgtctacctgtaatatctatatttcatttgttctaattcccagctttatccctattctctccaatgatgggtaatactttattatctgttcatatgtatgcgttcagcgttagattgcccatcctagtggttgatacgggctccctctgcttaggccacctttgatgtcatgaaattgctgtgttcagggcataaagaggaacagaaaggttgatttattcccaggtgcatatgctggaaatgaacctgatacatctgtttcaaagagaaaaagcaaagttaaagtgggtaggaaaagctccaactgcatttagaatgccgatgacaccaagtggaagaagcaccagggcaaatatttcagctatcttctctctgcagagctctaataaatcctagagggcctcttgtgtgattctctctgacattcccactctttcaaatgggggttaaacaacgctacagcttcccaagcataagattcccacagttttctgctggaaagactgtctacttgcctctcagggcttccttacctggtttatattgagcaaaacaaaagccattgtcagctccttgattaaacccgatccatctgctgctgcttttttttttctttttaaataaattactgaaagagtatgcttgcttgatgttacccttcctattttctagtattactacatacctttttgctcattttgtgcttctttagtcattttcatggggttaagatatgaagggaagaaaaaaaatgagttggtttaacttcccatcctaaagctggaaattatattttggatcttgaaaataaccaaaatattcattatttttatggcagttgagttagtcgaggaacagattctatgtaatgtcatgttaagttgcttatttagctaaaatgatgcaaagtaaatagctgtcaacatgattaaaattacttgcaatctgaatttaattaaattgagaactatgttattttcctactttctccaacctctggccacttaattagtaagatttacttttagttcatctcaaaatttctgtgcttatggtcaagagtggttatgtgaacaactcaaaagagacatccagcctgaatcatttttattggcacagataccattatgtgactgtttgggttactatttgccttcttaattatattatcttcagcctaatacatgaaaataagatttcaatccctgtggctatgacagaatatttgggagatactatctggagaaagcaaaggctatgccacccagaaatttgaatctggaaacacagaagttgcaacctgactatataaaatcaaaaggaccaaagagaggtgcaaggtctcagagctattgtttacataaaaccagtcatgtctaaatcattggaagaaagcttttgtacaacggaggatttattttctgttaacataaataatgggaatttctacatgttagagttaaaacctttaaaacacacacacacacacacacaactgcaatttatcttattccttccaggttgtgaaatggactgggggaaaaagaaaacggtgacagagaaagaggttagactggcttgttctgtgtaggcaggctgtcaaaatggctgctgggataggaaaaggtattcaactttatgcagtgaaggaagctgtacagactcctcctgagcgtctgtgaggtcaaatgctatgcaccccaatctacttcctgaaattaatagccaggtgttatgctagttactgtaccttaatcattaattatgactgtggcagcaagagagaaaaaaattctaggatacatgagctagagtgataaagggaaagcatcaatcacgcatgacaggaaagccaaaggtaccctctctctgcctgggatactttcatttgtgactgcagattttctcctacatcagacttcaaacttcagagaaaccatttctcatagcctgcctctctctctttctccctctcacaaccagctatggtcctaggactcaggaggatgaaaacaaaataaaacacatttgttagtaatgccatattttccatgtactaccaccaggatctatttgaaattaaaggtaatttatacaaataaaatattcagtcaagagatgatttattcaaaaaagcaagctacagcaagaatggagtttagagtcaatagttaataaacattctggcagcacaggctggcccacatgccttcatttttctacaatgtcataaatgtgttgcatgtcatcttaaacaagtgggcagagcaggtgaatctccctcaaagtctcatggcacagtctagtatgttacaaatcttgataagcagaaacccaagccacattctggtggtactgagtggtcagaaatggggtatttggaagtaggaagaaatacattaatttagttgaatggaaggaaactaagttgggttctactttactatggtattgtggatagattacttgacttctctagcattggtttcctgtttgtaaatgactggtttgagccagatcaggaacccttattctggggtgacataggagcttcagaggatctggcaggaaactcaaattataggagaaattgttcagcatattatttaagtgttactaaaaaaacatacacactaaaggagtgcttctctaactatctgtagtgaagaattagcactttgtaatttccaatctgctatgaaccacctccttttaaaaatcatacaaaaatgaaataaaaaataattttatacaaaatagaagcccactttttttttaatcagactcaatagatataaaaatactccttcaagttgctataaagatgatatggtatggctgtgttcccacccaaatctcatcttgaattgtagcacccataattcccacatgtcatgggaaggacccaatgggaggtaattgaatcatgtgggcggagctttcccatgctgttttcatgatagtgaataagtctcatgagatttgatggttttataaaggggagttcccctacacaagctctcttacctgctgccatgtaagatgtgcttttgcttctcatttcccttctgccatgattataagcctccccagccatgtggaacctctttcctttataaggtccattaaacttctttcctttataaattacccggtctctggtatgtctttattagcagtgtgagaatagactaatacaaaagattttaaaatcttcctatcaacttgggtcattgtaatggactgaccagaactggaccataggtcaaactttgagtaacaactattctaaggttccttccagctataatcttaaaactttctatgtaaaaaacagatatccctatgtccattctgcctcaactcctcctgccaaaaccatacaatctcacttgccattgcattcagcactataaacggaactcaatctaaaggtccatcttccttgaaatgcaatgaaagattgtaaataataatgacaatgacaacaaaatatgctttcccttgtcactggtgattatttatgttccctgaacaacaaggataaaaatgagggaaagcctgtaggactacttaccactagaacctaggccatctgctccctgacctagtagttccctcatctatgcttttgtgctctcataattatcctgactcagaaagcctttactagcctttcccctattccctacctgcagtcttttcaagatccttactgcatttattgggtactcaaagcttatctattaagcacttacaaatagaagaggataaaattataattatttggtccctgtcacatacacacacacatgcacacatgcatacacatatatacatatatggcccctgcccttaagttgtctagagcaattcaatgtttataagtatgttatatgaagaatcacaacagggaatgcagaaggggcaatgacaaaagtcaaagttagacaggaagggtcacataagacttcttagaagaacacttttggggctatttcttgagtcatgactatctggtgatctggctgtaatattaaagaggcttagtcagctcactgaactattacttgcagttcttcccttcctttattgctacatatttggtctagaagtacattctttccaaagagtcgactcctctttcatcaagagtgttctaattaactaaggggggaaaaacatgtgtatgagagtgtgtgtgtgtgtgcacgcaagtgtgtcagttttatgtgtttggtgggagaaaggcaaagaatctgggagagcagcgcatgtaaagtaatgtttaaaggctggagaaggagggaccaccaggtcatgaagcttcttgtatatttccctaaggattctggattcatcctgagcacactggtgactcattaaaaggttttaagtaagggtgtaatatggtcaatgttttgtttttaaaagatcactctagcagcatgatgtaggatatctaggtggtgagcagggtggatctggtagtgccaaggtgttcatctaataattcaaatgagaaatcatgaaatcctagactaagtcagtagcagacaggaatgcgaagccatttcaatctgagacagatttgaagcacaccaagaaggcagaattactggctatgaatcatggacaaatgaatgaatgaatgatgaatgattttgaggatactagcttcagcaattgggagattggtgatttcattccctgaaagagaaaaacactcgtgtaaatacaagatgagagtgtaacaaacaagaattcagatttaaataagttaaattcaaggtgtctgcagaatgtttatatggagaagtctgttgggaggtagaaacaggagtctgtagttagaagttgggtctggactagagaaaataagttgatcaacagtaactgaaggcttgagatgggtgtgattacttcagcatgccttgcctgaggaacttcattccactccaatagatttgattttaccccagaagtattcttcatttttatcacctgtatgttttccttaataggcattgtataaaaatatactcttttttactaaataaaaacataagtgggaaaaataagctaaagggccaatgaggtacagcaatgaagataaagttggactgtgacttacacacaacatgcaaactacttgataccatttactgatctctggatcacactctgacactacactttcaagcaacaatgcaaagggtgacgaaatcgcaagttacatatttaatactcatacaataaaagtaaaccaatttctccaaaacagaattatttatgttactgtgagctgagaaaaatttctcctgaaggtcctcataagaagagcattcaccatattaatggtgagcagtatcttttttttgacacggattctctgtcaccaggctggagtgcagtagcttgatctcggctcactgcaacctccacctcccgggttcaagcgattgtcctgccttagcctagcctcctgagtagctgggactacaagcacatgccaccatgcccgactaatgtttttttttgtttgttttttgtttttttgtttgtttgtttgttttactagagatggggtttcactgtgttagccaggatggtctcaatctcctgacctcgtgatcctcctgcctcagcctcccaaggtgctgggattacagacatcagccaccacacctggccagtgagccttattcttaatcacatccccatagtgaataaaaaataatacttacacaattattatatccatcaatgtaaggtgatagtataataacaaagaagagtagaggaaaggcaattcaaaggaagaagaatggcaaaattctgtcatttatgtggacagcccatgtggattggtatgtatgaatgaacagcaacatttccttcaggtattcatctataatacttgggatatgggatgtattttatctcccaaactagactggtatgtccacatctgcctttccactatttaatgtccacaactttcttcaagatgcattcatttgttccttcaatagtcaataattttctgaactaaagtcatgaaggactgagtcttaaaggatacttaggaatgattcagacaagatgggagacagggtaggaatagaaacacttccaaacagatggatacgtagcatgaacaaagctaccaaggtaagaatgagcttggtatgcaaagaaatataagcaatttagcatggcaacaatgataataataaggcagagagaatgatgagagaggaagctaaaaaggtagacaggagagcattgaaggaattttttcttatctctactcttggcaaatacaactcttggggactgagatcatatgtagccttaaatgttgcataagctgtgtatatggcacagaggtgatctccagtgtctacataaactttgtggaatttcactgatgaaacagtttgtgccatggctggagaaaagcatttggatgcatatttattgactgatgtatcggatgtgatgtgatgtttgaaatatgtcataagagtgctttctagaagaattacccatttgttcattatgtaagagagaaattgtttctggtcctctagaataggactttggggagtgactgcatattaccctgactcattctgccatcaatgtgctggagtcaccattcaacaactgcttcaactcacttggtcctaagtttggcagctcaaaattccaacaacctcacagaatatacctggggatccaaactggaaacagctcattagattcaaaataggagggtatattttagaaaataaaatctagcatacctttactggctcttaaaaaatcagattggaataggtggtctgaaaatgaatttatccagcaaaccatattaaaaaacaaaacaaaacaatatcggagtcctggcctaaataaagtggttggttactacctccctcttcaatcaccttaggctcttgtagcaaaaggacttttaccatattagctgctacaagatttaataaggatatgatgtactatatccttcattttgctaggcaacgcaacattctaaataagattgaatgtttgtcaatatttggaagaggaacctcaggggtttctttaaaaatttcctcttttcctattcctctaagactgattttaacctaaaactgattttttcttttcatgtatacaagatacctttttgggggtttgtgtttatttcccctgaagaaggctttacagagcttggattttaatggaaatttattgctggatgtttgatagccaaaaggattgtgttttgatcacagtcaaaatggcaattttctccacagtagcatagcagcatactagtacaaggccactgcagctagaaacctgtgggcgtgtcaggtcctttgtagtgagtgtcagtagcacctgcaagagcccaatccctaactgtgctggaaggaggtttgatcctattaagtttcaaataatatgtcagcttttcagctttgatacaaattcctccagaattatctattttcccacttgtgatataagacttcgtgaaatgtgtaaaatctaagagggtctgcctcattttctgtgttgggagagctttggaatgacctcggactctgtcaagactagtatttcttgagctttccccaaaccaattaatcttttcatctgggggttatacaatgcacaataataagaattaaaggtaaaaattaaaagaaaataaagaaatcttgttgtataagaattaatgcaacacaaacatagaggccatctcctcaaaactgacctggatggctacagattaaaatatggatggaaggaccactgagaaaaaagacagacatagagagcaagaattaatctaatactacatgtttggtacacaaacaacaaatcaaattgagcaaattattttctcaggagattctctcaatcactgtattttattatctgtgaattccagtaaaatcctcattttctaggtggaggctttcttttttttttttatttctgttttctttcttttttctttttcaggttttattttagattcagggggtacatgtacaggtttgttatatgggtatatttcatggtgaagccctttcaataacaaaaggaagaggtaaataattatacaaacaaaacaaagaaaagcaacattaaagaatacatttaaatgtgagtcaaaagacctaaattgagggccaacaagcatttgctctgtcacttcacttttctgtgcctcagttttcttttctggaaaatggaggtcatgaaaatactcatacctgccctcctcatttcacaggttgtggagcaaatgcaatgagtgtggctcaatcattgccagatcttaacgttgtacataaatgttagtgactgaggacaattatttaacccctatgagctttcatatatccacccgtcaaataaagcttggatactggcctgcctatccccaaaatgatcttataaaaatcaagtaaggtgataccagtgtgtgctttgaagtagtaggtgctatcaagtattagactgtcaaatatattcaaacaactgtgtgtgggaaaagattgtggtggactagaaatagccaaactttagaagtattctatagtctttgggaataaagctgggatgtatgaaaaaccttcttatgatattaaaatgttcacctttgaggaagaaagtagactagcagaaagtttcactatcaaaattctagaacattaactactgatactattacaagttgttaggaaacagtaaattaaactttgtaatgctctcccaaaggaagtagaaatacaccatcattacttatagtttaaattggactgggaacagtgggccagcatgtattatggagaagcaatgcttcagtagtagcaaagtgaaccaaatgacactgcagatcttatccatatttaatgtttgacaggcaaaaatacttacattaatgcagtaatgtgctatgcaagtcatcaacatgggaatgctcaaagctttaatactgtttaataagcatcacactatgagagcatattttccctttcaagtacgactcattcaagtttgagggaactgctaaattgtcacacttggcaaaatcttgaatgacagccaatctaaacaaaagcaatcattttgtattttgggctggtttgaagaaagatgggaagtgtgaggtaggcagggggatgtaggataccccaaaaggccacaataatcagacaaaacccccagcaaaattgcaaaggtaggatagacaagaaaaggcatcaatgctttgcgattgaacctacacaatgacctgatgtatacaaaaaagatgggattttggtcaatggtaaagtttatttcaggggctggaggtgtgagacatggctcctaaaagtaggtgtgtcaatgactaattatctaatttacaataagttgacctctctgtaattctgtcccactttttcaatttctaaaccagcagttctcagttggggaggggaaggaggataaattttgtcagggatattggggttatctggcttgtcaccacaggggaagtgtggtgctactggcatctagaaagtggagtccaaggatactgctacatatcctataatgcacagggtagccctccacaatagagaattatctagctgagattcaataataccaagcttgagaatacacgtgctaaactaaaatcatctgagaagtatattatggggtaaaatgggacctaatcattcttagcataaaagcaattttctaaaaatcagtattttattaatattactgttattgcttaagcttcttttctactgagtttccttttaattataaagcacttggcagaaaaataagattcatttctataataggcttagtgctttctttttcagcagtctttttcttcaattaattaacatttaactgctttcttataatgaaggccaaaaaaacaagctgtctccttaaacttctcaggagaagtgataaaactctgtgagtatattaaatttttctgataaagtatttgtaggacatagatttaggaggtctttctctcttaggaatgttacttataaacatttcttggaagtccaagataaaattaaaaacacgtgcatgattctagaggctacatatgctattgatgctgaaaatagaatgttggcaccggagaagtccttactatatatgtggatgaagatgaactcctatttattagtaattatgtaggaataaacgtgatgattctaaaaaaattatcttattgtctttgttggcatttattttaaaaataagtgaaaaaaaactataaccaatatgcaattcatagatcttctatcatggctaatagttcaaattttgcaagctattggtttgaattattgcatttgctacatataaaaatggaaggtttctaaaagaaaatgaataatagaaaatattcagatgaaaaccaaagcaagctataaggcattcttagaagaactatatatatatacacgtatatatatatatacacatatatatatacgtgtatatatatatacgtatatatatgtgtatatatatacgtatatatgtgtgtatatatacgtatatatgtgtgtatatatacgtatatataagtatatatatgtgtgtatatatatgtgtgtgtgtatgtgtgtatatatatatatatatatatatatatttttttttttttttttttttttttttttttttttttttgagatggagtctcgctctttcgcccaggctggagtgcagtggcgctatctcggttcactgtaagctccacctcccgggttctcgccattctcctgcctcagcctcccaagtagctgggactacaggcacccgccaccacgcccggctaactttttgtatttttagtagagacagggtttcaccatgttagccaggatggtctcgatctcctgacctcgtgatccgcccacctcggcctcccaaagtgctgggattacaggcatgagacaccgcaccaggccaagaaccatattttttttaaaaagtttgccactgtaaacaagatatttaaaatgaccatgaacaatttttatgtatctgtaggcttctctctttaccagaattaaagtgtggggtcctggaagaagcagagggctagaagccacgacacttaggtttgtctcctcatcttggcactttctgagatgttaaattattcaacttcactgattcttcattttcttgataataaatagaggggattagatatagagatgcacaaaatccctcccaactctaaattttcatagttttataagactttgagtttaaaatcatttgatctacttatataacactcataatttttgtatctttatttccatatgcacagtttatgttatgacaagaaccaactcaaactagcttacgccaatacaggaattgattggcttgtcttccacacaaattcagtcagcatgcggatcctgctccagggactcaaatggcatcctcagtatttgttttttctatatatctcagctctgcctcatgctatgtttatttaattcttgaggtatatgtagtaattccctattgctccaagaatactcttcagcagcctgggcaacatggcgaaaccccatctctacaaaaaatatgaaaactagctgagcataatgacacacctgtcagcccagctccttgggaggctgaggtaggaggatcaattgagtcttgcaggttgaggctgcagtgagctgtgattgcactactgcacctctgcctgggtgacagagtgagaccctgtctcaaaaaatatatattttttcccattttcaaatttcagcaataaataaataagaagctgtttttcttttcttctctctactgtcctagcaaaagtctgcttctttctagtttgctttgatcaggctataggcctctctttgaaccagtgattgcagacatagaaataggatacacagatttaagtggcatgaatgacatgtcttctcctgggaccagagatgaggtaaatggaaagaatgttcttgaagcaacaggaaaatacaataaatattttgagtattaaaccaatatagtaaaaagcagagctgagagagagaaaccaaataaggacaataccatttgaatccctgaaaaaatacctgtatgaagactgaaatttcatgaagaacaaaccaataaatctctgtgatttgctttagtttgagttgttgttgttttttgtttttttgtcacaacataattagtaccaactgaattaaagataattttttaaattacagagtattatatcctatattaaaatcaataaaaaattttaagctcaaagaacttgatgatatctttgatacaaatgacatactttatacttaataggttcccaataaatatgtattgtttggtacaatgtaatgaatatagaattaaaagaaatatgtatgtaccaaatgagtatgtaccaactaagaagaagggaaaaagggtacattcatttcctatctatataataatatggcaaaaagaatggaaaaatatatacataaatgatgcaagaaggaggcaaaaaaggtgataaatttcaaagtggaaacactcaagatatatatgttgtccttcaccaagaaaattacaaaagaccttgatattgaaggcttcttctttgtcttcttgatgcctcccatttcttctcagcgaatttcattggtacatacccatcctaatatgataagagcattttaagaaatacctgtaaataatattttcccctattctgttagaatataagctccataactttagaaatctttgttttgtttactaatatataccttatactactaagtaaatccctagaataaataaacaagacatagtaaaataattgtaggatgaattacaaacaggtgataaaatgaagaagcctgaggagagggccaagcaggatatgaactgttctgaattctttcttctacctttttttctcaccttaaaaactctggtccttatcacctgtattgattcatatatatatatatatatacacacacacacacatacacacacacacacacataccacttaagtcagatttcaggattcagaacatatggaagatggtgattatcttctagactctatattctaatgaaagataatattttcttttgggaggcatttcatatattccataatttattgaggaaaaaaatgatattgaggtcaattatactatagagtttgtaggataacttacttaattgtgttgaagattttagatttgctgagcttggaagaagaaaggaagagagattgtgtcaaacaccaaatgagaagctgttttgagggtaaaagatcctagaaataaaaaatatatggtagaattaaagtaaaaatatataaaatctaaaagaagattcctacccttgcattttgacttcttccctggtagacaaggctagaaggaaacaggatttacatggcaggagagtataaaagatgactcaagtatttccgtgaagaaaataaaaagatcatgtccactgtgtcataaaatcacatcacccttctgatcaaaagcaatcaagaacttcccttaggttttagaataaaatccaaatgtttcccctgcctatgtcctttattattacccatttgccctcatgattttctagtcacaccagccttcttgcagacctcaaagtcgccatgcttgttttcatcccaccggatttttgcatgggttgttcctctttcctggaatgttctgccaccctcagcccccaacattcccgtaactagtccttctcctcagttaggtcaaagaacgaatgatgtcacttcctcagagtgacatcttctctgacactatctacagtagccaattcaccagttactttctatcagctagactgctttattttcttcacctcagcagaagattttttgttcatttattgtttgactttactaactttattttctaaaattaaagccccataagagcagagaccggccgggcgcggtggctcacgcctgtaatcccagcactttgggaggttgaggcaggtggatcacgaggtcaggagatcgagaccatcctggctaacgtggtgaaacccgtctctactaaaaaatacaaaaaaaaattagccgggcgtggtggcgggcgcctgtaatcccagctactgaggaggctgaggcaggagaatggcgtgaacctgggaggtggagcttgcagtgagccaagattgccccagcctgggccacagagcaagactccatctcaaaaaaaaaaaaaaaaagagcagggaccaaatgcctattttaatacccccaaatacctagaagaatacttgacatacagcagtgaatcaattattattgaaatctcctgtgtgtgtatgtgtgcacgtgtgtgtatccatgaatcaatgaatcaatgaatcaatgaatccattaatcatccaaaattaggagaacttggggcaagcctgagacacttagggcagagggggaatgaaggttagagctgcttctgaaataggcagagtaagcagtggtataaaaattttttttgaaacatactgaattgaagcagaactgagtatcaagactttcaacaaatggcctaggtccttttaatgagtttgttggcctggacagttgtcccataaagctctctccaaaattaggtaatcaaagaaaactattaattcctgagaaattgccttgtattgcctttatttcaaatattttaccatgtcataatcatatttatgcaaatgtggcttaaacaaacttttggaacaatcccaattatttgttaagagtcacttgctattaacatgaacaaaagaaaatttaaagaggtgatattaattatatcatattaaaatattatggtcagttttctagtagcccaagagtccttggagacatttaaatagacaattttgatatctcaaagctctttgacatattaataatattgaatgttgcctcactccttaatgaggagtccaataatcttctaaatcataaataacaagtggattcaataaaataacaagacagtaactgctgatattgaaaagtaatgagaagaccaataaaggagaatgcagtaagactacaagggagagagggggaaaatgagaagaaaataactcagtgcagctgggatttcacagtattcctaatacttgtgatctagtcccacaaacaagatagaaaagacacagagaaggcaaaatgctacagatctgctttctccacacttgttttaatattttgggaaatttctgaaaatagaacaaagaggatagcaatgaaactgcagagaacaaaaggacaaagctgatgagtattaggcccagagaaatttggaaaagggaaattagacacaggagtcttaaagcttaataaagtatccctcaaaaataaagaataagaggtgtgtaactgggagtatgcatgtatatgtgtgtatttgggtatatgttgaatgaaggttcatcaatggtggctctagaaatagatcatgggaaggacttgggtgcagactgaattctaatataattttatttacagatacttaaatttgaattttacattatttttatatgtcacgtcttttaatttttttctttttttattattattatactttaagttttagggtaaatgtgcacaatatgcaggttagttacatatgtatacatgtgccatgctggtgtgctgcacccattaactcgtcatttagcattaggtatatctcctaatgctatccctcccccgtccccccaccccacaacagtccccagagtgtgatgttccccttcctgtgtccacgtgttctcatcgttcaattcccacctatgagtgagaatatgcggtgtttggttttttgttcttgcgatagtttactgagaatgattcccaatttcatccatgtccctacaaaggacatgaactcatcattttttatggctgcatagtattccatggtgtatatgtgccacattttcttaatccagtctatcgttgttggacatttgggttggttccaagtctttgctattgtgagtagtgccgcaataaacatacatgtgcatgtgtctttatagcagcatgatttatagtcctttgggtatgtacccagtaatgggatggctgggtcaaatggtatttctagttccagatccctgaggaattgccacactgacttccacaatggttgaactagtttgcagtcccaccaacagcgtaaaagtgttcctatttctccacatcctctccagccaagatggccgaataggaacagctccggtctacagctcccagagtgatcgatgcagaagacgggtgatttctgcatttccatctgaggtaccaggttcatctcactagggagtgccagacagtggacgcaggacagtgggtgcagtgcaccgtgcatgagctgaagcagggcaaggcattgcctcactcaggaagcgcaaggggtcagggagttccctttcctagtcaaagaaaggggtgacagacggcacctggaaaatcgggtcactcccaccctaatactgcgcttttctgatgggcttaaaaaacggcgcaccaggagattatatcccacacatggcttgcagggtcctacgcccatggagtctcactcattgctggcacagcagactgagatcaaactgcgaggcagcagcgaggctgggggaggggcacccaccattgcccaggcttgcttaggtaaacaaagcatccgggaagctcgaactaggtggagcccaccacagctcaaggaggcctgcctgcctctgtaggctccacctctgggggcagggcacagacaaacaaagagacagcagtaacctctgcagacttaaatgtccctctctgacagctctgaagagagcagtggttatcccagcacgcagctggagatctgagaatgggcagactgcctcctcaagtgggtccctgacccctgacccctgagaagcctaagagggaggcatcccccagtagaggcagactgacacctcacacggctgggtactcctctgagacaaaacttccagaggaacgatcagacagcagcattcgcggttcacaaaaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcgccatcatcaaagaccaaaagtagataaaaccacaaagacagggaaaaataaaaggaagaaaaactggaaactctaaaaagcagagcgcctctcctcctccaaaggaatgcagttcctcaccagcaatggaacaaagctggacagagaatgactttgacgagttgagagaagaaggcttcagatgatcaaactactccgagctacaggaggaaattcaaaccaaaggcaaagaagttgaaaactttgaaaaaaatttagatgaatgtataaccacaagaaccaataaagagaagtgcttaaaggagctgatggagctgaaagccaaggcttgagaactacgtgaagaatgcagaagcctcagagccgatgtgatcaactggaagaaagggtatcagcaatggaagatgaaatgaatgaaatgaagcaagaagggaagtttagagaaaaaagaacaaaaagaaacgaacaaagcctccaagaaatatgggactatgtgaaaagaccaaatctacatctgattggtgtacctgaaagtgacggggagaatggaaccaagttggaaaacactctgcaggatattatccagaagaacttccccaatctagcaaggcaggccaacattcagattcaggaaatacagaggacaccacaaagacactcctcgagaagagcaactccaagacacataattgtcagattcaccaaagttgaaatgaaggaaaaaatgttaagggcagccagagagaaaggtcgggttacccacaaagagaagaccatcagactaacagcagatctcttggcagaaactctacaagccagaagagagtgggggccaatattcaacattcttaaagaaaaggattttcaacccagaatttcatatccagccaaactaagcttcataagtgaaggagaaataaaatactttacagacaagcaaatgctgagagattttgtcaccaccaggcctgccctaaaagagctcctgaaggaagcactaaacgtggaaagcaacaaccggtaccagccactgcaaaagcatgccaaattttaaacaccatcgaggctaggaagaaactgcatcaactaacgagcaaaataaccagctaacatcacaatgataggatcaaattcacacataacactattaactttaaatgtaaatggactagatgctccaattaaaagacacagactggcaaactggataaagtcaagacccatcaatgtgctgtattcaggaaacccatctcacacgcagagacacacataggctcaaaataaaaggatggaggaagatctatcaagcaaatggaaaacaaaaaaaggcaggggttgcaatcctagtctctgataaaacagacttgaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaacgagacttagactcccacacaataataatgagagactttaacaccccactgtcaacattagacagatcaacgagacagaaagttaacaaggatacccaggaattgaactcagttctgcaccaagcggacctaatagacatctacagaactcttcaccccaaatcaacagaatatacattcttttcagcaccacaccacacctattccaaaattgaccacatagttggaagtaaagctttcctcagcaaatataaaagaacataaattataacaaactgtctctcagaccacagtgcaatcaaactagaactcaggattaagaaactcactcaaaaccactcaactacatggaaactgaacaacctgctcctgaatgactactgggtacataacaaaatgaagacagaaataaagatgttctttgaaaccaacgagaacaaagacacaacataccagaatctctgggacacattcaaagcagtgtgtagagggaaatttatagcactaaatgcccacaagagaaagcaggaaacatccaaaattgacaccctaacaccacaattaaaagaactaggaaagcaagagcaaacacattcaaaagctagcagaaggcaagaaataactaaaatcagagcagaactgaaggaaatagagacacaaagtacccttcaaaaaattaatgaatccaggagctggttttttgagaggatcaacaaaattgatagaccgctagcaagactaataaagaagaaaagagagaagaatcaaatagacacaataaaaaatgataaaggggatatcaccaccaatcccacagaaatacaaactaccatcagagaatactacaaacacctctatgcaaataaactagaaaatctagaagaaatggataaattcctcgacacatacaccctcccaagacgaaaccaagaagaagttgaatctctgaatacaccaataacaggctctgaaattgtggcaataatcaataacttaccaaccaaaaagagtccaggaccagacggattcacagccgaattctaccagaggtacaaggaggaactggtatcattccttctgaaactattccaatcaatagaaaaagagggaatcctccctaactcattttaatttttttctaacttttaaaaatatgtaaaaataattcatagattgcaggatatacgaaaacaggtagattaggtgctcgcaggccataatttgcctctgccatcaaacaatagcataccataatctacatctgtgaattccaagggatcacaaacagaaaagcacaatggcagctgagaacaatagtggaagaatacatttttattactgttattacttattccacttatacaaatggaaaatgccatttttaaatttggtatttcctcttgtgcctcctcagaaattatactaaatttctttcagaattcatttattattaatgtgcccagattgtttcagtataagatttcttcattaaggtgatttcattttgaacagaggcaaagaaatacatttggctatttactaactataaaatatacaactgctgaaagctcgatggcacctaaaggaattgaccactttgttatcccaaaatgttctgacacttcaatgtcattgaaataatgccagagatatttcaagggatttcttttccttttcaaagatgcacattaaatagattgctatgtaaagctgatacatcatttagtcctccccaaaagggaaatgcaggtacaggcatgtttgcctcctgactcccagacaccatggctgggaaataaaacaagcaaggctgggaatctttggagtcaggcaaatctgggctctgctcaataggaagtatttgtttctttgggcaacatggagccttagttttctctccactgaaacttggaccttagctccctcacttctaaaatggaaatagaaatttctacttcccagggaaaatgagaggtttaaacttaaatgaaatgagaaagtatatgtaatattcacattgctagcacaatgtgtagaatctattattatcctcgaataccctctgtgatacacatagaaatagacacagcttctcccagcagcctagtagttggttgaaaattgttctatattcacaataaaagtcattcccagaagttgttgcaaggaaagaagtgatcctgttacaggtttgttgagacaggaagatacaagaagacaaaaataaaaatatttctttaatattgttattgggccatctgaccttagaagctagattcctgcttaaaaattcatgactaatttttagcatgaaacagcagaagtttccaattctcaagagacccactgcattgaaaatcctggggtctttttgtatggtccaaaactaatggagacaacttagcccatctaaaaattgggtgaaagagacgtaaggggggggggcaataaaaatgtatttttctaactagttttcaggtatccatattccaaaatagaacagcatctttgccagaagttcaagtcattaaggagttggtatggcattctcacttacataaagtatgggcacctctgaacaatgacctgaggattactaacaggtatgcaacatatttgaaatgtcaggtacagcaaagcaaatgactttatcaaaatataaatcacacttttagcagaaaaaccaatagttatatgaatttaacttcatctttaagtgcaaagagtaatattttgtgaattttctaaccgttttttagatgtcatcagtgtttcagaaactggtttctttcattttaaaataaagagatgctatttacttcatcattttccagccttcctgataggcgtatactcacatgaggagatacaaaactgaaaacattatctcattatagactatccacgatttaaaccttcaagctggcaatatgtatttaaataatatgtcataaacacctcttggtacataataatgtagtaaatatgagaatgcctttaaagtgaactaacttattctcccaactgttagattattccctgctatgatcccatcaccaagtgaaattttaggcatattcctctaggcaaagtaaatagttatgaggaaaaaaatattgctaattccagttgaaataagaaagcctcttaatcatctaaaatatttctggggcagatgcagtggctcatgcctgtaatcccaacactttgggaggcccaggcaggaggatcatttgaggtcaggagttcaagatcagcctgggcaataaagtgaaactctgtctctattaaaaaaaaaaattaaagaattatccaagcatggtggtgtgcgcctgtagtcccagctactcaggaggctgaggcaagaggatcacatgatcccaggaggttgaggcggcagtgagctctaatcatgccacagagtgagatactgtctctgaagaaagaaagaaatacataaataaaataaaataaaatgttctctatgggccagatttctctctgcttaggtcaattaaactacaaatttctcagtaatttttgaacgctctatctcccaagatgcctaggtggaattgttaggaagcaactgcccatccacaaaatatacctggagaatctcagatttcattcactgcttttaaaaaaggaaacaagaaaatcttcctcttagaagaaatttaatcttttaccacttttattacttttattatagaaatatatatgtatatatacatatgtgtatttatgtgtgtatatatatcagatatatctatatatatatagatatatagatatctatcagaaagcaaaacttaccttccttagacaaatggagatttggggaaattgtattggagtctagaagaataaatcctaggaaaagcaaacacacggtatacacacgcacacatacaaacctccaataaactttgggaaaaaaatttatatacacaaacactgatacacaaaatatatggattatatatgtatgtatatgtgtgtatatatattaaaatataggtttattcaccaatcactgaaaaactacatcataaactacaccaaaggagtagttttaggacaaatggcaaaaaatagtaccttacagagttgacagtttggaattgcaatacttcagatgatcacaagctttaaaaatgctcaatgtgctcgtctatgaatttcaaaatgggtataaattaaaacttattacactttttttaagttgcattcccagtacatgaaaaaacattgtcctaagactacctctttgaagcaattttcaaggattcgtgaatgagtatcgtgagcaataaactaaagctgcataagagagatatagtgtataaactgtgctagcatattatctttggttccaatcgcctcataagcattgctacactgactcaggccaatggtggtctcaaaacaatgttttcatctccctgaaccatttattcttttagaacataactcattgttgggtttcaggtgactattctgactgccattccaaggaaacaggccttctgaacaagaaaaaaatctgaaaacggaatatttcctttcagagatgtatggaaacaagctctgcctttttacccatgccataatgggtcttgctgagagtttgcttcaagaaccagaactcagtaaatgtaaacattcccttaaacagatgcacatatgttcttaatataaaatcttccagatgtaagtttcatgcaagaaagcaaagtgacctagcaagaattgagctttccatatctggtgaagcatttttcttagtgtgtgccacaagcagttattctgagaaatcatgcatctgctcctcttcacatggacattccacttctgatgagactacattcttggaaaatgtaggcaggagctgaattcaatcttacaatgtgtgtgcgcttattccttccatctatcacttacccaaaatacctgcaggtggtatcagaaatgagctttaaagggcctgtggcactgattacaaaaaaatgttaagtggtatttcatatggttgtggagtgggcagactcctgcttaagattcataatcctcatcagtaacacaagtgtatcacactcacaagataatattgaagtaatagaagaaatcgtccagaaatgcaaaaaatagttcacgtaagatgcaaaatcttatgacaaaatgaaatcctgaactaataaatagctctgtactgatatcaggccctaaagcctatattactgagagataaaacgtgggggacagcaacttagagatagggctattacattaaatctatgattacattagctaaaaagaaaaagcacaagagatgaaacaaaacatccaagaaactcatcaagatttatgcttcaagcaatgtcctaatatctgagaatatcaagatatgaggacactaacaaaagtattattattctaccggatcatttaaaaaattccttttgttctgaaatcaaataaaaagtaacaagactggcctgagtagcagaatatacatttcatactttatatttgtgtatgtctatatatatgtacctttacacatacacacagatacacataaacaatcacatctgtatttcatatctgtatttcaaccttctccattcactggaacagacatttaggttgattccatatcttgtatattgtggctaaggttgcaatgaatgtaggagtgcagatatattttcaaggtgctgatttcatttcctctggatatatacccagaaaagggattgttggatcatatggtagttctatttttaattttttgaggaagctccatacattttttcataactgtaccaatttccattatcagcaacattgtaccagggttcccttttcttcacactctcgccaacacttgttatctcttggtgtttttctttttttctttttttttaaataacagccatcttaataggtgtgaggtgatatctcattttggtttgatttgcatttctctcattagtgacattgagcaccttttcatatacccgttggctatttttatgtcttgtttagaaaaatgtctattcaagtactttggtcattttttttataaatacatacacatatgcacatgtgcacatatacatgggtatgcacatacatatgcatattttaataactatgagtactcaatgatatttaccttttttttttttgagatggagttttgctcttgttgcccaggctggagtgcaaagtcatgatctcagctcacaacctttgcctcctaggttcaagcgattctcctgcctcagccccccgagtagctgggattacaggcttgtgccaccaccctggctaattttgtatttttagtagagatggggtttctccatgttggtcaggctggtctcgaactcccgacctcaggtgatctgcctgccttggcctcccaaagtgctgggattacaggtgtgagccaccacagctggcccactttggtcattttttttaaatcaagttacttggtttttttttgttttgttttttgctattgtgtgagtttcttatttattttagagattattaactccttgtcagatagtttgcaaacattttttccaacctatagtttgtctttttattctgatgattgttttgttatacaaaagctttttatagtcccacttgtttaattttgctttcagtgcctgtgcttttggtgtgatgttcaaaatatcattatgaaggacaatatcaagaagtttttcccttgttttcttccagtagttttagagtttcaactcttatggttaggtatttaattcattttgacttaatttttatatatggtgtagataagggtccagtttcactctttgcctgtggatatccagttttcgcaacaccagttattgaagatactaccctctctccatcgtgtcttcttggtagccttgctgaaaattggttgactttataaacttgggtttatttctgggctttttattctgttccattggtccatgcatctgtttttatgccagtaacatagtgtttggttactattactttgtagtataacttgacattagggaatgtcatacctccaactttatttttctttctcaagattgttttggctattcatggtctttgtaattccacattaattttagaatttttccatttttgtgaaaaatgctatttaagtatgtccatcattctaaattaattataagagtgaagttatgccctaaattgttcattttgtaagatgtgccttgcagttttgcaccttgcaaaatgagcattaaaaattaggaacagtattttgctaatttgttcctgtgatctagaatacataattttattctatagcaggagctgtatattctcacatcggaagaaagtaatataatctgcttatatagcacatggtgtagccaataaatagcattttacatttcgtcccttttttcctttctctctcatactttcctactatttttaacagctttattgagttaaaattgacataaaataaacatcccacatttcaagtgagtgtacaatttgataaatttttggtaggaggttattgattgaattttttatattaataaccagttgttccagcaccatttgttgaaatgattatcctttgcccactgaattgcctttgaactttggttgagtatcagttgtctacatccatgtagatctttatggactctagtcatttctattgatctatttttctgagtttcctttaacactacactatcttgataaccatagttttataatgagttttgaaatcaggcagtcttagtccccaaattttgccttttatcaaagttgttttgactattctaggtcctttgcatataagtttcagaaacagtttttcaattactagccaaatgaatgttgggattttgatctggactccattaaatctacagatcaattgaggagaagagaagaccactttaacactgttacagtttcaacactgtacagtttaacatcataatctgcatttatttaggtcttccttaatttctcttggcactgttttatacattttgtgtacaagtcttgttaattttttatagacatatttcatattattgatattattgtaaaaggttttactatttcaactaatttcaattactcttaatgatacatgtaaatactactgatgtttgtatacggatcttatatcctgaaaccttgcaaagctaagttttgagttctagtaagtagtagaggttgaataaccctatccaatacacttggaatcagaagtgtttctgattttgttttttaattttggaatgtttgcatatacataatgagatatcttggagatgggacccacgtctaaatacaaaattcatttatgttttatatgcaccttatacccatagactgaaggcaacattatataatattttaataattttgttaatgaaaaaattgtatattttaaatcatcagaaggcaagtgtcaacatctcggccacccatatgagccatctgtggttgtttggcatcacaatcattcttgattttgaacttataagctactgataagcaacaattttcttaacttatttacccataagtacttatctgtaaaaaatatggcatgccatttacacagtaaaaaaaaaacaaatgtgtccagggtaactaagcagcacagcagcatcaccagaattcccgtaacagctgttgaacatcagcaacaaccaacaatggcaggctttcagtctccacctatgatgctgtgttttgattaataggttactgtgtgctgatttttttttaggtgagagaaaaaaaaaatcaaaacagttgaaggaccaggaagtgagtcctctagggatgaagaggcattttgtggatggcttttaaaaatgtttccttcagagtcatcttgcctcattaacaatggtttttgtcttagaagtctccctttgggattacaggcatgagcatgggtggatcacctgaggtcaggagttcgagactagcctgaccaacatggtgaaaccccatctctactaaaaatacaaaaaattagccgggcatggtggtgggtgcctgtaatcccagctactcaggaggctgaggcaggagaatcacttgaacttggaaggtggtggttgcagtgagccgagatcatgccaccggcactctagcctgggcaacaagagtgaaactccacctcaaaaaaaaaaaaaaaaaaaagaataagtagtagtagtagtagtagtagtagtagtagccatcgtcgtcgtcgttgtcgtcgtctctctttggctttataaactgacatgatttcttgtgctgttataaatgtacagtgctgtagtccttcaataagcccgtcacacatttttaccttatccataggaactttttcttcagtgttaacaatgtcattttaatcatcactattatcacaatcaacttgattcaaaaccatctggactatttccccattggtcaatgaagaattggaatctcattattgatgttaaaaataatcaagttctttgatatttacttctgctagcctagggaaagactctgaaattatattttttgtgtatgtaaggaggtcagacaccatctttttttctcagttggcccacagaattcttcaaagtcactaccttgttcatcaagatcacttaatatagtcacaggcaagaggttgtgccaggagtgtactactgtgtctttagtcactgcgttccaagtgttagcaatggcataaacagcacccttcatgctaaactccttctagaaaccttccacacccacacctctcttcactggtgctggcatgatgttcaagaaagtgtttttatatttactcttcatcaatctaaggataccttggtcacatgactgaattaatgaagtcacatttggggaaaagtatatggcataagcattatttttgatgaaaatttcagctgaaggatgagcagaaatgttgtcaaggaataacaaaaatctaacagttgtcatccaatccagcttccttgcagtaaccttgagcctctggtataaatgtttgtgaaaccaatcagaaaatatgtccgtggtgatccatacctttttgttaacataatagtggactgctgagaaattcactccttgaaaacagtgaggatgcaagcttttgcttttcagaacaagtttatacttttgtatgcctgctgcattagcacatgccagcacagttattgtccttggaatccttaatttttgtaggggctacctcattagcttttgtcagtgtctttctggggcaacagtaccaaaacagtgatgtttcattagcattatagactagttctggcatcagattttcatcagcaatgactctggcaaatttgtcaatgaatttttccactactacatgaccagaagatgctttatcactacaaatctttaaaaatgtaatatcatagtttttcttaattttctgcagccagcctgttgagtactcatggttcccttcaatattcatttcctcattatagatctttgcttgtctcccgattcgtattccattaagtgacaagtgttcactgcaatggtaatggatccactatttaaatacacaatcaatatttttattgttagctgtatacggtgtttttctatttttcattgacttctattcatcactttcagtataaaacttcaacagtttatccttctgtttcttcaggtcatatatggtagtcaacactatactcttccatagaacatttcaacttccgccactgtccagtttcttcttcttcaacagtttgactttctgtgctgtagagaaacataaatgcttctttttcttatcactgttacccaatactgatatcacagagggaactgcaggagtttttaatatttttaataatctttacaccatagagcagataataagaaaataaaaacacagtaatgcatgtaggtcttggccccatgtgacacattattggaaacctgccattggtgtgtttggcctgcatacatgccattttattaccctttatgagtgtgcctgcatagtgggggtggaggaatctgggtacttaagaaagatatatttcatagctgaaggggtctgggagggtcttcttccccttagggatgctgaataaactgtgtgctcagagcctgttttttgactacaccagtcacatgaagtcatgtatagaattttccacttgtggtattatgtaggtgttccaaaaagcatcttggattttcacattagcaatgctcaacctgtactagtagattccatcatattttctacataaatgatctcatgtcatctgtaaagctttacttcttcctttccaatctggatgtcatttgttcattcattcattcattcatttattgctttccttagtgcactggctatagcatctggtataatgctgaacagaagtggtaagagtgaatatccttgtcttattcttgatcttaaagtatccagtctttctgctctaatgatgtttgcattttatagacccctcttatcaagttgaagaagtttctttccattcccagtttttactttagttgaatttggtcatatttttgtctgttgggataatcatatggttttcttttttaatttgttactatggtaaccttacattgatttgttttaatgttaactaacctagtattcttaggataaatcgtatttcattaggatatgttaagcttttagatacattgaattagatttgcccacatcttaaaaataaatttttgtatctatattcatatcgatccatatatttactaattttttataatgtctttggttttagcatcaggatagtgttagcctcagagaacgagttgggaagtagtttctctgctcaattttttgaaaaataattgtatatacttggtaataggtactatttcttacttaaatgtttggtagaattcatcagtgaagccatctgggcttcaaattttctttgtgggaagatataaatgttagctggattaaattgataatgatgccgtttaagtcatctacatccttaactaatattttggtttgaatgttctatcaattattgagattgaggtgttgacatctctaaatataattgtgtgtttgtttaatactccatctttttttggaagcataatatcccttccttaacaaattatcttcttttattctatttgcacttttactttttattatgttcttttttgatccttttaagaatactggttgtactaaatgctacccatggttacactgatttttgtcttaggctttattcatttctagcccaactatatcttcctacctcttgtttgaaacagaaatattcatttttctccataaagcaggcatcccttctaatcctaagcaacacaattctcctagacacaagtattttcaagccagtcatctttgacatcactttatagaaaatacatcttctcagttaaatctttactcaagtagtgtattatcctccctctgctatcagtccctgactgtacttcatgttatgacattttaaattattgtggtaaacctcttcagcctctagaacagtatttcatacatcatcagtgtgcagtagaaacaagaacatccccaggtttactactgcctacaaaaaacaatggaaattcttcagtctatccaaataaaccagttgtcctcccttggcatcactctgtctccttccatccttcatccattcattcttccttttcttctttccttccattcaacaaatatttatactcgctcttaaatgcagctttcattcaattaatctactcattgttgtcaaaagatagcttatctttttttttttttaattggaccatatggccccactactcttcctatgcaagtcttgcaaggcccacttttagcccatcttctgaatgaacattttctgtctccaaagacagcaatttctctcatttctgagcatattattgactgtgtacataaacacaccaaacagcagtggattaaaaaaacacacagaagccattactgcctcaatcagttaaataagaatggttaaaaataatctgttgtttaaactgatggaaacaggaaggagaatgtcagcttgctttttaggctattgtcttcctgataacactggtagaaagataatcctttaccctaaaaattaatactgaattatgaggaataaatgcatacatagttcttcctgccatgcagtccatatgaaaagggggagggggtcacaacagcttaaataaaagagaagtttcagtttgtctgtaaatgtctacaccataaggaaaaaaatatttgaagccacagtaatgagagagtgtttcggtagaataaagtgtgaaatttgtaggaaggagaaccaagactgaaaatacaaaaacattattaggaaagagacattgcaaaacactataatgtgtacagttaacagaattagcagagaatataagagacacacaagaagattatgaaagatatcaatactagaaagacagaagagaatgtttaaaatagtaagaatactaatgtgtccaatttaagcatttaatgatgtttaaataaaaaataagccaccctttaaaaattccttctttattttagagttccaagataaaaatattgggaaggtatttttcaatcagtaaaacaaacttcagttagaaaaatttactattagataatcttattaatatctataaaagctgcattcatattgatttagcctacacccactttgtgcacaatgtatagagaaagaacagcttataaaattaatatctaggcaacgatggccacagtgcattttaggtatggccacttttacagtcttttgtaataattacattttaattttttttttgtcttagcaactggatcgtaaaatctttgagggcagggctccctcttacactctgtgtatcatatatagtatctagcaaggtagaaattaaataagatttcctgaattattccctggctgctcatcttaattgtaggaatccataaatgtctttcctattgattctaacatgttgggagtgccaagtatccttaagattacatccttggactagagatttaatagaaacacttcatttaatattaatagaaaagaaactaactcagagtaccaatttcttgggtggaaatacatggataataagtgacaaggtggtagaaaagcaagctacctatttcaaaaccatatttcatgtgtcagctggtgttaactaaccaggcaactactatggatgtaaacaataactacagacaacactttccaagtcttcatatcgtatctccttagaaaaaagctattatcaagcagttttgaaatccacttaaaccttttcaaaatgtattatagatttacttaggacaaagtgttctggtgcattcagtcataattggtaggaaatatcaatcaattgtttcatttgtcataatgttaaagtcactcaatctagggtcttagctgatttctcttttctgaagaactataaaacgtacaaataaactttatagaaatgggaaaatcccaagcatgtattaaaaataattcttgccactaactataaaacacatcaactctggcaagagcctttcctggggagcatagtgtacaaggtctagatgtgactatcatacagagcttttttggcttgccaatgctgccaaaaaaaaaaaaacaccactgactggatgtagcttaaacaacataaatttattttctcctagttctagcggctaaaagtccaaaatcaaggtgttggcaggtctagtttcttctgagacctcttgtctttgcttgcgggtggcggccttcttgctctgtcttcgcatggcctttcctctgaactaacacacattcctggaatttctgtgtgcccaaatattctcttcttacaaggacactagtcatgttaggtaaagtcccatcctagaagtctcattttgtctcaattaccccttgtaggaccctatctccaaatgcactctcattccaaggaaggtgctaggagttagggcttcaacatatgaatgaggaggaggaaggaagagatacaattcagcccataacaagaggccagagagctgtcatgaaatttcaggaaagatatagctctctcaaataatatttttactgagtatcactgaatttagagccaaaagagacctcaaagttgatcatgtctcaccacctaggcaatgctgaaatccctcgtaaggttgtaaggtttcactgactagtctcagcctctgcttccttatccagggaattcaccactaccatggaaatagatgccatttatagagagttaatcattgtgtggtgggataataattttgaaatatcaaccgttttttcttttccatttttctatcttgtattttctcttttcatcaactccagtgagcttttattctatacttatcacctcaccaagtgatatacactagaagcttttagtgtgaaaacgtctaggccccgtaaagaccaggaaggatctggcatttgcactctccaaggcctgaattcctctagaccaaattcataaacacagcagcagaaccttatacacaaccttatataaacttgagaaaacctaaaatatagggaaataagatttcagggtagaatggcttgctctgtgtctgtttcagggctctgtgtctccttagatggacctaaaacagtccacggaatttcctgtgcttggatgtggcacaggaaaatgaatcccatcttccaaaaggggccttgacatagctgagataggacttgtagataggaacaagtattgattcagtagcaacttgcatgggtgaatgactagaaaggataatgagtctcagcaaatgtcagatgaaatggaagcataaaggtcgtcatcccttggcaatatggaaagccccataaattagagagctgccaaatggctaaggtttagtttttgccattctgtctcaaaacagaaattatttcgagaaaaaacctctattttttgaatacttgggtttatgactaccattaaacaaaaatatttattccttattacttcttcactcacttatattgattacaaaagtatgaattatattaaaagttggtgttgtttattacaaacaagaattgaaatgagatcaactagtatatttgttcttatacgtaggtgacacacggtcatttcaatgcccactctttaagaccccttgggcttgtaaaacatgaagtacatattaagaggtgtgaatatgtacaataccaacaaacatggctgattatgagcctcccaaacattctttaaccaaatcagaaccctaatgtgtaaatttcgctgttgtagtaagaaatatacaattatgatatttgaaatgctattagaaattaagaaagaaactaataacactatacgttgcttttgaccctaataaaatactcataaaaataaattggatgtgtcaatgtgtccatcctttgagatcaaggccaattgtagcgacatagaatgttgaaactgaaagggttcttagaagccatctggcaaacactctcataaacagatgtgagaattgagatccagaaacatgaaaagatgtgtttagggcaacagcagtcactggcaaatccagtgtggaagatggtgtcttcacacattccacttctttttctgcaggcatctcaaggtcacagcagaatcatttcttcaaggtttccttactcttctataagggcaatcacatggttgatgcttatttaaaatatttaaaactatttataatcatgaatgaaatttaaaagagtcaagacactagctaacccaaaagttgggcttttcccttttgagaaaatatttttctaactgatagaacatttggtttctcaacttttatctatcattaatgatatgctccactgctagaatgatggaatggcctagattgtttagagtacacgaaattatctttaatgaagataatttcattatctttgtgataatgaagaattagcctatctttgtgataatgaagaaataaagatttcttcacaatgataagcttagttgaatttagaaaaattaatatgtggctcctaaagcattcataattatatataaatctctttaataatttttttcctaaagttatctctgtgataatatatattctagacatatattcaaatatatttaagatatattaaaagtagtaattttaaatacagtttgaggaaagaattaaactctgagatatttataattcaacattgaaacaaatcttaaaactttgtcatgcgcttgttacaattacagttttgtaattctgtttgcatcaggtatgttgcaaataataccacctctttattcatttagcactttctatctataaaacatcttttaaatatactactaatttcatccatgccttgctgtagaatctttaaaaatgtgttagcagtttatgcagttttttcttctagttatagatcaaaagattcagagttagccacctgaggtaggcagtgtggaaacctactctcaaatacatttttggtgagtgaacataatcctattttctaccaattgacacaaatctcaaactgatttgttagaacatgtattctgcaatagtcaagcaatacaggacctggaatacacaattagtctcttcaagaaactttttcagcctttcaccgtgaacaagaaacaaaaaaaaaaaaaaaaaagtaagaaacttcagcaagataaagaacataaactcatcatgacctttagcttcagaaatttcagaaattttaattgaaacattaaaaaacagctatatatcatgaaatatatgaatttaagtacttgaactctctaataatgtatcttcctaggtgtccctcattcatatgtcccattattcagtctgcttttgtcttccttgtgcttctctgtgttgcttctttacccattcaacaacataagttaggataacttggtgggcttttcttttttctttttttgttttcttgagacagagtctcactctgtcatccaggctggagtgcaatggcgtgatcttggctcactgcaaacttcacctcccgggttcaagtgattctcctgtctcagcctcctgagtagctgggattataggcgtgtgccaccacacttggctaattttttgtaaattttagtagagacagggtttcaccatgtctggtctcgaaatcctggtctcaccaggatggtctcgaactcctgaccttggtgatctgctcgtctcggcctctcaaagtgctgggattacagaagtgagccactatacccaaaccttactttcaaaagttcttacctttcttgtgtttttactatttagaatatttggctgaagtttttactctttctttttgccttccccaagcctaggccccagccatcttttctgactgctcccatttttgctaggcaaaacctagcaagaacctcctttacaccaaaaacaaattttcctaatgctctcttgtcaaggtccaacagtggtagagctgaaacagagccaatggagttgtttatatcatccagcttcgtatttattagccacatatgtgctgcaaatcttagaaagggaaggatggtgctaagttctctgcagatgctcaaatgctaaataataaacatgtgatacaagctgagattcacaataaagacagggaatatccaaaaatatgtacttcaaaattatatcagttatttcccctaggcagtttagaatacaggattttaaaattcttgatgagtaaagagggaggaattaaatgataggcaaacatgtagcctgcatattgagtaagaatttattgtcccaaagagctgttatcccaaatcagctggttctgatatttcgatattattcaagaaggtagttagtcaccattttaggaatggtttaactttagctgaaactgattagcagttttttctgaatataaaatatggagaagttattaataaatgtcaaatcagtctctctcttaatcgctctcactctctctccctctctctctctctctcacacacacagcaagagacatttgaatataccatcaactttcattggcttactaacgctatggcacagcagagtgtgtttctttcctttggagctctatagtagcataagaaaaccttgctgaaaattgagcaacactttttcatgctgaatgattttgttttacatttcctctgatacaaatagaaaagacgtctcacattcagctacctatgctagactacaccacaaataagctcatacctttataatgtgtctacatgacagtaacaactgtggtgagcatagaattattcatatgcctatacttatttcctatgtctttacttaacatctgggaaccactctcaaggtagtgtctctggtagttctgggaaagctgggtgcttctgtgttactagtatactaagaccttaagtaaggggtcctcttatgctctagggacttctctaacctctctctgaaaccctcaaggtaacagagctttagttccacacaggaggctcgagaaccacaaagctagcaggctgctatgatctgggtctctctaatgcctgtgcccgcccatatcttattctccttctcaacagacagaaatgagttccaaaatcttttcaaatcatttcttcctctggcaatattcaatagcagggccctcaccttggttcctgcaattgcctcacttcccatctctcctaatcactgtggcttcattccttttcagttttggttcccaaagtaactctaaccagggatctcttttatatgacagtatttagcagattggtattttaaatgttttagagtgtggttcctggcaggcctttttttgttgtttggtttttgtccacagtgtgagcaataaagatcttaattaaagaaattaatgaaaatgtcacctagagttggaagctcaattcacagtgttgggttgctggttccctactaatagattatatcctggcaacactgtcacagtacagcaataaaaactgttctggcatcttccaggtccaccacagagtctcattcttgctgttatgtctggactgaactcagagtaacccagaatcttcctcatacaagccttgtccacctatattctattctcgaatcatatctgaatcagcatttaaaactcaagtcactcctcccaataaaaccctccagtaatatcccatttaatttttggcttggcttataactttcatatatttacatatttcaacatatggaaggagacaccttcatttatactcttgccctggttcattcaaacattaagggtgaacatgcatcctgctgcctgttaaagagagtaatattaattttactaagcctaaaataatattttaaagtataaggacatactacagagaaaatcacatgatagaatataatgaagtaaaaatacccattctgaacagatctaccttgtaagagagtaattaagttaaaggcttgaggcactctccaaagaggagaccacacccaaaatgatcgaatcgtgatggtgtattgactgttattgataaataacattagcatattaactatatttacctcaaacttttcctaatggagctagtatattctgtaagtaaataactttccctcttctttggttcagcacacccaaagttcagtaatccagttgttgcatgatattcaattaaattgcacctttacgccaatgactacaattaaaatggaaatccattctctttctctctttctctagattacagacttgggctctttcatacattcaaaaacaagcaagccagatacacagttatcctcaacacttgtgtcttccttatccagaccttgcaaattcagttaggtactgtttctcaaaactcttatttagacccttcatcactgcttccataaaactccctttatttttccctgctttgttgcagtaatcccctatcttgtctactttctgtagattcatctttctaaaccattcaccatccacctctgcttttttgagcagtgcttcttaaagtatggttcccgtatcagcagcatcacatcactcaggagttgttagaaatgcaaactcttgggttccaccccagaactactgagtcagaagctctggaggtggggcccagccatctgtgtttcaacaagccctccaagtgattatcatgcattttaaaatttgaaaaccaaggttctaaagtcatatttttaaaaggcaaaaccaatcatgtcatttgcttgcttaaaacttctttaatgagtctcttctgaaggataaaagccaagttcttgggaagacgtgtaataccctttctgttctcatatttcagcccttctctttccacttcctccttcccacccagtgttttagtcatataaatgttttgaaatattgtgaagcaacctgctttttctgcctttttgccttttcctagtgcacctcttcccacacacaattcatccacctggaggggttccattcatctttccagatcaagctcaaatgtcccctttttcagaatgatttctgagggctaatttcaataacttacttacagcctattccacttcttccaggtccacctacataattttcccaaattaaatttttatacctccagctctttaaaaggaaagaaagtctgtttactgggcaaggaggcataggaaaaaatataaagggcactgcttatcccacctcacatcctcccacccctagttcacaagttaaagattgtcatccatctcttggaatagttatggctccttaaggatgttaatgccccctcctagatgttgtctcaattgtttattggtaagcccactcctagatatgcaggacccaaagcaatagtagaaagggaggcctacataccacatttaaatatttaaaagttatttaaaaactaagaaactttaataaaatatgttctatcattgtgctgccttaaatatataatttttaatgacaaatgaaaagtattatgtaaggcaatagtttttagataactaaaagctggcaaaatatcaaagatattcagtgcaatatttgatagcatacctgggcattctcttgatgagatagcaatgtttaggtaagtaataaaatgaaaccagcttaattcataaacacacatgtgttccataaaatttatatttctcctctttatttcatcaaaattatattgctatggtcaagatttttaatttcttgacagggatgagccaaaggatttaaaataaaatgaaattgtattgaagttagaaaattcaaatatatttcattaaaaattaaatataaaaacaaaaataaaattatttttttcataattcttaaatattcaaattatctattaagtcaaaaactgaaatgcatataaggaatatcacattttaatttcagaatatttcattaaagctgacattttctcatttaattttgtctcatttaacattgagcatccactatccatttgcttgccaatatgaagaattggtagcacacttcatacttattttctctaaccctacatatagacaaatgtaggagtactatgatttatttaataatccaaaatatacttatcgtgtacaaatgttatgctaatttgtctggactttcaaatctaccaatgaaacatgaacagatacaagaaaatggatgttcagctctacccaggaaaacaatcctcgattctgcaatgatttggtgcgttcattccacaaggaagaatttgaaaataatttatgtatattttctctatagtgctcaaatcctagcccaccccacccacctgctgcaaaataagatgttcatctctcatattgacagcagttcaaactgcaaatgttcatggcatttgagctttgttatctttttgctactaggatgtaagaaaaattgtggagaagaattttccggtagcccgagtaatattaaccacgagagtgaatgtttagagttacagattgcactgagccagtgctgtaggccagaattgaggcaacagaggcatttatgtttgtgtttttgtcatatgtggggccctctaatgcatggggcccaggacaaagacctttctttcctggatctaagcatggcactacctaggtgtttgatggctttaccctaggagtaaggttgagttttaaggtgctatcctagggaataatttcaatatatcttggagttggaacttctatacatttgcagtgcgtcacccgactttggtctatcaaagcaaaaaaacttggtcaggctttggtgcctagctatctggtcaaatatttatctaaatgtttctgtgaaggtattttacagacgtggtgagcatttcttaatcaactgactttaattaaagagtttacccttgataatgtaggtgggcttcacccagtaagttggaagccataaaagcaaaagataaaaacagaaaaaaaaaaaaacagaaaactgaggtatcccccataagaagggattctgccttaagactaacatagaaatcctgcctgagtttccagcctgccaacctgccctacaaatttcagatctaatattgcaacatcaactcttgcctgagtttatataaaacctacgcgatagatttcagacctgccagcccccgccatgtaagccaattccttttggaggaccccgactgacacaggtaaataattccatcttcttttatcccagtccccaaaggcagataaagaaaatgtaaacatatatatgtactatataccttatctttataccttctgatagcacgttggacaaaccacggtttctagaatttatggcatagtattataatcataggtttcaaagtctgtctcctattctagactggaagttccttgtgtgcagaggctgtgttatcacagcgctttttgaggctggaaataaacgttcaatacatgtctgtcaaaggttagagaatcaaaattaacacattacctggataagctggcatgtggtggggacaggagtaggggatggtggaagagcaaggagaaagaatcaaacaatgtggacgtaggaagcagtctccctgaagctaagacaccccatgagatggtactcatccagctttgccaagctcccagcacagtcttaatcacctctctcacagcgactttgatagctctggctaaggaacttgatacctgcaagcaattaactttaataagccagcaggtgatttccttgagaatgctgacgattcaatttgctgacagcagctctagattctctggctactcagccatggcttctacctctgcccttatgaacccagtgtgtggttgtgagtaataaatgaaaaggtagccaaagtgtgaatccttttaacagtgaaaattgtaatcagctttaaggcatgattatatattacagacagaaccaaaaggtcttttaaagttatgaagaaaaacaaaagccaacaagttgtacagctacattggcaccaaacttttatagtttctgtgaatgtgaaatgaagggatataaaagtactttcacctgtattaaccttttttttttctgttactcatcatagcattatctaacgcagaatcctaggaatgattctaaactctttctctctgtctcaataatcctaaatgttgcaattgccttattgtcctattttactgcattattttttacacaatggcagcctaatgagttcccccggcatcagtctcaggcatcacctatcaaacaactccactgcttgcgtcctcttcccaaaatgcaaatattatttcatctgcatgtaatttcttaatagttctccattgttaattgactacagtggagtcaaatcttagaattaaattttaaggaaaaagaggcaaaagagctattttactcaaaattaacactgaatatttcttaaattgtccaaaaaatacagtatgctccccattatatatgaaactgtgcagcaatacatgtttgtatatgtagtaatttatggtaaataaatttataataaaactgtaatattataattaaatataataatataatgtaaatatcattaataatataataaaataaacttataataaagagaatgtaagctttgtgaggacagtgattttcattcattttgttcaccgatgtaccccaaaggccaaaaactgtgcttgtcatagcaggtgatcaatgaatacttgttaaatgaaaatcacataacaattgattaacaccattttaacaattgatttgacaattgttatgtcactgacaattgtttgttaaaatcatttcaaataactttattttccctttttgtgcaacacatttaccactaaagtaacatagaaagtctgtgtgtggtggaaagtcattaatttacattgctttctaggtactaccgtcttccatgatctgcgctatccgttctgcacttatactttgacttcagtgtatcaaatcactcaatgttctccaaatatgctgtgcaaagatctttgcactttgattcctcaagccaatttaagtgtcctgtgatcttacgaactttgtttttcctctattttcaatgtttatttcattgcatttttatcgttttcttgtgggtctgccttcttgatcagattctaagactcttgattataaaatctatgtcttaatagtgtttttaatagtgtctctagtacaatgtcggtgtatcaatagacacatacagagtatctgatttatattaagtgtttatttgtctgtctgtgccattatgaccacatatgttacacttgaactttctgaccctaagttaacatctgataacatgtgttctacattttaggagcaaaagatatacttaattatttcaacaaactaatgagcaaacaattttagtatcagcctgcagtaaatactctttgatccagtatccagaatccagtacacagtatccactgtgtagcagcttctgcacatggggcatcaagggtaccaccccagaaaaactgctatgaccagaagtattgcagagaccagggtaaccagaagcacgatcatctcagaatatacctgcagcagcatgcctacagtggccttatatggtttgtgggcaagagaccattgtgaggaagtcagagaaacatatttgagtcactttgttcctatgcaaatatatgcctcccagagatcttcttgagttggcagagagggactttgctgtgggagaggggagatatgttttttggcctcaatggtagcagctaggcaccagtataatttgatattaatctagatgcctgcatttcaactcacctctcaggcgggaatatggactcaggcttttagaaagctttttcacaatgggggacaaagtagcaagtgaaagaaaagggtaaagtggaaggaaaaccttttcctgatggttaagcagttcctaacttacatgtatgaatgcatacatacaaatataaatactagcttaaagaagaataccctatcccatgcactccaggtaattaaatgtttatttcactctgatttgagatgtctcacgatgctaaggaaaatattggaaagaccttctctctcgttatctcaccttcagttaaaaaaaaatgaaagagagaagaagagagaaaagagataaatagaagggctatttgaaggtaagaaggtgaaggcagtcaccttttatgccttcctcccttcctcctgccaatcatccactctatttggttgactcccaagcttgctttataaacagctggagagcaaagcaaaacttcaactttagaaagataaggtcaactcatcctttcatttgcaacaagttgatagggccattgccgtgcaggtttggctggtcctggacaaaaccgccttctccagaatgggatttagaggaagacccttctctctctaatgtgactgaggaaaacagaaggaaggtaggcaaaggagatctgctctaggccaggcacagtggctcacgcctataattcaagcactttgggagactcaggcgggtggatcacctgaggtcaggagttcgagatctgcctggccaacatggtgaacccccatctctactaaaaatacaaaaaaatagctgggcgtgatggtgggcacctgtaatctgagctacttgggaggctgaggcaggagaattgcttgaactcggaggcagaggttgcagtgagccgagatcgcgccactgcactccagcctgggtgacagagagagaccctgtctcaaaaaaagaaaagaaaagaaaagaaaacaaaaagacctgctctccagtagcctctgaggccccaacttcccagaatgggagtgttgatcaggacctatggtaaatgtttcctactccagtccaacagctcactgggctaaacaaaagaggcccttcacagcctcggggcagacccacaaatatttttatttaattggtttgagatggggccacagactttttggactggtccccaggtgaatcacacgtacagacaaaattcagaagcactgggttagagggccagcatgagggctagagtgagagttcagatactgcagggagaggctatgggatttcctcacggaaagagacccaagggtgtggaaggcattttctggaagatgactgaggtacttggttatgggcaagacagtctaatttacaaaaacatgataaacctctcgagcaaagcttttcaagctgtgcaccccagaaggtgtgcaagatgagccatgacaacatataagaaaacaactgaatgtaacatttccattctaatttttataaaatttctttgttttacttattagtatagtagtgcatatgtattatttataaataaagaaacatttattaggagtatagcctcaacatcattttactaatgggcataaataattctaaaatttggaaactagtgttctaaagaaggaccatgattcctcactgaaggctcagctgagaaagctgtgataaccaggcaaaccagagaggaacttcatccagttgcctggtaagaatgatgaatattctgggttgctaagaaaatacatcagccagaagggagcaagagaggctgccctgctggggaatgtttgggagaccataaaaacagaaggtgggagcaacgagagggctcttcatcgctactgttaataacaaaacaatagcaacaaatgtaatacctgctcttacttactgaattcccagtaaggtcaagcactgtgataggcactttttgggcatcactgttaatcctcatgctgtcatacccattttacagattaggaggaaaaaaacctttaaaaaccataagtggtgcaacacagatattctactccaaactcaatgttcctgacattatgtcatgcagtttcaagagcatggatcatgagtgacattaggaaactgagagaagaagcatattatagcacttagagggtattatagtataaccaggttgtatttatcagctgtcttttctttcaattaaaatgctaaaggccgggtgcggtggctcatgcctgtaatcccagcactttgggaggctgaggcgggtggatcacgaggtcaggagatcaagaccatcatggctaacatggtgaaaccccgtctctactaaaaatacaaaaaattagccgggcgtggtggcaggtgcctgtagtcccagctactgaggaggctgaggcaggagaaggatgtgaacctgggaggcggagcttgcagtgagcctagattgcgacactgcactccagactggacgacagagcgagaccctgtctcaaaaaaaaaaaaaaatgctaaactgtggttgatgttttcataaacagagaattggtgctagcttcccaggcaatttgagagaatagattttcctgagtgtaagtaaacctacaagttaaaagaagtgacatccactgggagactcaggccaaatgtgatttcttccatacaaagtcaggtttatcaactccctccccccaccccaccacacacagaaacacacttttaatacttgcttttacactctgcatctgtgttcactttttccattgaccctccaaccaaatttgtggttctaaagctctgacatcaacagtgcattcctgagggtacttctctaggactgtcttcattttaagtctttgctcataggcacaactgtaaacttataagaagtttcaagcaactgtagagtaataagaatcagatctgtcctggggttgtggcgggggtgggcgggggaagtgtggctcttgagtagacagagacttggcatgacagtccttgtttaggattgggactcaagagattccaggaaagtcagtgtcccttccgtccaatcacagtgtgaggcccggtgattctggccttttctgctctatcattcagaaatgaagtcttttctgctctatcattcaggaaagaagtcttttctgctctatcattctagcttcttagccaccttgttggtttttatggattttctttttaccctgctcctgcctagcaagaaagaataaagaaaagggagaggaggggagagaaaggagctgactctgcagaccacaactttataattatttgaatataaaattagctggtaatgtctctctctttatgcaggctatgagatacatgatagttgtttctagtaacatatgttttctcatttttatcttttgaaatgttgttgaagtattcctaacttttatggctattaatggaggatgctgctaccatcctacccaagggcccatttttctaaatcctacaatcctctacgaatggaagcaatagcactacagttaacactctaaattgtacccttgtgcacacatacaggcctaaatcacttggccttatagccacaaaacacaattaggaaggactaaggtcatcaaaaaaaatcctaaatgccagttcactgcacagcacattctatagtcatcttacttacttgttcttgataaaaatgaatcccagcagggactagaatggtgaccctgattgtgaataatggcacacatgcagtgtccctcaatggctaccagaaaacaacagcatcagttaatagcctgtgttgtctcttaactgcccattgccagcaataggttttgctctatatagtctggattcccagtttcaagggtcttcactcctaccaggcaaaagtgctgtaatgagaacaagccaagaaaggaatgaggcaggcaacaagccaaaatccaggcagtgttagaacagccttgtcagggaagcagagaaacaaataattgaaattagaaaaaactagattttcagaggagtctcataaatcagacttgaaaatttaatttgagagcttttctctttctttcatcatattttttcccctcctggagctgtgctacaggcctgaacagaggaagtggaatgtaattaatcgatgtaaatctgcttcattaatggattgctactccctgtgtttcctctagtcaagaatgtttctgaaagtgctctctgacaacaatgctattcacagtctggataatggtaccaagcaggagaagaaacgatgaagtacttgcatgaagggagcccatgtttgctattgactggtagagaaatttagttagctcattaaatgttctgcttacaaaccctattcatgctttttaatcaattgatacttgtcctcctttctcacattgattaaataccaggaagtcctcacaagatagtgagatgtgaagttcccattgcagttaacaaatggtcctaagacccttagaaaacacatggttgtgcatctttatgcccacagggaatacgccattaatctgaactaataaagaggaacagcaggctaatcatagctcatttatatttggccctggaatgtgttatgtggtttttggcagaagatttaccttactaattatgtcttacttaaattaataatacagttaatttgcattcccttagcacacaccaattgacagtgagaagaaatgtgctaagtgataaggggatatcatctcgaaatttaaaagcttcattgaataatttgtgtatatatgtatgtgttgacactatatacatttaggacaaaaactctcaacatactttggaaagagaagttaaaattatgtgtgaaaatcgctatcaccttttggctaatttgcatcatcattgtttcaatattttatctcactacttctgagaccaataaattagaaagttaaacctgtaatcaacaaatatgtgtatatgtaacctaccatatcctgagcactgttctcagtattgtaaagggatttgaagaaatatacagtcattactctgtttcaaagtggggactggttccaggacccccatggacaccaaaattcatggatgctgaagtctctgatataaaatgatgtagtatatgcacaaaacctatgcacatcctcctatttactttaaatcatacctagattacttataatttataactcaatgtatgtgttatgcaaaatagttgttattgtactctgcattgtatagggaataatgacaagaaaggaaaagtttgtacatgttcagtacacacacaactactatagacctaaccacatttttcatctgtagttggttaaatacatggatatggaacccatagatactaagggccaactgtaggctattttctatcttaagatctaaaaatctggagaaagaaatattaagagatctagcactaatatgctttaggtgatctttgccttgtttgtagagactacaactcatttacaaaccatctcctatagacctggattgctgatgtggggaagaaaaaattaaggggtttacctttaagcagagtcaaggaggttaagaccaggtatctgattttccagtaaatgaagttgatgaacacaataaacccatgtatcattgctaaagtgctgtaaagtagagctttaatgccctctgtcaacttagaatcaagagtaaatatccactagcaattctacactggtataacaacattgcccagttactccacctttgaaatcttcccagacggacagttgttcaccatggcagatatgaagattcaaatatgtttgagctatacgaagtacatgataatgtaatgttgatctatctggttttggatgcatgaagcaatggtccaaacttggatatggaaaggaaacctcacttgtttcacaaatcacaggcatatttgtttcagatattgtaacacaatgattttcacccctctcacttttagcacaagtgttgcataagacccttggaagttggcctaatactagagatatcactaagtcttttttataatctatttctgattaattagtcctttaggataacatatacttatcaatatcattatgacattgcaggaaaaacaaaagcggtatgggtggattcatctcctctaaacttctttctttatggtcttgaacaaattactaaattgtaatgagtaaaatatgtatgttaatacccacattataatgtagttataagagctcgacataatgtatgttgagtgcttttgcaaagtgctttatattttagaaatactctccttttagtgcagccatactttgattctttttcattgcaatgacatggaaatttcaggacacaaaaatcagagtggccaaagaatttcatgggttcctttcaaaggataaaacaggaaattagaaagaataagtatgatataattcaaaatgtaaagccaatatctcgccaacttattaatacataaaattatatgccaatcttaacagaaatgaatgctacaacgtggtttgctaagctaattcaataggactacattaataaagttcctataacaattgagatggtaatctcatgttacagttggctagtctggccaatccaacaatactacattctattttgaacatcacttggagtggtattaccaaaaaataaactggaaagcatttagacaagaatggctcagacaaggtaagagctaaaagtaaccatttgaagggactataaaattcacctcagagaagagggagcatatggaatacatgagggctgacttcaaatatttcaagagttgttgccaggaagaactttaaacatagagtaactgatgtttaactcatgccgtgaactcatccactgtatgtttgaaaaccagtagcccagtagcctgttgggaagacagatttgtttcatatgtaagtaaagacaattcttcttattgaaaaaagcatggacataagatctgataaatccagcagaaaatttcaccttcaatcaagtagcaatgtgaccctaaatataaaacctctttgagcttatttttccaaactataaatcatgtcaacaataaggctgatacaaggattacctaagagaacatgtttaaaagcaccagcataatgctttaaatttcatagatgtgtaacaagaactaattctaacagtcatatgtcaaagatgttcaaagatggaattgagtgttatgggagacaataattttcctatgctagaaattgtttaggcaaaggctaaataaccacttggaagaatacaaaagaggaaagtcaagcttcagaattaaaattagattactttcaggattcctttcaactctaaatctgaagatcttgtgatacaaacattaaaaaaaagtttgcctaggaaaaaatatcaagaatagcaacagttatatctacaagagtaggtaaaaattgactaatatttgaaaaattagtctagctccctattaaagtatatagtttattactcttttaaactagtcaaggggaaaaaataaataatattggtaaaactcaatgcagatcatatttcattaaacaagaacatctttctttgccagatgtataggttagttatacactttcagaggatactatgataatgatcatatacaataacccagttgtcccattctttgatattaataattaaagcaatatttcttttggagaagttattcctttaaaaattcaactggtaggataaatctaatagagaagtagcacacagctaaaaacagaagttttagtaaattaatgagtggaatgttgaattcagcagtagctttaactaatgttgtgaactcatccactgtatatcagaaaaatttacagtacgttagaaaataatttgtgaaaccaatagcccagttgtctaggaacaaatgcacatcaagtaatagggaatatttttaataaaatttagtagattatggtgtaaggttttatacacaaatgtaaaggttttaattcaaatgtgataaaggagatgtttgtggatttatttagggtataaaaagccacatttttaatataaaactttattaatgtgacgaaattttggaattaaaagtagtaggacgcttacatcatatccctcactaaatgaagggcgtattgtttatgaaataatgttacatgagaaagaagacaatattgcacatacatattaacaaagtccttagctatccataaaatctagtttttccttcattactagtaacagatgtgtagcttttgcaagtggctaccagaaacactacatttcccagtctagcttgtagttggaaggaatcatgtggctaatttcaggagaaggtaagcagaaataatgtgtgacactgatacctgtaagaccagccctgtatttttcttgtacatttaagttccctgtacactctggatattagacctttgtcagatggatagattgtaaaaactttctcccattctataggttatctgtttactctgatgatagtttattttgctgtgtagaagctcttcggtttacttagatctcatttgtcaatttttgcttttaatgcaattgctttgggtgttttcatcatgaaatctttgccccatgcctatgtcctgaatggtattgcctaattttcttctagcgtttttatattacagttttgggtttttcatttaagtccttttttatttttatttttatttttggcagagtctcactccgtcacccaggctggagtgcagtggtgcaacctctgtcattgcaacttctgtttcccgcgttaagtgattcttgtgcctctggctctcgaatagctggaattataggtgtgtgcaaccatgcccagctaatttttgtatttttagtagagacagggtttcaccatgtttgccaggctgatctcgaactcctgacctcaagtgatctgcccacctgggcctcccaaaatgctaagattacaggcatgagccatggcatccagccttatttaagtttttaatagatcttgagttaatttttgtatatggtataaggaaggtgtccagcttcaattttctgcatatgactagccagcactctcagcatgatttattaaataaggagtcctttccccattacttgtttttgtcaagtttgtctaagattagatggttgtaagtgtgtggtcttatttctgagttatctattctgttccattggtttacatgtctgttcttgtaccagtgctataaaaagtggacatgaacagacatttgtcaaaagaagacatacatggagccaacaaacatatgaaaaacagctcaacatcactgatcattagagaaatgcaaatcaaaaccacaaagaaataccatctcatgccagtcagaatagctattaaaaagtcaaaaaacaacagatgctggcgaggttacggagaaaaaggaatatttttacactgcaggtgagagtgcaaattagttcaacaattgcggaagacagtgtggcaattcctcaaagatctagaggcagaaatgccatttgacccagcaatcccattactgggtatatacccaaagaaatataaattattctattatgttcacagcaatgtggatggaattggagatcattattctaagtgaagtaactcaggaatggaaaaccaaacattgtatgttctcacttataagtgggagctaagctatgaggatgcaaaggcataagaattatacagtgaactttggggactcaggggaaagggtggaagggggcgagggataaaagactacaaattggatacagtgtatattgcttgggtgatgagtgcaccaacatctcacaaaaacaccacaaaagaacttactcatgtaaccaaacaccatgtgttcccccaaaacctaaggaaatttaaaaaattttaaaatcattctattataggccaggcgtggtggctcatgcctgtaatcccagcactttgggaggctgaggcgggcggatcacgaggtcaggagatcgagaccatcctggctaatgcggtgaaaccctgtctctactaaaaatacaaaaaaaattagccaggcgtggtggcaggtgcctgtagtcccagctactggggaggctgaggcaggtgaatggcgtgaacccaggaggcagagcttgcagtaagccgagattgtgccactgcactccagcctgggtgacagagcgatactctgtctgaaaaaaaaaaaaaaagatcattctattataaagatacatgtattcatatattcattgcagcatgagtcacaataacaaagacatggaatcaacctaaatgcctgttaatgatagactggataaagaaaatgtgatacacatacaccatggaatactatgcagccataaaaaggaatgagatcatgtcatttgcagggacatggatggagttgaaagccattatgctcagcaaactaacgaaggaatagaaaactaaacactgcatgttctcacttataagtgggagctgaatgatgagaacacatggacacattgttggagggaacaacacacactggagcctgtcggcatggggtggggacagggagtgcatcaagaagaacagttaatggattctgggcttactacctagatgatgagatgatctgtgcagcaaactaccatgacacatgtttatctatgtaacaaacctatacattttgcacatgtacccctgaacttaaaatttaaaaaaagaccagtcctgtcttttcacattcccctgatctcttcctatgagctggaataataaaaaccagagtgatcttttatatcacatggtgaataaggcagaggcactaccagaataagaccttgagtgactatgtggaaggaaggcactgctaacccagaatactcatttgcaattgttatgtgagaaaaatacacttctatcttgtctgagctattgaatcttactttatttgtttcagtagtttagcatttgaccctaaaaactactctgactaaaactatgcaaaaatgcatgtttatctaatcatagagataacaagaagccctaggaaagtacaaagtgattgttttaaggtaatattttataaaatttaagtattttccaattatgtgacaacatttcttttggataattattatggatcagtcaagggccaaatacacaataaattgttcaatagattcagtcttcctctgaaatccaaggaaggccatatataaaaacaggagcaaattgctaggggaattcatatttgattcctaattgtacatttaccagaagaaaatttggcatttgaattgagcatttaaattcactactattcaacagcaatctgaatccccaagttcaattaaaaaggtcattaccctctagaactggaggtgctcttttaattacaatattgctaatgaattgggagacaagacattttggcttagttcaattagcacatttaagtcaaagcaaacttcagccaatatgggtgactttcccagtggcatgctttttctttattccctccttccctccctcccttccttctttttgtgtcttccctacttccttctttcctcggaaatttaagcataactctggcacgtaagtctctcatttccattttatctgtaaactgctgcaaagctgttaatagctaaggacctacaaccacatttttgttttgcaaaactcttcaaatttatatgaatattgagaaaacattttgatgagaaatttttaacatagctttctgaagcagagtaaaacataaatttcactttccctagctaaaacaataattatccaatcactttatcatggtgtattgcacatgcttttgctatgggaaagggggaaaagtgaacatatttaacactttgctaccaacaatggtttattgaggttaatttatattaggaaagtggagtttccggatgacattccaaactaaagaatactaatgaatagctcctgagctctgagctttcctgcctggctagaattcacaggacatgaccttaaatgtaacagtttttggtaaaaaagagaaaatcttcccttcaaagtgatttgaaaagttcagaaaattagctcttatgctcaaactaatagtaacaaaaacactgctaccagattaaatttaaataaagttcataacagctgtttgtaacatctagatttaactttaggggaaataattgactcaatttgcccaggttattctcttcctttgctatgccagtaaagggcttggagaggttgcccatgcaacatatcctacagatttgagtcagctagactaggtgtttattcatttattcaggaaatacactgagcagcctactgtgagcttggaggtgggcaaacaaaacagagaaaaatctagacctctctctctctgtaaattgacataaagatagttttagccaaggaggaacaatttccttctaatttagcactacagagtgttctccttggaaaagccatccacttggctttgtaccctgattagtctgttctcacactggtaataacgacattctcgagactggttcatttataaagaaaagaggtttaatcgactcacagttcagcatggctgaggaggcctagaaaacttacaatgatggtggaaggagaagcaaacaggtccttcttcacgtggtggcaggaaggagaagtaccaagcaaagagggaaaagctctttataaaaccatcagatctcgtgagaattcagtcactattacgagaacaggagcatgggggtaactgcccccaagattcaattaactcccactgggtccctcccatgacccatggggattatggaaaatacaattcaagatgggatttgggtggggacacagccaaacattatcccctaaacaaagtcataccttttcttttttttttaaagaaacagattctcattctgttacccaggctggagtgcagcgacatgatctcagctcactgcaacctccacctcccaggttcaagtgattctcatgcctcagcctcctgagtagctgggattacaggcaccagccaccgcgcccagctgatttttggatttttagtagagacgaggtttcaccatgttgaactggctggtcttgaattcctgatctcaagtgaccctcctgcctcagcctcccaaagtgctaggattacaagtgtcagccaccacacctggtcaagtcatacctttttaaaatatattctcctttattatattcaagtaagatatgttctttaaagaaaatttagaaaaaaaagaagaaaaaacaaatatcttctttctttgccaaagcaaaaactgctaacatttttaaaattttctttcgaatttcatctctttaactctcttgtgtgtagtagaaaaaaaagttgtaattatattgttttttaaatttgtgctaagttttaatgcaaacttttcataaaacatttagtggaagcatattccttaatttataacatattatgatttttcttattgttttcttcattgcagattataattaagatgatcaacttttcagataacactttcctaggagaagtgttgagtcaaagaataaatatgtatgtttttattttaaagtatatatgtatacacgaacacacacaaatatatatgtatatattttttatttgtttaatttgtattgttaaagggcttttccaaaagattgaaacaaattatactccatctaaaaaaaatgcttacttaacctcactcaggtatatacataatccacagcttactcagatgtatatataattttctaatgagttaggaaaatgattacatgcctaagattttctctgtatttgtaactaaagtatggtgatttgtgaaaagcttctttacatctattttctattaagatgttgttaaatttttttgcctatctttgaggtttcttttcaatggcttattgtgtgtaaaataaaccatgataaaactattaggtaatctttaaaaaacaatttctaagagtgctgtacatattaaaaatatgaactttatattggccacatttattgcaaatattttcccagatataattagttttaattttatttatgacatgttttaccaaaaagtacaagttttatataactaattgtgatgtatttcttatatcaagatgttaaccaatattttttattcaattcttatttttcacttctgataaatttccatggtatttgtctcaaagctccacataattctcatcattccttaaaaaaaaatattgactttttaaagaaacttcttttacttattgaattttattactcattccaaaaatggttaattttcttctctctcttttcttctctctctctaaacatataatctaaacaacaccttttaagttgtttttcttctccagtaattatcttccttatttccactcttatcacagaagccaaacttccagaactatataaaataataataataatgggaatctgaactattagttgttaatataatattgatatttttcagcatgttaagaaaatacctttttatttctaaatttctcaaaagtattttgttggtggtgctggtggagaactatttttacatttaaagccagaaatgattagttatataaaactctgactttaaatgtaaaaaagtgcattacattatgaattttattacagccaggcatggtggctcacacctgtaatcccagtgctctgggaggccaaggcgggtggatcacaaggtcaggagttcgagaccagcctggccaacatggtgaaactctgtctctactaaaaatacaaaaaattagccgggcgtggtggcaggcgcctgtaattccagctactcaggaggctgaggcaggagaatctcttgaactcgagaggtggaggttgcagtgagctgagactgtgccactgcactccagcctgggcaacactgtctcaaaaaaaggaagactgtttcaaaaaaaaaaaaaaaagaaattttattacattacggaatcttttttaaggcatttgcaatatattcagtggctagctttgcaaaaagttcttatgaatttgttttatagataagatgttcaatattgtcagcattttttgattaaatatcttttttatcttttattgataaaacaatattttttattatatattattaaagtaagttattctgtataacagactaggcaacagtgaaagttttctaaatgctttcttgattcaccttaatattgaattttgctatctataataaaaaattctataattattacctttttgttatctttgtcaggctttttataaggtaataattatagaatttttggggaaaataaatcaattggtagctttccatacttttgcatgtcttacaacaaattctatagcataggaataattcttttaaaaaccctaaatactttgggaccaaattcttatttagaggtaactaacattttgatactactcatgactaatggtacattaagaatgtttttattttctggctcaatttaggtagtgtatattttctcagaaaaatggcttctgagaccttcaaacatactaagatttaattttacataatatttccttattttaaaaagttattcttaatatatttccattttaatttataacatttataactttatatatatttactcttactatttgattcactatgggtcagtcttgttttgtttgaaataaccagagttgattaagttatcaactcttctgatacctttcttctaataaataaattcttgcttttatctccatcattgtctttcctccattttcttctacttttttaattgaagaggatattatagaagaaattgttatttcttcacaattcttccttagctctcactcttgccatggttcactgtgggcagagtaaattccttggctccactgacctaggcctgaccatgagagttgctttaataacatttaggtagaaaagaagttgtgtcacatccaaataggggctttatggagcattccatgtgtccctctccacgtgtcttgtgttcttacccttgccttgggaacatgcttcccatttggcggctgatccttcagtcagcatcccagaaatagaaaaatgcataaagcagacatcagtccaacctgcagagtgcagttgagccacagcgcccaacaacgacccagcctctcttattcaacgtgctgggaaacaaacatttattacagccattgagattctgtactgtcatggaggaagacctagtgaaaagtgacgaatactttttttttttttagactgagtctcgccctgtcgcccaggctggagtgcagtggtgccatcttgactcactgcaacttccgcctcccgggttcaagcaattctcctgcctcagcctcccgagtagctgggactacaggcgcacgccgccacacccggctaattttttttttttttaattttagtggagactgggtttcaccatgttgcccaggctggtctcgaactcctgagctgaggcaatctgcctgcctcggcctcccaatgtgctgagattacaggagtgatctgccgcacccaggcaactaatacaattttacattattctttctatcattataaattgaaccccttctttatgctccatcttacctgtttattaataataaggctaaaattatgccactgtgtacagctttgtaaatgggccaaaaatttaataattttatgttaaaacattctaaaagtatgaaattatagttattatttcctatttgacctaatatatatttacaatatatattttaaaatttctatctgtgtgcttttatcatttaatccgtattattcgtttacagcattcttgcagtgttttcagagagatgtggtcttacaatttttgagttttcaaatagatttaggttgcttatatggcttacaatgtgatattttaaaatcacattactgttttggtaaatagttgaaaaacatttgatttttaataacactttaaatgttttaaacttaatctgaatatttgaatttaatttgggatataaatctatgtgccttgattatgatgactggtaagattcactttatctctgcactgtgtgctttaattttcttcagtgatacaaaaccaaaacattcatatcctcctaaatttttaagcgcattcttaaaccatttcctctgattaacaaatttatgaaaaatacaaaaacattggcctgtgcatgtttcatcccccaacacacactagtgtaaaataattttttatttctagttcacttaaattttcagtatttgacaagatattttgaggatacagttgttgattatgactgtttaatggccaaacttttcatatatttattctctgggaatttttttaacatttgcaaaatattccgtggccagtgttgcaaaagtttttaaaaatctttatgttgaactggaatcatgcccacaccactgtatatatgttatttaattctctagttcttagttgccgcattctcatttttcattttattggagcatattttcaagtaggattattcaaaaatgattcatcaatgatatatgttttgaatcctttacaatttcaagaatgtcttcacatagaaatgacaacatggctacatttataaatattgaaatgcaatttttttccctgtgagactccatataagtgacttcttctagcatttattatggtgcaaactttgaatctaacttaaaagttgtacttttttttttttttgagatggagtctcgctctgtcaccaggctcgagtgcactggtgtgatcatggctcaccgcaacctctgactgcctggttcaagtgattctcctgcctcaactcctgagtagctgggattacaggcatgtgccaccacacctagctaatttttgtatttttagtagacatggggtttcaccatgttggccaggatagtctcgatctcgtgaccttgtgatctgcccgccttggcctcccaaagtgctgggattacaggcatgagccatcgcgcccggccaaaatttgtgcttttaagtaacatccttctcttccctgcactgaaggatatgactttgttattgacattttaaaaatctaacagtatattctaggcataggtctttttcaccagctttccatgaaacatagtgatccttttaaacttacaaagccaaaatcttattagttctataatagctgttttattatgactttgattattctttttggtcagtttgttttggcttaattcccaaggattgtcagctatctacaaattgcatctttgttttctttccttgatatctattatgtttttgattgatctgcattcttaatgtacttttcaaagttgttctttaagtcactgactgcatttcatagttagctgattctgtttttaccacctccaatgaatacttttatcagtttgatgtattctttctaattttccttctcatcccatattttttatgctcacaagctgcatctctgcaaatgacaactttgtatcatctttaatctcttctgtagtgaatttgtcttttctggttctttattgaaaaagcaaatatacattctagaaaaaatatgtttctaaaataattacttctgtttgcaatgttaggacatcaaatttttcttatgttagctctttctgtagaaagagtttggtcttcatcgatttgaacaaggggatctttacccatatacacgtttcatgtaaataagtgtatgtattcattttaatctccatcactatttccctgtgtacatccagatattccttttctgatcttgtcaatgaaacccagattaagtgagattgtatcatctcctgtttccctaatccttgcagtaaagtaggtgtatttatttctggataattttaagcagcctgaaattattttcttctatttcccgcactactggtattttacagttctacttataatttgctttataaatgtgttgtgtggttttcccaacccttttcacctctaaacatgctgtatggaagttgcaatctccagaatagaggaagaaagatagtgatgtgtgagggggatgtggaggaggatacaaaataaatttcagtcatctcagtcacccatagacctgggattatcactaaattctctagatatatacagagattataaatctctgaacaaaagatccagagtggggatgaatgaaagacatctcccacccattctaatcacttctggatccattccatctctactgtatttagagcaatggttctcaaactttagtgtccatcagaatcacctggaggacttgtaaaaacaaaacaaaacagattgctgtcacactcccagaccgtctaatttaataggactgtggtggatcctgataatttgcatttccaacaagtcccaggtgatgctgatgctgctgctctgggcaccaaatttcagaatccctaacttacagcaattcttccaagggagctcaatcacagattgaaatattttttaactttatatcagtgtgtattttcacagctatcccacgagcatgtaaggaaaggtgaattaagcatccacagctagtgatttagttaaaatatgttatgtttatatatatttatttacattatttatgcattttactattagatttctttttaagattatcttatatatagatagctatttaaaagctagttggaaatgaaatgtgtttcattgtctaatagaaccattaaaggtacattgttaagactaatttgtaacgtactggccattatatctggaataaacttgtttttagtgggggattaaataaaaatttcctaatacaaaaattgagctaagtctgattggggaaagtacagttgtgtgtttgtgtgtgtgtgtgtagacacaaacatatacataaaatatatacatatgtgtatacatatatatctgagagacttgctaaagtttatacaaagaaaaattctaatttctggctgtgtgtattaaaacatgaagaacaaagccctcctgagacaacattaagcacgtgcaagataacgtgggaatggagtaggaaaggtgtttgttcctggctggccagattcagatcatttggggaatcatgtcttgagtgcagaattgtgggtcactgtgtttctctttctctttgttgctttgagttattaaacaagagcgggggactttattaaaaagaaaatggtattaatgttttagtcctgttaatatcttgaaagttgtttccctaagagtgaccagacatggtgagactttactcaatcagcaagaataccaccatgtactttaataatgaaagaaattaggctggggctattgtaagaacagtttctgaatgacgatgcaaaatataataaacacagaagtcccacactggcacagcatctgtgaggctctggggtttatgctccctaggtttagaagattttatgtttcaactccacagacagacattttcagactacctttatgtgattacactgtaatattcaattttgtcaaattatttttctttcatgcattgaattagtccctttttcctaattctctttggaattaacaaatttagattttccagcacatggcagttccatttaagtggaataaaataagctctgttcatttctcttttgctttctacagtttgcttttctctgtgtgaaaatgctgtttctttttcaaatgtattattattctcacagacacaaacagaagctccttttgcaattgacttgcctctctttctgccattacaaaattatcactatggtagtttcatgagttagaagataagtatgattaaattccacttgaccttgtttaacccttcattcatagaacacttcctagagcaagggattttgaagctgaaatatctctttgaagctgatacataatatggagaggaaaagcaatcttgccttgaactttgaaaagcttacaatctagactgtgccactgttctaaaagcgtggtccatgaacatcataggtatcacttgtggatttgttggaaatgcagattcatggaatcacctagtgaaacagaatttttgtttaaacaaccattccaaatacactattttataaaatcctttaggtgattcttatgcatattaggtttggaggctactgctataatcaaagataaattatgattagattttttaaatgatatcttagtagatttcagaagtgaaagcaatgccttctggtgcagataaaggaagtcttctggcacttgaactgaaagtaaagaaggctttttctgggttatgatagtggatcaatggctaggtggaagggaagagatgatacaagcaaattcccaaggccaggaaaacacagatgtatcattgcatagggggcaggtaagtcaaaatacaaagtctaaagacattaccaaagtactttgtgagtaccatggaagaaaacgtctgataccagcaagagtgaggggaggcctcacagagcaatttatataaggctgggccgagatgggtaatttcaatttacaagtcatctaaactgacggctgggaaaacacaaattcagattttcagagcggaagagaccttcaggataaactaatacaattcactacacaatgcatggattcctcctctacaacaggttggatgagtgtttggcctttgctgggttctactgcacattcactagcattgcgggaagtcagggaccccgaatggagggactggctgaagccatggcagaagaacataaattgtgaagatttcatggacatttattagttccccaaattaacacttttataatttcttacacctgtccttactgcaatctctgaacataaattgtgaagatttcatgggcacttatcacttccccaatcaatacccttgtgatttcctatgcctgtctttactttagtctcttaatcccgtcatcttcataagctgaggaggatgtatgtcgcctcaggaccctgtgatgattgtgttaactgcacaaattgtttgtagagcatgtgtgtttgaacaatatgaaatctgggcaccttgaaaaaagaacaggataacagcaatgttcagggaacaagagagagaacctcaaactctgactgccggtgagccaggcggaacagaggcatatttctcctctttcaaaagcaaatgggagaaatatcgctgaattctttttctcagcaaggaacgtccctgagaaagacaatgtgtccctgaggggaagcctctgaaatggccgctttggggatggctgtcttttatggtcgtagctgtgggatgaaataagccctggtctcccatagcgctcccaggcttattaggatcaggaaattcccgcctaataaattttggtcagaccagttgtctgctctcaaaccctgtctcctgataagatgttatcaatgacaatgcatgcccgaaacttcattatcaattttaatttcgcccaggtcctgtggtcctgtgatcttgccctgcctccatttgccttgtgatatcttattaccttgtgaagcatgtgatctctgtgacccataccctattcatacactccctccccttttgaaaatcactaataaaaacttgctggttttacggctcagggggcatcacagaacctgccgacaggatgtctcccccggacacccagctttaaaatttatctcttttgtactctgtccctttatttctcagaccggctgacacttagggaatacagaaaagaacttatgtgaaatatcgggggtgaatttcacccaatacaccaggattctctcatacattaggaagatatctaattatcaagacaaagcgtcctcttctggtgttctcaatttctgtttatttgtttgacatttttacctgctcatgagtcagtatctctggtgatggaatattttaatatgtaaacatcttaccttttaactatactgctcagatagtaggtttatattttacatcatttcctctgcccctggttttctaccgtttatacatgattttttttgaataacaacctgaaagaccaaagctctaacttattttcattgatatggagtaaagtggtatacatttaaattatgtattggacataagatccaagattttccaacacacaaaccgagaatgcatttaccttcttggtatgatcacaggagcaccaacatgactggctgaccccaaacacctccccactggctgattataatagacatgtaagatacatgtattttacagggataaacttgtaatattctttcagacatctaaaaggtgaacaggcatcattgtatccatgtagatacagaatagtacctaatctctaaagaggaaaaacccttagaattagaggaaaagatcgtacaaatttaccctctgcaaataaaattaataaagtcatcagcatatgactttttacctagatatagacatttacttatatgtaaattaacccttaatatgagatattgcaaatattttctgaaaatatgagactttatctgggtttatctgagatactctaaacccattttggggagatactagagtatattcttgaacagacctgacttgcctatttctgctttaaggaaaactataatccacctaattggattgtaacatgtctggtgtgaggtacttctagttattcataaaggggaaaactgtataggaagaatgcattcagaaagagtagaaatgagatccatagaaagaaggaggaggaggtcgggtgtggtggctcatgactgtaatcccagcactttggaaggccaaggcgggtggatcactaggtcaagagatggagaccatcctggtcaacatggtgaaatcccgtctctgccaaaaatacaaaaattagctgggcacagtggcgtgtgcctgtggtcccagctacttgggaggctgaggcaggagaatcacttgaaccagggaatcagaggttgcagtgagctgagatagtgccactgcactccagcctggtgacacagtgagattccatctcaaaaaaaaaaaaaaaaaaaaaaaaaggaaagaaggaggaagaggaggaaaagcagaaagagggaagaatgaatgtaaactgcaggtggcagggctttagtctgcaagaaactgactactatgacagagcaaatgcacgctctcagacctatgagcttctaaaatgatccgaatccatgctgaaaaaggaaactttggatcactttttaggttttacaaataatcttcatgcaccaagaactgatatgatcaatttgttaaggtttgcttgtctatttagctcttcttagtatagtttttattcctttgaattggccaaaaatactgtttcttcaaataattaaggactctatgtcttttgcacatgacattctaatttggatcaaagaattaagttttgtttttgttttagtgttagaagcaccttatagatcatcaacttccatatttttaatgaaaaggttaacattttgtcaagatcactcaactagttaatgagagcattggggttaggacattggggttgtcctgtcttgtgattcaggacaactctatttccagtgctccatatcacctatttctagacagtatctaatgatcactggcttcttagaggttagtagagaaaagttgtttgccttgcatttatattttaaatatttgactttatttcaggataatgttattatataattggctaatttgcttagtttaaaatctcaaatactgttttataaggattattgtctaatccatacccctaaaataaaatgcttaccaaatggcatagagaaaaataatcagtgtaattaagcctcttttgtgtatgaataaatgaaactcctgaatctgaggtataatcactatatctttaggagttctagggtttttatgttgaggaataaattgtaataaaatatttcagaagtcagcacccaaaaatgattgtttaatgacctttgaaatatcttacttgatttcaaggtgctaaattgttttaactacactaacacaaaagctctttaaaagctaagagtcacaattcaagaccgtgggttcattattttatatggattggcacaaactcagtcacctgttcacagccagctccacccccagcgcttctcagctctcatccaccatgctgtcatcacattcttagttttcagtcaaacaaggtctggagctctctttacactgcatcatgttaacatcttatttgttagcttcaagtgtaatgcctgttcaagtttggcatatgcagaagtaaccacataggttctaaatattttaaaacttgatgtaaaaagtccagattacctcatatttagttattctgtgattggccaaggtcaaacagtaaacttggtaaaaatcacaccaaagaacaagcttatctgctggtattaactctaccatttaaaaatacattgtcaaggtgtgcagaatatctaaaggactaaagtttctgctcaccatcccttaaaagccaggcctgctgacaaaggatgtgctccataagtgtctgcatttattaaatcatttaattaattgtagaatggctactatatgtcccatacatggaggatctaatggtatataatgcagacagccttttttttttttttttttttgagacagagtctcactgtgtcgcccaggctggagtgcagtggtgtgatctcggctcactgcaagctccacctcctgggtttacaccattctcctgcctcagcctcctgagtagctgggactacaggcgcacatcaccacacctcgctatttttttttttttttttgtatttttagtagagatggagtttcactgtgttagccaggatggtctcgatctcctgacctcgtgatccgcctgccttggcctcccaaagtgctgggattacaggcgtgagccacagcgcccggcccacagacagccattattttaagtgctgataacatagctgggaagaaaagacacacaatattatccatgataaggcattagataataagtcatattaatggtatttacaattgagatatctggtagtcagttaaccttccaccaactaactatatgccatcggcatgttccttaattttcttgtttgccaaatgaaaaagaaatgcaaactagaaggtctgttaagcttttccatctctctggctgtcttcggtccaatcagacgtaacaaagttggttttgccattgggagcaaatgctaacaaataatactagataatattaggaaaacaaatttcaaggtaaaaattattagtgaagacaaagacaaatattttatgaaaggtataatagaaaacaaaagattatggactttgaatccatttagacctagtttagacctaggtacaaattctagctctactatcttctaacagtgtgatgtcaaaaagctgattcaccattcttaacattctataaaatttggcaaataatatctaactgagataaagcctgtaacatagtctggcatgcaaaagcatttacacaggatagctattaatattactacaagtattatttgcatagcattttttttccttttctaagtcctcacacattagctatgtcattttatcttcacaactactctgtaaagtggtattgtccccattctgcatttgaggaaatggaatcacaaagaggttcactcactacaataggtaactataagtggataccttctatgtctctctacacaaaaattgtggtagagagagagagagatgaaggtgagagtcccttgactccccataagtatcaaattttgcacaactatttttctcccaataagagtcaatcctaaaatgtctgcactcacaactttaaaaatattccttttctatgttgccaaaaatggatgcagtgtgtgtgtgtgtgtgtgtgtgtgcgtgcacacacatgtgcacaaaggaatgcagtgtcatggaactgcgattagtaattagtagggattattcatggcatactttatagatttttagtcagtaatgtcaagatgttttccaagagaaaaaaaaaagtcttttcatcaatataatggagattaaaagcataacagaaataaaatgctggtgaaatgtattttatacaaaggcataatagccaaagtcaagtgacagagccaggaatagaacctaattcaaatgttttgactttatttcacttaaatgttgcttacaagcttagaaagtatatattgtctcgggccttaatgctttttaattttttactgtgtgttcatatcttggatagaaaaggcactcagtctgttaacaaggtcaaaataactccttcctactcttaggaaaataataaataaatttgaaattcttcaagactaaatggttaatagcagccacacttgtgagtaggaagtctgcctttaaataatgatcacaaccatggaaatcttgagacctgtctagctccggtaaaactgcctgcaggtcacactctcactgcatcactacaatcctgttttaatgcagcaggtagctttatagctgtgaattttctgaacataaattgaattatggaaaactgacctatgcacgtcacttagctaccttccagtcataactcagatctaatctttcttagctccccgcagaaaatgtctaagactgaccacaaattccagaaattacatgtgggttggtcatgggaatgtggttttcatatactgggggatttagaaaacaggactccaaaagcagagtcacctgggcctgtgatgaataactactctggtgtgggctgttctgctccagttcttaggaaggaaggtatcctagaaacaagcaaagaaatagataaatcctgggtgatccctatgcttttcctcatttatcttcctcttgctttctaaaaaaggtttataacaatcataaaaataatacaattacgtccacagtgaggggatttttttctccactggcaccaactcataggtcaaatgggagattcatactgacaagagtccagacttctctacacagcagaattgacagtgacagtccatttcttaaagaaagctggtgtctgtgcttcctgctgtcagtccttaccacagagctcatcgactctggcatcaaaggtatcagcaccatctcatgccaaacctatacgagggaatctaactgcaaaggggctttggaaattgaaaaagtttgattacaaaaaacgttcgaatctggagattaataaccttcaaagttctgaaaacaaaaatgtgagatccatttgtgtgtctctgtgttgaaaaagcaattccgcagacattttcactgacttcaaggttaccttttttaaaaattatactactgctttcatgtttctgttctgctccttgccaatgtagttaaaaattgttccatttttgaaatcagataaatctgctaatttgagtgtgactgtcctcttgtggctgctttcctaggtatattttatagctgacagatgtactgcagctcctatataattaatatcctggagtttctatgtttaaacaaaaatgcttaaatcatattatttaactgttgatcagagataaattaaaattttcatgaataaaagacatttttaaatgggacattgtctcagcatttcttttatcccaccagatgttcattttacctgagatttgttaaatgaataaaccaattaacaattaataaaataattaattaattcagtttatttttagagcaattttaggtgctcaaaaattaagcagaaagtacagagagttcccatacacccctgtcctcacacacagacaatatacccctctgtctatatcctgcaccacagcggtgcatttgttacaatcgatgaacactgacacttcattatcacccaaagtccatagtttacataaagattttctcctaggttgggcacggtggctcacacctgtaatcccagcactttgggaggccaaggcgggcggatcacctgagatcaggagttcaagactacctggccaacatagtgaaaccccatctcttccaaaaaaaaaaaaatacaaaattagccagccatgttggcaggtagtcaccatgtagtcccagctgtcacctgtagtcccagctacttgggaggctgagacaggagaatcacttgaacccgggaggcagaggttgcagtgagccaagattgtgccgctgcactccagcctgggcaacacagggaaactccaactcaaaaaaaaaaaaaaaaaaaaaaaaaagaaaaggaaagaaagaaagaaagatattctcctggtgttgtacattgcatgcggattgacaataataacatgtatccaccgttgcagtatcctacaaaacagtttcactgccctaaaaatcttctgtgctctacctcctcacctctccctcttcactatcccctggcaaccactaatcttttactgtccacatagctttgtcttttccaaatgtcatattgtggaatcagataggatgtatcctttcagattggcttttttcacttagtaactatgcatttcagtttcttccatgtcttttcatggcttggtagctcatttttttgtgttgagtaatattcccattgtctggatataccccggtttatttattcattcacctactgaaggacatcttgattgctttcatgttttggcaattatgaataaagcttctatgaacatccatgtggaggttctagtgtggacataagttttcaaatcccttgggtaaatatcaaggagtgtgattgctgggtcttatggtaacagtatgtttagttttgtaagaaactgccaaactgtcttccaaagtggctgtaccaccagcaattgcattcccaccagcaatgaatgacaatgcttcttgctcggcatcctcaccaacacttggtattgccagtatcttggattttggccattttattagatgtgtaatagtatcttgttgttttagttggcaattccccaatgatatatgatgttgaacatcttttcatatgcttattggacatacgtatatcttctttggttagagatttgtttaggccttcagttcatttttcagtttggttgttttcttattgttgagttttaagagtactttgtacattttggatgataatagtcttttatggaatctatgtatttcaaatatattattcatgtgtgtggctttgttttcttattctcttcatattatcttttgcagaacagattgtttttattttaatgaaatccagcatatcaattgtttccttcattgatcatgactttgatgttgtatctaaaaagttgttgccattctcaaaatcatctagattttctcctatgttatcttctaaaagtgttatggttttgcagtttacatttaagtctatgacccattttgagttaatttttgagcagggtgctggggatgtgtaaagattcatttttccacatttggatgtccagttgtttcagcatcatttctgaaaaactatcttttctccattgtaatgcttttgctcctttgtcaaatgttggttgactgtctttatgtgggtctatttctatgctctctattctatactatttatctatttaccttttttgttcaaataccatactggttcaatcattacagctttacaataaggcctgaaggcaggtaatgtcagtcctccaatgttgtacttctctttcaatattgagttggctattctgtgtcttttacctgtttatataaactttagaagtaatttgtcaatgtccacaaaataacttgctaggatttgtattgagattgcattgaatctataaagttgtgaagaagtgacatgtttgacaatactgagttttcctgtccacaaatatggagtatctccatttatttagacttttaaaatatctttcatcagaggtttgtagttttcctcaatttaaatttatacctaagtatttcatttttgagggtgttaaggtgtaaatgataatatgtttttaatttaaaattccaggctgggcgtggtggctcatgtctataatcccagcactttgggaggccaaggcgggcggatcacaaggtcaggagttcaagaccagcctggccaatatggtgaaaccccgtctctgctaaaaatacaaaaattagccaggcatggtggtgcatgcctgtaatcccacctactcagaaggctgaggcagaagaatcgcttgaacccgggaggcagaggttgcagtgagcctagattgtgccactgcactgcaacctgggtgacagagtgagactatcttgaaaaaaaaaatttccacttgtccacttgtttgttgctagtatataggaaagcaattgacttttgtatattaatcatatattctgcaacctttctacaatcatttattagttccagaaagagttttttagtcaatgctttggatttttgacatagacaatcatgtcatctacaaacgaagacagttttatttctttttcccaacctaggactttttaggtttatatttattgtaatattatttgtactacctcattggattgtcccaataaatgaataggtgtgctgtccatagacattgtcttcatcttcctaatgagagaatgatgggctaagttgctcagattcacatggtattgaaatcagtatttgtttcactctatgctctttcctactacattagactatactgccttccaaggttctaacaagttttgattttaaaagcagcatcacatttcttacttaaattagtttatacatcaaatcagttaatttaatgggcaactttcctaaaatttcttttaagtgtactacacacaaaaaagaaaaacccataaactaacaaaataagttaaaaagcttacaatggatttatgtagtataaaaataggtggcaaattttttggcaattaaaaatgtttgaatgctaaaaactgcaaaacattgatttaaaaaatcaaaggaggcctgaataattggagagatataccatgtttgtggattggagaactcaatactgttaagatctcaatcctttttaaactaatataacgattcaatatgatttctatcttaatcttaacaatagttgtgtaggtactgataggcttatactaaaatttacatggaaaagctaaagaaatagagtagccaaaccaattttcttaaagaaaaagaaagaggactgacaacacctgatttcataacttactataaagttacagttttaaagacaatcttgaataaatggtagacacatagatcaatgaaacagaacacagagaccagagacatacccacacatataggccaatagatatttcacaaaggtacaaacatgatttaatagacaaatgataatcttttcagcaaataacgctgaaacaattagacatccatatgtaataaataagtaaactttgaccctttatttcacaccactaattaactaatatacaataattaatgcaaaccctaaaattatcagacttccagagaaacatagaagaaagtcttcataattctggattaggcaaaagtttcttatctaagtcataaaagcataatccatatatagtaaatttaataagtttgatttcattgaaattaaatgttctgccatggacaagatactctgaagagattagaaaaacaagccatagaaatagagaacatatttataaatcccataaataataaaaaacttgcattctaaatacataaacaacttttaaacaatacaaaataagaaaatagggcttgaaaataaaataaaagatatccacttcagaaaggaagaagtatagctatattctcagatgacatgatcttgtatatagaaaatcctaaggaagacacacacacacacgcacacacacacacactgtatgaacaagagtgactctatttaaatgctaatctgccatgtgactcctgactaaccctaagtctaggaatgcctccaagatgtctagctgatgtattactttttatatagaaatacctgttcactgtaagttttccctttcctccaaaacaacccttgatggtgttgcatacatcataggctatgaggcccatagctacctactcattccttctggagcacatatactttttccccaattcaagcctggactaagggggttgtggtgcagagatctacctatcttgcagctgtgtaagacatgcttccatttgtaagttctcccaataaatcactattttcctataatctagatttgtctgcctcactctttgctttcttcactgttagcctttggaggatgctttgtatatacagccctttcatggaacacacattcacacagcaacaattagagctaaaaagttcagcaaggttgcaagattcaaaattaatatacaaataacaggccaggcacggtgactcatacctgtaatcccagcactttgggaggctgaagtgggcaggtcacctgaggtcaggagttcaaaaccagtctggccaacatggtgaaaccctgtctctacgaaaaacacaaaattagccaggcgtggtggtgggcacccgtaatcccagctactcgggaggctgaggcaggagaatcgcttgaacctgggaggcagaagtttcagtgagccgagattgcaccattgcactctagcctcggcaaaaagaatgaaactccatctcaaaaaaaaaagaaaatatatatatatatacacacacacacaaataacaaattatatttcaatacactgcaataaaaaaatctgaaaatgaaattaagaaataattccatttacaatagcatcaaatagaataaaatttattgataataaaatttactgaataaatttaatgaaataagtgcagactgaaaactacaaaacattgttgaaaaaaattaaaggagatctaaataagtagaaagacaactcgtgttcatggatcagaagacataatattgttaagatggaaatactcccaaactgatctacagattcaatgcaatccctatcaagatttcagattgtcattgaataaattacaagtttatcctaagattcatatagaaatacaagggacctataaaagccaaacaaccttaatggaaagaagaacgatactggaggattcatactttctggttttaaatcttactacaaagataaagtaatcaagatagagtggtactggcataaaggttgacatatagatcagtggaatagaattgaatcttgaaataaaccctcacatttatagttgatttatttatagcaatgtaattgaaaaataattgtcttttcaagaaatgagctggaataaatgggaatctacatgcaaaagaatgaaattggactcttacctaacaccatgtacaaaaaataactgaaaatagatcaaacacctaagtgtgagagctaaaagtataaaactcatggaagaaaatataaaaataaatctttatgaacttggattaggcaatgacttcttataaatgaaaccaaatgcacaaatgacaaaagaaaaaaatagataagctgcatttaatcaaaatgtaaaaccttcatgcttcagagaataccatcaaaaaagggaaaagagaacccacagcatggaagaaaaattttgcgaatcatatatctgataagggggttacatcaagaattcataaaaatgggcaaaggatccaaatagatatttctattaaaaaggtatacagatgaacaataagcacatgacaagctattcaacatcattagccaacaggaaaatatagagaaaagccacttcacccccacgatgatggctataatcaaaggcaaatagtaacaactgttggcatgtagagaattgaagccttcatacactgcagatgagaatgtaaaatggtagagcctggcaccactgaaaaacagcttaatggtttctctaactgttaaacatagagttatcatatgaccgaaacccagaaatgccactcctacatatatacccaagagaaatgaaacagtatatctacacacaaacttgcatatacatgttcatcagaattattcataacacccaaaaaagcagaaatgacccagatgttcaccaacatatgaacagagaatgaaatgcagtacacaacagtatacatcagaactgggcataagccggaatgaagtactgatgcatgctacacataggtgaaccttgaaaacattatgccaagtgaaaaacaagtcataaagaccacatattgtatggttcctttatatttaatgtccagaataagaaaatgtgtagagatagaaagtagggcttgaaagtagattaatagtttgatagattaatagtagattaatagttacctagtttcagggagatagaaaaaatgttttaaaattgattgtagtgatagttgcacaactctgtggaatattggaaacaatcgaaatgagtgaattgtataaaacatgacttatatctcgataatagatatctcaaaaaagatcattgatatcatttgtaattagggaaatgcaagttgaagcattatgagataatattacatacatattaaaaatggaaaacagaacacacacaaaaattatcaatacgaaatattggcaagggtgtggagcaactggaattcttatacattgttagtgggaatgcatgtgccatatgactcagtaaatccgcttctgggtgtctacaagagaaacaaatatttatttacagatagaaatctatactcattcctcagtctaaacgttgccagtccttctgtctctaaactttccctctattctcatctccttttcctaattcaacttttaacccccaaattctctttagttcatagtttagaagcccacttctcaaaattggaatgtttaatcctaaactaattcaatctgcatataagttcccataagacccagtaattacaaccatacacaattgccatttacttttatttagctcctcctaaatgctaggattcaaagaggtagagtatatttcttctgattgtgattgaatctctagcaccagcagtgcttctgttttatttttaaatttatttgaagaacatttgcccttttgcaagcataatgcaaactttaaacatcatattgctagctaagaaaaatttaaagcaacatagataattctcctttgacacaatgatctgactagaccaatagctggaataaaataatgagaggaagacattagagtgaaaaaagaggaggacaggaagagagatcatttgcagtacacagtcactaggctgattcaaagcaccaaagtgaaactctctaaggatgtttcacttttatattggaacgccatatataatttcataaaaatgtcaaagtgattttgaaaactcaaatctcttcaagttgcttatacttaagacaaagcgatcaacgcaattcagagtaaatttgactttgttttttagtgatgggagcatttcttaaaaagcatcaaatctaacatttctatcttgcagaaatcaccaagcctagttaattttctcatgaaagggactttctgggtatacacagctacagatttaactaggtctaacatacacatgaataatcctttgcaaggtcccccttcctctctcctgacccctaccctaacattgcttgcaagcagcagaggagataaggggaaacagctgatctcctctgtgtttctctaatccacttcaattcacctcctaattcaagataaatcactacaggaaagaaagctgggaggaacccacttccctaaatcaagttcccttcctgtattttactagatagttgcaatacctgattctcaccaaaataacgtcctctagatcttatagacatctttaacaaaaatccaccttgttgagccttgtcttttcaaaacttgaccctagagcagaaattgcaaaactagtgattcttggcattatgtattgtcataagtgatgggattgtgtttttgctttaattttgctttaaattgattcagctctctacatttcaaaacaaacaggcttttacattgaaatccatatttcttagttcttttgagaaatgtgaatgtctgtcaacactaggcctgcattcatgcacagcaataattgactggggacgagtagaggccaacccctttagactgagtgtatactcattatttcagcacagcctcatgctcctgagccctttctttcactcattacttcttggtaacctactgtaagcatttgaattttctgtctccaccttagggctgagagggggctgagtgatagggagtggcaactctaaatgcattttagattaggaagaatattcataacaaaatgcccttcgagtctatacttctattaggaactcaatagcctattgaggattaagtaaggaagctaactagtatacatagcactggttaaaagacaaaatggttccaatcaacttacaaatggactacttgtactttctcattagaagaagatgactgattttcttaggtcttgtgtcctgggctaatcgctaagcaatagctaagcagttacttaagagttagaaagaatgactgcatgcagattttacaggcagaagtgtgggcttcccagctctctgcttctctaattaaggaaggtggaataagaagaaatctaatcaactcagaatttttgcagcctgatgtactcaatagcaggtctcttgtccaaaagcgttcagaaaggtttctcctctcttcatttaaataattaaacatataaaacttgggctcactttctacttttaaatttattatgctacctttatccctttaatctctggcattgatagaactgagctgatatctacttttccatatattagctgtgtgatcttaagtgagttgcttaatttctctcagctagggtttccttatcagcaaaatggtaataatagtatttatctccatcattgtgagcattgatataatgaggtaatgagtgtaaagtattttgcatgattttggcacagattactaaatattttattttcctttattttcttcccttttcttttctttttattatttttaaagttattttcatcctataaaagccataaaataaccactcctgcagtatgtctggttaactagcctcttccattcaccatcaaattacctacatgtatgaaacaaataaaagaactctcccctttggtttttagaactttcaatgccaggaatggagaaaattattttaatctcacatcttccatttatagataatgaaactgaattccaaaatttagtgatttgttaaaagcacttcagcatgggagtagaactcattcattttaaaacacaaaagacaaaaatggaatgaggctttaaccagcagggttcagtatatataagccctaaagagcacgtcgtagggactcattatgcttgtgtttaattgagtggaatagtgaattgattaaaaagaacagatcatccccaaagtgcatgatcaggctgatgattaaaacaaagtttggtttcaagactgggattattcttcagctagttgtcagttagcatgtttgcttgttacctcttgaccaaataccatgttggaggtcaatctggggaagttttcaagttcagagaagtttcacccaccaattaattgtatatcaaaactttgggccgggcatggtggctcacgcctgtaatctcagcactttgggaagttgaggcaggcagatcacctgaagtcaggagtttgagaccagcctggccaacatagtgaaacctcatctctactaaaaatacaaaaattagccatgcgtggtggcaggcacctgtaatcccagctacttgggagactgaggcaggagaatctcttgaatccaggaggcagaggttgccgtgagcctagatcacgtcactgcactccagcctgggtgacagagggtgagacttgtctcaaacaaacaaacaaacaaacgacaacaaaagaactttgggtacataattttagcagagaattttgcacatgacaacttttgacctgttaatgttgctgaaaaacaattctatctgaaattgaaagttggatacaagggtccaacaacatatacatttgaaaattaccttatgaagtgaaattttcaaaaggaaaatgtcaccgcttgtcagagctatctgaagattcaggtgatctcttttcaggcaagatttttgaaaaaaacatttagagaagaaagggaagacaaatgtttcctgaacgatgatgtccacactgtgtggcatttggtactttaatgtgttcgtattcattggatcctacttgcttcaggttgcagtggaacacttcttttacaaggcagatataagagatatcaagtgtttttcctaagaacacctagccaggattcaaacccaagtctgtctccatatttcatactttactcaataaatcacgttgttgtccacatttcaagattttctatggggttaatagatgttcgtttattcaataattcattcaacatttattgaacactgcacttactaaatgtcagactaagaaacaaaaacaaaggttctagacagtatgtccagggtccagcacagtatatggtcacaataggctttaaagacatatgtattaaattaatgaataaagacacttctgctctcaacttgctcattatctacctagaactgcactgtctgatatctggccaccagccatgtggctattgagcacttaaaatgtggccagggtagattaagatgggcttcaaatataaaatacatcccaaattttaagtcttagcataaaaagaaatataaaatatctcattaatggcttttatattgattatattgaaattatagtgtttggggtatattgaattaaatgaaacatattaaaaccagtttacctgtttagttttttactctttttagtgtggatcctagaaaatttaaaactatacatgtaatttctttcaattcctattggccagccttaacctagtgctgttaagtcctggggcacttgcttttctgtttcaagttcattattaaaactagttctattctctctcttttatgtatgataataagttaggtttaaatgcagtttattttaaatgcaatctatgtttgtgagattagaatcaattgttaaaggttagaaatttttgtattcagatgcaaaatagtccacacgcaggctctactgaaatatgacttccctttagtccctttcctggtgagaagctaccacagttctccagatatgttactgccagctatacaagaggaagtctaacccgtgcagcctgataatcaaatatttaaggctgttcaactgcctctatcccatctcatgctcctgccaacttacctatctagatttcctttctacagtattcctggaacacaggaatgagcactgtacctttattcatgctgttatctctacttggagttttttgtttgtttgtttgtttttcaattccaatgcctgcctagttttcaaggttcagcttattgtttacttcttgccaaattcccaaactactataatcccatataattttctcttttctccgaattctaagacactaacattccatttgaaaatatctatacttgattgtgggaaggctcttacttttctataaatgaatcattacccttttcttatattccaaagaccgtaagtagaaaatttataaagaaatcactacaacatggaaaggaactcaccgtgcatttggttaggcttttaaaggtcatgttcagccacatctttttaacagtaaaaggactaagatgctgagcagtttataaccaagggagtgggcagtcacaccggtgtgctctgttctacataagtaaagcattcccgcctatagcatcccttccctaccaaaacaggagagctgccaagatgctcacttagaacagttgttggtttgtgtacaagtgttaagtatgggtttgttctttttcttttatatttttttgagggaaagaagaaggaagaatggaaggggactggaaaagctgtatttatttataatcaaacatatccttatttgataacagatgaccaattaaagcaatgtgtgaaacttgaacagcattctgtcaaaaagcaaagaaattagcagagctcatagcaatcagcacttcttgcaaactgcaagagtcccctctaaagccttctgtcttggcactggggctttgctaaatagggctcaccattttgcgagtgggaacaatcagctttgtaggtggtagggaagtattataattaaatgtccacccactttttcctttctgatgaaaggctcccatgaaacttactaaaataaggtacataaagatagatgaatttttgatgagtaagtcaaagcaccgacaaacctggctttccacatagagaaaattctttaatttatagaaaaatttcggcctagatcattaatactgtcatatttaataactaatacgataaaatccatagggtaactggagatttcactgttttcgttggtagtgattgtagtgctcagcatgaattgacttgcagaaaacaaatataattcaaaaaaagagtgaaatttttcaaaattgattttagagaaatattaagtgatagccatttaatcataatagcctttttaataataaataatgcatttattgaatgtaatggcattcttccgaataatagttatagtaccactttaaggttagaaactatatctctgatatagcaaagggcttgaaagatgttattgaattgtcagaaactttttatgagggagctctggaacagagtctatagagtctgcttttgataattaatggtaatggcatttactaaaatcactgtgaataattaattttaagtacttatatgcagtagagtagggagcttctctgctttataactgagctcagacatatatttcaagtccagttactagcattcacaaagtcaatattttagaaagaaaaagaaattaaaattaattggtactatgaatgttttccttcattcaatgtggatttattgggcatgagctgtatagactttgctatcagaggagcctcaaagcaataatcctctctagaactaatgaatatttttatttttaagctaaatttcatatttttatcttcctgttcaatagattttattggcagaagccagtagagataacggtgccctaaatcaccaacaaggtgagatcaaagtactggggaggatatgaacacatttgtcattaattgaacacatttgtcattcattgctaatcactatgtgaagatgacttttaaaatactcctgacgacttcttatccttccccactgtggttctgtggatccaagaacacagagtaactggatgctcaaagtaggaaaagtttgcataataggtactcagctcagcataactaagataaaattagccacaaagatctagattctccagttactggcactatccagggttttataaccatcattacccatgatcattttatagtaaactacaataatagatgtggtgacacatctgaggtctcctcctgtattattagtatagcgggacacctcagatgtgtcaccaccaaggaacaggcatgttcagaccaaattcttcggccactgtcctcctcattcccgtttgtttttttgaattccccagaacttcttgtttttcaaattattacccacatacttttttaatatttcattttctgctttgtgtttagtcctactttttactatctttttgtaaaagttacacgttaaccattatttaaagagttcctttaacagtgtggaggttttcttcaaagacttgatagaaatctttaaatatgggcttttttctcatttaagtcttacttcaacatgttcactgattttagatttctctgacaaacatggttgaggtatcaaaacaaagacatgttgataatagctttttctcaaagtcatttagaatgtaagactttctgccgtgctatgtcaaattgcccaacttgggaataagatgagtgtatgtgcatgtctgtggggtggggtggtagggagcaaggaagtaggggattggtaaatagtctatacaaggagaactcatattgtcctctaaaactgatatatttaggctctcctattttccacgagtctatcatagacacttgtgtctcaatgtttgtagtaaattactgatgattttctctgttgctttggttaggaagatcctttcaaaaacagatttttctgggagataaatgcagtactttttcttcttcatgagataaacacacacacacacacacacacacacacacacacagagagagagagggagagagagagaaagagagaaagagagagagagaaacaacctagtgtgcaagcagtatgcctaaaaatcatttttattttctcctgttataggaatctataagtctgtaagtctctcagttgaaaaaaaaattgttacatcatagaatttaagaaacttggaatgaccttagatattatcctgtctaactttcactttatagataaagcaaatgaaaccctgagaagagtagtgaccacaaatactttgctattccttctattgagaaatgtagtctcactgctcccttttcctgtgtctgggcagtctctgtaattggtttgaccaatagaatacaaatgacaactgcagcttcctaattcttgcttgcatttgggacttctcatctcagaacccaaccaccatgctgtgaaaagctgaagctacatgaagaagccatgtattgatgcaccagtcgacaaccacagctaagcccccaactgacagttaacgcacttccagtcatgtgaatatgccatttagcatgtccggactaggccaacctttggcaggctccattccctgccagtatgtgacagcaatcacacgagaaaccttaagcaaaaattgcccagctcttcccagtcaacccatagattagtgagagataacaaatagttgctttaaatttcaggatggtttgttatatactaaaagctcatcagaaatgaaagtgacttagaccaaaacttctaagcattaccagagtgaaaaccagaactcaaatatcaccccaaacctcgtataatctcattataatgtgttaaggaaacatgtcgagttaaatgagatccagtttcagtctcccaatagttcataattccaaaagattttattctttcaaaattcacatggaatgcagaatttccaaaattcttgaactttaaaacaaattcttagagctgtgtctacataacagtaaaccatcatttggtataaggtagcattcccaagtgttcctcgaaggtagtgtcttagtaatgtgccatgaaagaaagagagataagctgatttaatttgtttaaactaaattaaagaggtctctttgcttcaggatttttcaagaatgtaaattttccaagaggagctatagatagtacttattttctgagaattgttcgaccaaggcacccttcttcatcaaaaaactaaactgagaaataggaagaggaattcaattttgtcagcataaaccaagttttgctttcagaggatttcataaaaagaagttgttttcataatttggtgtgtcttcagcttagagaacacatttttagataacacttttatgactgtcagggactgtgcttagttatgtcttttacaacctgttcccatttcttcccgccttacttttaacattctttggtgtctacagttaataaatctttctggaatgtgtagacgaaggaataaataaaagcagataaataataaataattcaattaattaaaaattatcctgaaatgtttcattaacaatgtcaatgactatgaagaggcccaaaggtttttgagtcaacctctcatttagtttaataacctggaaattagctccaactctaattagcttggtttgggttttatatctttatttacatctaaggccaattgaaattgtaacacttgccatatctaacagagttcttgggaaattcaaagaagatttcaaagttggaggtggaacggctttgggctacaaaaattgtagcaatcatgtattcatccactcctttcatcttctagttctggagattgagatccagaaagagagtttatagcgcaaatgctagctgcattggaaacctcctccccgtggatccacgttaaagatgttaggaaagttctctttttcagtagatgttatattgaatggtgtgattctaattcacgtgctgattattagacagactatttacaagcatttgggccgtaaaaacatatttgaccacagaattcatgactggtataggaaggtgtggcagtcaaaacatttaataacccatatggcatggccactgacaaccagagtagacaccagccatgaacaactggtgcagccatgctgatgagtatgagccatactgaatatcatctgagatctatggatctagtagataacatttcccacttcttgccactggtttgtggccttgtgaatactttcatcttatttgtattagacattcctccattcaggctgtctcttaaatatacttgtgttattgacatccataatacagtaagttctattatctctctcctgggaagctatcagcacttcacagctccttcagcaatatgctatcctgttccaaaaatcatggtgcattcccatgtctctagtttccaagcagagggaataatagttttatggtcttcttttgcccctgtggggacatgagccagttcactacccctacttacttattcctggatatctctaccctgtatattcctatattcttgttctgtagtcatgctacatagttaaatatgacttgaaaggctgacagagtaatgcagctacaaaaagatggcagagaaataataaaataatatgtgatagagtatttgatacttttaagtcagaatgggaagaaaatatttgtaaggataaatcaaagtattctgcatttagccagttcctttgtgaagctctaataaaatatgtgtttaaaaaataagacaagccaatgtggagtgatctatacaatcggacatatacaccttcatattactttggccagactctgctgtatttgtaacacggtgtcaaaagtttttatttaggtacaattcaaccataaatggagaatgggagcctcattctcctggactttagtgagttacagttctagcatgcttacctctacaagcctgctggtgtgttcatgaaatatcgcagcatattcttttatttccttttcccggccattcttagcagcttcaatgagaaccaaaagagggactgtcgtatccaggaaagagtctgacacatgatctataatagccttgcggagctgagaagaaatgaaaaattcaggttttttttttccaggaaatagttcactgtgtttccttttcttacaatctcagtagttacacaactcatttttcatttttgcacaattcctaaaatcacaatacttaaagatatacaagaatgtcccttaagaaactaaaaaacaaaatatccaggcaaaaagaaaaaatcatctagcaatatttcctttcctctcaaaagtaatttttcttaagttgtatttaacctggaagtcagattaaaaatggtaatactttcttttttgctcaaagaaattgtgttattagaatatttatgagtgtgtacacataatattgtacatcttgtatttttataattacaaattatagaatgttttctaccttgttggaggaactgatgataaattttgattagctaaattgtagacttcatagtaattaagccaagttagatcaccgattatgccagttgataacagattaatagagcaagaagaataataaatgagtttgatgtccaattttccccatttgcattcattgttcttgccctcacactttaaattattaaacaactataacattctgctacaattagttcttttcaattagattacatgtaagcttattaatgacaattaggcaattactctagtcagcagatattttctgagatttaaaactgcactgaaaaattaattcattgtgtttatataatatcgagtctttaaagatcataatatcgggccaggcacagtggctcatgcctgtaatcccagcactttgggaggccaaggcaggcgaatcacgaggtcaggagttcgagaacagcctggccaacatggtaaaaccccgtctctactaaaaataaaaaaattagttgggcatagtggcaggcacctgtactcccagctacttgggtggctgaggcaggaaaatcacttgaacccaggaggaggaggttgcagtgagctgagatcgcaccactgcattctagcccaggcaacagagtgagactccatccactccccccgacaaaaaaaaaaaaatcataatatcctgaaatgtttcattaacaatgtcaatgactataaatgggcccaaaggtttttgagtcaagaccttcatatagttcaataacctctgtacaataaaacagataaatagctgtcagacagaaaaatgtaatttttctgtcaaagttacattttagagtatttttttaaaagaatagacacttagtttagttttagattacttgggaatgaatagtaatacattttgggagagctgaatgatagagctaaatagaaagtactgtcttctataatgatcatagaataataaatccataataattacaggtttctggaagaaaaatatctctgcccaaaatagtgagcttgctcagaagcattgtgaaattttctgactatcaacaatttaagaaaggcttcaggaagatccccaaggaaggattctgcttagtatgcagaaaggcaaattactagtggcaactaatatttactgagcacttattaggacaaagtatagagtgccaaggggttacaaggcaaaggggagaccttaactgaatgaataatgtgtttgctgtctataggaagtacaccagggaagtcaggcgtaaggtcacgaatttatttgagctgggaactacaggttgtgtaagtttcagatactgaagagaaaagtagagattccttctaatttctcagagtgggggcattttttaatgattatcctcccctttattcttttcttctttcattcataattaggacatgtagattattcttttcttctttcattctaattgagacatgtagaaggaaagctcagatgaaatctacactagagatatgccatgaagggccagcatatgggaactaactcaagcggagagtgtggatgagaccatatagagtgaggagacccacagaggacctcttaggaaacactatcatttacaggagtcatgattaaagagtagggcctaaaaagagactgagataatagccaagaaacaaagagacaaattacccacaactaaaagacaaactttcaaatatatctctgtgttaatgctcttcaaatgtagttatcctaccaaacataactataatattcccatcatggacttgttaaatcttctctgctgtgtaaatgatttcattcaattcagtaaatatttctggaaaccatttcctcacctttctaccaagagaaaggtattgaaggaaatgttaagatggaaattcatgatcccttataatctagtagaagagtgaatattacaataatacattaaacattacaataaagaaaaacttagagactgacagcaaaaaaaaaaattagagtcaaattttaaagataaattaaattaaaaaaaaggaatgagacttgtcccttgggcttgaatactaagaggttattgataaacttggtaagagcagtttcagtggaaaagtgggctgaagagtcctattgctatggtttgaagagtgaatgagagataaggcagtaaagacagtgagtataaacttctgtttttaataatttgattgtgacatgaagaagcaagacttggtatttactactctgagatatatgtttaaagagtgactgtttttcatataaagacttcactataatttcccatctgcaactatagccaaaaagtcttattactcccctttgctttgctggaaatacatattgatttattgccaaagcaagaataacaggtgaaaaagaactattgtctcacattgtgccaacttttgtcatcttttcgtcccatgacagaaggaaatgcccagaaatcagtgacttgagctggatgtgaatgaaacctttaggagctagcacatggtcagaggcagggatgtatctctcccactgaaatcatcttaacccatgcaaaaaacaaagtgtaactaattcaaccaacccacaatattctcaccagtctaaccattctccctgtctaacttgctggttcctgatcctttaccttcactattatgaactacattatagacttttggtgccttatatctcatcctctggatctatctctgatttcagcttttgctggggggaacagttccatgtcctctgaagacattccatgcttcttgtgtgccttccttgtgtctctttgttattctatctcagggcctgttccaagtctctgtgaaattctcaacccagcataaacactgcctggaagttcttcagcgtccacaccactgggggaaaccctcaacctatgcggatagaaactactgcataaaattcctaccctccatccattagtcagacaattctgggaaacattctgttattctcagagatcctcaagctctcattgcctacagcagcaatctcaatagcatatcatttcctctttccctgcctcgcttttcatgttctataacacttgcttccaggaatcacctcctaaataaatgacctgcactaaggtcctagttttagtcactgctttcaggaaaacccatctaaacaggtacctttgtctggtattaatgttgtttgatcatgcaccaagtaagagactccaatgtcttatgtaaactactcattgctaattatactctactaccttggctctgtacatcactgggttttgttctgccatgccctgaattatactcactgtaaaagaggaattattatgagacaggactagaaatgtaggtagggacaagatgtgaaaggactagaatgttatgctaagcaattttcattatatgttctgacatattcatatggaattgttttcattaaattgtatagtcatatatacctacatataacagcaaagtagcctctatcttatttatttccgcattattttcctgcccagtggcacaatgcattcctttcagttgggtgatatacaaaaagtttaaagaagaatgcaatatgccaatatagaaatggaagccaaagcactaaaatctgaagttagtgggaggccaataggaattacagatacatactttcaataaatacctgtttgtggccaggcatgaaagatgttagaacaaaaccaaactgaggtgcttttcatcttttctcactacagtttaataaaaggctttgagacatcaatttttctatttcctactgatgtaagtggtttgggatctcaaaataatatatatcactacaattgaagcccaaagtgaaagccctatgtgaaaagtctaaaaaagccccaccattcccaccaaataaaggaacagaaagaatgaaattgtgatgggaaggggaatggaaaggggagaaagtgtttcagaaaggaatcatcttcagggaaacagaaaaatacatttagactaaaatattttatgttaaaatattgtattaaattttaataaattaacagtatttaaattttaataaatattttaaattaaaagccattttaatttaaatcaaatagcaaaatgtgatttttaaagcttggaattaaatgtactaataattatttcactgtgtatgtactatgtaagtttagtgaaacttgtctcttgtggatacataatgttatttgatgatgaggatgatgaccaggaggtataaaagcctacatatttttttctgagtggtgaactggtactatgcaacatggaagagagatggacctaacaattcagaaactcagcaactaaagaattaatcaagtttttgttttgtctgtttttaccaaaatcccatttgacatacttcatctttactttgatatttatgaaataaaagacatttttcttaatatacacaaatacaaattttagcctgcctttagtgaaatcaaatatattttagtatgtatagtaaaatagaaataagatatatttgttgcttaaatttttttataaagtaaagaatgtttaaaaagtcttcctccttttactgagagagttgcaataggtatacagttttcaaatgaatgatggaaaaagaggctaaagaaagaagaaaatttaactttaaaaaggcatttaaaacaaataataaagaaaataatacatgatggtaaaatcagtgtattaggcactgggaggttctgaaagtgaataggccataatccctagcccctggtgtggtgattacacatatgggctggggttggatggacctgggctagaactgtgtctctatcacgtagctgggtgatgtttgctatgttaactcattttgggggacaaagataacaataccatggcattatttattgttttaggaataaaaattaataatgtaatgaatatgcttggtagagagctttgcaaagcatttagtaaatgagagatgttgtcatagctatcattataaggacttaaaatgcagtgggaagaaaactcattacaaaagaaaaaaatagaagaatataatcattgctgtaatatgcacatgctgtaagtgttccaggaagaaaaaggtccattccagctggtgaaaacagcaaaggtttcatggaagcaatagcatttacactactctggaatttagttgcttatgagttggggttgtgtgtaaggagagtgagtggggaaggcatcaagctgtacaagtcatatgtacaaagatgcaagtgtatttgagcgggaggtgatgcaaattctggtaaataacaagtagattctttcatcagaaaacaggttaatgtgggccaggcctggtggctcacacctgtaatcccagcactttgggaggccgaggtgggcagatcacaaggtcaggagttcgagaccagcctggccaacatggtgaaaccctgtctctactaaaaatacaaaaaagtagcagggtgtggtggcatgcatctgtaatcccagctacttaggaggctgaggcaggagaattgcctgaacctgggaggcggaggttgcaacgagccgagatcacaccactgcactccagcctgggcggtacagtgagactctgtctcaaacaaaaaaaaaaaaaagagagagagagaaaagaaaacaggttaatgtgttggtgtgatgaggaggacacaacactgcgaaggagagctgaaggaaaaggaacattaagaataatggggattaagtcagggccaaatcacagagaacctagaacaccatgccaagaacatttgtctttgttctctagtaaaacaggcaagaaagtcacagaggaagaagattgaaacaaataaatactctcgcctcctagaacattccatcttgatgtcctcaaatctataatttgcttctccttagatatttctaagcaatctctgtcattcctcttggaagaaatccaatcaccctctgaactgaagctgaaatgtttctgcattactgatagaaaggccatggttaagaaaggggataaggatgaatgggcaggaagatgggctctgcttattttttactaaaaaaagttttaaaagataaaaccagttctaaagcaaacgatgaacattaaatactccaaagaaaaacattttaagggcagtgctttctctttcctgtgagaagaactatatgtgagatgcttacaacaactgttggataaacttcttaagaacaagaagtagagataacttatattgctgttttaattaactgtgacttctaccaaaaatgtaaacatcaggatgaaaaataaagtactagggggagggtaagtgaggataatgagaaagaatcatagcaactaacttcatcaaaacggaagatcatggaggtgttcaaagacagcttctaacaattccatccattcctgtacacacataccacttctcctacaacagacagaacttctgcctactcctattgaactgggacagggtttttgactgttttttacttacagattatagaggaaatagcattctctgactttggagctaaggcactaagaatgcttgtcagcttccgtctcccttttcttggcaacttgaaacagcatgaaagagatctaggctaccctgctagagattgaagccacatggagaggccctaaaacattaggcaccgtatcgagagagggaacaggaagaagcactgaggttccaaacatcaagtcccaaatctagccacagatgccatttgactgccactatgtggaaaaccacaagtgaaaacggtacagaaaatggccccgctgacgcccagccaacccaagacatcgtgagatgcaaatatcgttgctactgtttgtggtggtttgttaaacactgatagaaaattgaaacaatggagatgttaacctgtgaaaccatacagaatgttaataccttcagagcacagcagttttctacaagatgggagtatcttcttactatgaagaatagtattagtaatccccaatgctatttctatatctcactgatggtagtgaggtggaaatacaagtaggattgcaatataaaatacaagatgctcggttacatttgaatttcagatgaacaactttttaaatataagtatgtaccatacaatatttgggacataattatactaaaccatgtttgttgttaatctgaaattcaaatttaactgggtgccttgtgcttttatttgctaaatctggtaattccacacacaagtaattgcattttcttgactttatttagaaaaataataattctaaaacctttagaagtataaatgtagattagctctttatgcataatgttgttgaaggcaatatagagggaaaagacacgaacgagagacacaatcattgagagctcatagagacaacttttctgagtcctaggtgaagcagatggggtagaaatcctgaagacgatggagaatagggatcattccacgaaaggggaggatcgctctgaggatataaatttctgagtcctggtacaggttctgactcggtgccccatcctcttaggcaggtcacctcaccacactgacctgctttctcatttgcatcgtaagacaggttgtgctaagttccttctgactcttacattccatgattacaagtgtaaatggtagaaacagaattcacattaagggcataaagttgagaaactgagattttcacagacttcaacattatgtttttatgcagctattattaactggctggagatctctattccatttccaaatctacgtccaaattaaaagattgcttagccattttactaaatcttgccattaaactacgataatacattgcattaaaagttcatagttgaaaagctttttctcccttttgatgagttaatgatgaccaagtgaaagttctgcatgagaaagaactctggttattgaacagaggaaaggaatgaagagcaaatgtctttgaaaatagctaagtcttcctatttctggaaaaatgtttaacttgtggcatcatactagacttataaattgtttaatgaaattctttctaatcccatgttcctgatgacttaaggttaaaaagaaggcttaacttttacaaaaactaatttttgaagtatcatgaaaaaaaatggaaggaggaatgggtagggtctctgaattacttactagttaatcatttggatttaagcatttggatgatgaactctgatgtaatacaatcaattgatcaacattccctaaaaacttgctatgggtcaggcacttacatgcattttattgattcctcacagccctattgcatattattaatttcattgtataggttcaaagcagctcagagagctgaaatatgtgccgaagatctcacaactgatgagaacagaaccagaatttgaatgtaattctgtctgataaggcacacattctttctctgctttgtatttgccacaaaaaacatttgaggtatgaatatataaatgtggaaagtatatatttactctttttttcctgttctaaattaatttgaaaggaacaaaacaagaaacaaatatgcctgcaatgaataacagtttcatttagcccctatgtttctgactccatatctctctcttccctcacctgtctgcgaaggtctcttgtcttcttacacatgttgtctaaagcaatattcagggtattactcctttctttttttccagcctgcaaagaagaaaaaacgacataagcaatggtatcaattaatctttatcacttagcaatttgctttctaaatttcctgaaaataacagcttgaaattcaagaataggtttcaaaactgctatattatatatgattcatgagcatttcacttaagactaagtagaatggtgattaaagctcacattattttcatctttatgcttctgtaatatttccgatacggagttaggttgtattcagtgtgacaataggcagagcattatcttcatgaaactctgatcttcatttttaacaagtcaaatcttaaatcactaagcaggcaattagcttaaaagcattagatgcccaatttgtcaacttctgtgggagtttctaaagtcatttccatggtgtattgtgtaagttatgcagagccatattggaattttgctaaacactaaataaagtatgcagtgcaaattcatacaatttgcaaaagttgaccacaattttagctgacaatattccaagaacaaattgttttaagtaagaactggacgctgtttttggctctttaagataatttgtgcaacacctttttattctttgagcagaacagctctctgttatatccttaacctaaatctttaggctattaagcacatagagagtcaccttggttggtattttctacatattatttttgtgcaagacaactggattaaatctaatcatactttttgcagtgatatctcacataaaagagattggaaaaatcattatgtgattcacctctaggaaaattgctgctgtttaaattaataaactgaaaagggatcttgagagaagaccttgaaaatcaggaaggcaagtttaagcagctgataactgaagggggttacagcacgaactcaatgaaaaaggacactgaggccaagtataaaccacgaggaagcatgtctgacactttccccaatgactaaactcatgcataaacccataccctgcagtggactccctaacaagaaatttaaaaactctctatactctgtcctaacctacttttttactcttatgtactgctatatactctcctttacagtagcaatattcctataattttctgtctcttctccccagttcttacatgtaatgtacctttgatttcagagatcatcttctaaaacacctactgaagtcctatctactcctcactggtttctacagggagttcttccaacaaccctgctcaaaagtaaagtctcacttttcctttttccaacagcattttgagtgtttttcaatataatcattttatttatgtgcatcccccttatgatactgttagaatcctgatattggcaaatatatctcaattttttttctattcctgatagtaacttacataggacttatcaaatagagttgactagactataaatgagcaatttaattcaaaacacaacatagtttgattagaggcctactgttttccaggaaggtgtcattctagagactctggaggagattttagcatttagctctcaaggcacagctaaagttctctatgagctgaggttgctggtatctacctcaaactcaggtcaacctatattttcccaacagcagtgttactgatatttaaagtgtgaaaaatggccatcattggagatcattcgatacactgcaagatatctggcattcgtggacccaggtctgctaaattcaataccaaatctggcgcactgtgacagccaaaaattggcaccacatatgttcagctgcctcctataggaagacacagtagaaggccagtaagtctttaccatgttttagtttcttataaagagattgtggaatgtgtacaccatggaaactgtgtctagggaagagagaagtaagaaaagggaaataggagagatttggttaggttatttctatgagcactaataacattctggatatcagagcaatggcagcaattacacagatgaaagttgtggctaccttcacagctcctactcagcattctctatgctagcagtggggaattatgaagagctaactcatgactatacaggacaatggcataaacagatacacaatgagctctcagacagtttataattttacctaaagaacccagcccttattctctagcttcatgcagtgtttgctcttggttgtatcgctttccacttcatgaaagcagagataataaaaaagaggcagaagtgggacagacaaagagacctcctacacacacacacacacacacacacacacacacacatgcacacacacacacacacacacagtatcaggaataatatgggagactcctgttgtgttggctgtaaaaacccgctagcttctgtggtgtgattcatcagaacaactaaaaaatgtcagctttctcagagctagcagcagaagcataccaaactttaaataaaggatgacaggaggtgacagcacaaagagattcaataggaactataaaaattattccctaatttctacccagagcttaaccctagtttaaaatgtttcactgggtcaaagacatttcattgtctaggcaataataaacagtccctatcatgacaggaagtttaaaggtctcccttcttgcttttttctcccttgatcccctatccccaaccacaatcacctttctactttttcacctccggctttttattggatccttgctctatttatctagatttatttggcttcagtcaagccattttatgcctctttattccttttgcatagcataaaaataaataaggcaaggagaaatagccccgtcctgcttaaaggccctcattccttcttttttcaaagccttaacaaatcatcaatgagctcggactaaaggtgaattctgtgttctgagacaagagatggaaatggcaggatattaaaacacaactgcagataacagtcagaacctgcctatatcccgagtgctcagaaaagagactgctccttaaagaaatccttgacagaagccattattaagtcagcaaatccctgctaatggaaaagggaccacttacagtggagtgtcaggcagatagacactcacatggcacaggtcagcactgtatagggaaagcagtcacattcttcatctgtaaacaaactgccaagaaagactttattaaaaaaaaaaattctgggccgagtgcggtggctcagcctgtaatcccagcattttgtgaggccaaggcaggtggatcacctgaggtcaggagttcaagaccagcctggccaacatggtgaaacaccatctttactaaacatacaagaattagctgggcatggtggcgcatatctgtaatcccaactacttgcgaggctaaggcaggagaattgcttgaacccaggaggcggaagttgcagtgagccgagatcgcgccactgcactccagcctggcaacagagcaagactccatatcaaaaaacatttaaataaaaataaataaaataaaatagtaaataagaaatagacaaccaaaaaatcccaaccctcaaagtgcttactccctagtggagaaacataaggtctaattatgtccctcctttgctctaaaacccttcactgtatccctactgatgaaattaagaacaaagtcttgatcattgtgttcaaagcctcatataatctacttctgtatttactaaaccactaataagacaccttaatgggtcttttctattctctgcaatatgattacaactcaagaactctgctagtataaatacctctcttttcatttcttgtctcttacttttcttgttatggactccttccttccttccttctttcttttctttcttttctttctctttctttctttccaaatgttttgttctgttgcccaggctagagtgcagtagtgccatctcggctcactgcaacctatgcctcctgggttcaagtgattctcctgccttagcctcctgagtagctgggattacaggtgcctaccaccatgcctggcttatttttttttttgtacttttagtagaggtgggttttcaccatgtcagccaggctggtcttgaactcctgacctcaggtgatcctcctgccttggcctcccagtgctgggattacaggcataagccactgcacctggcctggttatggacctctttcaaggtataactcagttactaaattttacatagagcctttgttgatcttctcatttgcaattaattactctcttccatgatactttcttatagttcttatacttcttttataacacttggtttaataaataggtcaacatagtcaacaaatctttatcatctactatatgcgggacaccatgctaagaactagtcgctgcctttcaggtgcacaaatctagtgatagacataaacacagtagtttatagaggtacctaggataacacatggattgatgagagcagcactctcaataatgatgaaggaagcattcttgagtaggtaacaattgagtattacaggatatataaaagtcagccaggtgaagagaagagaaaaagcttatcagggacaggtatagcctgagcaaaggtaaaggtccttaaagattatttggttattagtaaaagtgttaggagaggcctgatcctggaggtctttgctatgccaagaaatgagcttaaccctatagacaactgggagtcatagaagttaagaaaatgaatgatacaatcagtccattatatcaaaccggctgtggagtctgcacaatggatttgaggagatgacaagcagaaatagaagcattaaatggtcacagtaatagtccacagagagatgaacagtgttgaaactaatgcaatggcagtcaggataaagaaaaaccacagacttaaggactctataatagagtaacctgggtaggaggatgactggcagatgctggcaggtgaaggaaagagaacaatctaggctgatgtcctggtttccagcagtgacagctggctagatgatggagttgtgaactgaaattgtcatttcaaggagaaagccaggtcaacacaaggatgatgatttcagcctgggaactgctgaagggctcataaagagctcatttcattagtatttgtcctatgcttaattacttacctgaatgtgtctttctcactagatggtatgatccttgaaatataaaaatatcttacatatattttgtccctcaaaggatctagcacagtgctttgcacatagtaggggctcaacagttatttgttaaataaatagagaaatagaagactggataaggttttggcagatcccattacgtttctgggccttaatttccaaacccataaaatgaatatttgtcctaaattgtttctatattcctttctaactttaaaattctatgaaagggccatgttctctaaaaggaagaattgtagaataatatgttacttttattgcacaatttcttgcataaacagccattgaaaatatgtcaaaacatgtgtgtgtaatacgaagctgaaaataaaaggagacgtttgaaataggaaggccatgatgctcaccctataaattatgaagcctcaaacactaagagatgaggtttaaagcaaataaaaatttatctaattcatagtcaaatgaaaatcagtgcagaggagccctgtgtggaattcaaacagcaggaaaatgttttttgttgttgtttttgttgttgttattgttatgttttatttttgttttgtaagtgtgtgccattttattcaaccttttaaaatgatgcattttccttttaatggtaaaagatgaaatatgatacccttaaacttagttcttctctaaagaaattgcttgaaaaatagtttatgcttagcacatagcacaggcacagattctagtctacatttttcaggcatgaaagacacacaaacagacaagtataagaaagaaaaatgaaatctctccttctagaataccactgtactgaatggcgtatcaggaagacacctgatggggcatgctaaatgatctgtcagaaataaggtctataatgtgaaaatacaactaaaacaagccaaaaattaactctgagttttgaaatgaggtttttaaaaattaaccatataagaatagaatgatttagctaacagaggaagtaggatgaagactacaaatgtcttgaacttttgtattgtttgggaaagtaagatgccatccccatgtagatgcctgctggggtatgtctggaagtcagtgagagggaaacaacattgtgtcaaatgtctaccacatataataagtactttacacgtactgtctcaactgctgttcacaataactctacacacatttgtatgtgaagacactgaggttcagtaaatttaaatgtcctgcctctggaggacacacagtaaattgtgtgtcaggtagaactgtgtcccatctcagacttaagccaccataccatgacaacttgaagccactgtaacttaaactcaatatatctgttatgtaagctttataaaagtatttataaaatataatgagcagaatataagtttgtggagccagttgaaattgtattctaatcagctccatcacctgacagctttatgtctttgaacaagtgacttaatcctcaaagtcttagtttctttgcccataaagtggagataatataaaatctatattacaaagttgttataaggaataaaaggataaagggtatacaaagctggcaaataggaagggttcaagaaatgttagcagttattattagacatatcattggtgttaccaatgtcacacttgggtttcttgaactaaaccaactggctgatttccctgtgctttttcaaacaccagccttgtcctggaatgcccccatctcttcttgttcaacaggaaaattcttaattcataatctgagactcagctcaattgtctcattctctgtatcaccttttctgaccctcctcaattttgctataaaaatttaaagttacaaatcatctcatttgttctttcattaatctcttcatatatttccactatatctgtgagacttttgttatcttttatttatactctgcctcatcttctacactgacacttcttaaatctgtcatttgtatctactataacacctgaaactcaattaatggatgtgggtaaaatgaataaatgaagaattgttaaccatacttctaataagtaatattcaagctatattattaatacattgagtgtttgtatttttaacaaaaataatatctatcctattagttattaaatattttattaaatcagtgtttttattcaaagactgctgttattattacctataagtagtacaatataaacttggtatgaggataaaaatctaacctgtgaatcagaaaatggggtttctaaaataagctctctggttgaccttaactaggatgaatcacctctcttgtcctgtctcaaatgtccttagcatgcataaaaggaggccattacactaaatgatctttagggttcctctgaactctaacagtgtgtggcattagagttctctgttggtatctagtctagtaaataactaattaagtactgagaacactacactccagcttgttgcctgtgttctcagaccagagatactcacgccagaatacagaattttaaccgatattcaccaaacatgaaataaacattcatgggtttgcactacaaaaagaaaatcaaatcatttttctgaagatgttactcacaggtatcaatataaactatgactttgtcttttaaaggtgtttccatgaagagtcaatcatatatctgaaatatagatatctaggccaaagttcataaatccttcaatatcaattaatgattaaattgcacattatgtctttactgatattttaattccaaaacttttttactgagtcaccatcagaggatctggagtaagatctgactcattctagaaatccttttggttttgtgatgcctgacccagcagccagctttagaaaagtgcctacccctgaagaaagcagctgtgatgctaatataaaagcgtctgtacgaacgtggagaaatgcaatattttatgctgtcgattacactgtgagctcctgtgagctcatatggcaacgactttgtctacaatattcagaaccactaccagagtctaataagcaatgacatagcattacacacatagaccaaataaattattttcccgcttttaaatagaatcaccattttctggcaatttttctgtctccaccatgtttttggagatagagaatcagaaaaccactgatcttgtaaaaattttattgtctgccattcctccagtttcttaagtctaattcctactctgtttcccaagccaggttttcatagtttaataatactcagtatgtcaaacttcagccaacagtgggttttatggcgtttgaataatagactgtcaaagtatttccatagcctttacatatggctatggaaagtctatgaaacttagaacagatagacttccacgattctggttattgttttcactttcacagtgaactgtaatctgtgtcttgcagacatgtttatttttaacaccataaaataagaatacaatggatgtattctttgctgattaacataaatattttctatcatttctttcctaaattagcactttcaaggttcataacgtgaagagtttcatattctaaagcatgtgagaaagttaaattaaagcctccactttaaagaaacttggcatataaaaatttttccttcaagataaattagtaggtaataattttctttacaataggatgcataaatatattcttttatagcagtcctcttagcctattgaaaatattatttgttatgaaacttgatttgtgcagacatcttaaatttttaaaaatctcataaacaggatctaacttatatactgtcagaagaaatacagatctatatggcattacttgagaggtaccagtggcttctactcaaagatagtctctcccttttttcttccattgccagattctaatatttgaaaatctccatctaatatttgaaaatttccattcttctttatttcattaaaaaactttagctttaactaaatacatatagggcattcctcatttctgtgccagaccaagataatgattttcaaaagaaataatcaaaaaccactacttggctctgaataaaacctcacatccataataaaggtataaaggtcaaaacatgtggagattagggaaggtttattggagaggatttatataaagaatctggaattcccattctcctccctactttctcactccatagtctagaaagagacacttcaatggaacatttaaaagcaaagtccctggcagctgagattcagtggacacttgtgaactctctcccaagaaatctaactagtgaaaggaggtcggctacttgctgatgaataagcagaaaaagatgtgaatgaattccaacatttgagcatttttcatggtccagatatgggccttatgctaaagacagctggtctggggtcaccttgtttttttgtttgtttgttttgtccaaggctattgcctagatcagtaaaatagagaaaagctacaaggagttatagaaacatctggatttcataaataagcagtcagctgcagaagaagatatcactcacattaagtgaactgcaggtcagatgcagacctccaaggaaccctcaaaatcacctgtgacatcaacttgattgggttaaaagatacctaggtaactggtaaaacattatttctgggtatttctgaagctgttttcagaataaaattcgcatctggataagtagacccagtaaagaacaaaatgcctccaccaaggtgaacaggcatcatctaatctgttgaggggctgggtagaacaaaaagacagaggaaggacaattttgctctctcttctccagctgtgacatgcatcttctcctgccctcagagctctcctggttcgcaggctttcagacatcaggacttatgccagcaccctccctcaccccttaaccttgtactaagcctttggccttggactgggagttacaccattggctcccctggttctctggccctcagatggggactgaattataccattggcttcccaagttctccagcttgcacacagcagatcatgatacttcctcacctttataatcacataagccaattcccataataaatctcctcttatatatgtatcctattcgttctgtttatctgtagaatcctggctaatattttatctgtgccagattttttccatttgcccctttggatccactcatcaccttttttcaccacactctcttcccccaacccccagatatcacaaaaattgttccatgttttcaggtgagcttgtgcaaagcaagggataggcagggaggaggagagtagggttgaaagatttattttcttgttgccattccaggtagttgctgtaagttggttgtgtctgtctactgaagaccacaactcctggcagaagtcttcttcctacagccaccctgtcttgttctatgacccactccctccccttgatcctacaggcctgggagtgggcagagctccctgtagttgcaggcctagggtcttgctctatcccttattgagtccctcaagccttgttcatagctatataaataggccctttaatatactctcctcaaattaccagcttggggcactgtttttttttctcttgctgggaccctaactgatacagcaagtttatgggaaaagtcagccttcagaaacctgagagctagaaataacttttatgttcccttcagctctccttcctcctcttgcttctaccccagaaaaggggagaacaataataaaaagcaattaagttctctttcaactgctggtttcctacctacaataggtctaagctgtggaaaatcagcccaattgaaatcaaggtataagttttgacagttatattctagttattgattagaagagagggactggcacaaaagactgaaggtaactagaaaagtttggccattgattgacttttcagccagggtgaagggaataatttacccaactgtataaaatcaatgagacaagaaacaaaaatataataacttcattttacctgttttttaaacatcttagttattttagttttaaattccaaaagctaccttggaaacatcccacatatgaaatatgcattattgggggaaaatacagtagaaagaagagagtttgttaagaaatatgtagaatattgaccattcttagagggcaggcctgacagtggtgttcaagtcagttaagtggaaagaagggcatgaaaaggaggacaacctaagggcaaagtccaactctacagcgctgtctcagacttactcagagccctgatcacaggatgatgcaaatttaaaattcacaatgcaacttcaaagaaaatccttctctattcaaagtgatattcctaagactaattccaagtacatctttctaagttccttttttcctgcaaaatactgatgtggagaaaaaattaaaacctctacttagtgagtcagaggagaggcgattcctactcctaacttttccacttcctagatgtgtgaacttaagcaaatcacacagtttctgtgggtctcagtttcctcttctgtaagatggcgtgtagaaacagatgtgttgatgtctcgatcagatctgatcactatgtactaaatgttactattggtggtgttcattgcctctcggtggtatttccctacaggaaagagcatttttattttactctataagagaaaatattattagagtaataccccctggttcgctggtctgtctgggtagcacaacttacttagggggtgaggttggacagaagttggagacgacttattcacagctttatctctattgggcttttctctttctccttctgcctctgtctctccttcctctccgggaagtgctaaataagttgtctttaatgtagggaggaaggagtagcaagcccctttatgaccaagacctatccccttgtctagttttgttagttctagttcctgtagttcgaaggggaggaggggcaagtgacaagccacaactaacgcacagaagtcggtagaaattggtagcaaaagatattcttgttttcatttcaaccagcaagatttaaaatgaagtatcattctggttacaggacttataatagatacatgtttcaccacatccttgcaaaaatgcagatttagtgagtgattcttctacaatcaatgtgcagagatttctaaagtaattcagtaaactgtaattaatgttattgaacagagcctggagaacacccatgtatctgagagacagaactaaatactgtctatgcaaaaagaatctataaaataaccatttgaaacacacttatgtatccaaagctgttactaccactattttaccatgttttcaataaatatatatgctattcttcatcttaggtttacaagtcaaactaggaaacatctatgtttcattattaattagcactgaacaaaactcagtaaatttcacttaatcaatgatatcatctagtttgattcagaggggttcagaatcttaagtgttagacttttatttctttaatgaccaccaccctccttcccaagggtcaacgttccccctcactgagtgggtgcaaactgacatacccatcagaaaagatgggcatttggagagccataaactaagcctctctgagcagggtgatttggacagggtgctatatatcagttccaggcgccagggaggactgatacagcagcacaaagctcccgatgaagcacagcccagttgcaggagattgctgtgatgataatcgccagaacaaaccataaattctggactcagaattaggaatggcctgtaaacatcaaataatgggtgtctaaattgaaaatgaaactatttgttgcctgtaatatttcttgcagtgtggctcagagagccagtaacattcgagacaagcgtgatctttttcaatgtctgttgttagaaagctgaggatattaactcctccttccatcaaccccagggaaacagagctaaatgaactagctagaaatcatgggacataaaatatagatttaacattatgcagcaagaacattacaggttaaaaaaaaaagaacagagaaatacaagtactgcattgaagaaccatactggcgagcactgaaggaacaggctcaaatagtttactcagggccctttcacactcactcatatacattataaaatgaaacttgactttcttgcatctggtttaagggggtgccagtcaacctggtgagaatctagattatacaaccacagacatgacatttggggatccataataattgcagattgggagataggtacttgatggattttttaaggcactttattaaataggaagaatcgtgtctaataagcacagttttaatttagtaagatcttttgttataataacaagtgcattgttacaagtgttacaagtacatgaacaaatatttttctcctgccattttataaataaaacatatttttgctctatttatctgcttactaaaccttttttttgtttatttgtttgttttgttgttgttttttaagtctcactcttctcgctgaggctggagtgcagtggtgcgatctcggctcactgcaacctctgcctcctgggttcaagtgcttctcctgacagcctcccgagtagctgggattacaggcatgcatcaccacgcccggctaatttttgtatttttgttagagacagggtttcaccatgttggccaggctggtcttgaactcctgaccacagataatccacccgcctcagcctcccaaagtgctgggattacaggtgtgagccactgtgcgcggccacctttgttcttatcaaaagaaatgaaagccaagatgcatagattaatgacatctaaattcacgaaaatttaccaaattcatgaaattactgttactcctgctaaatcaatgtacacatatactccatttgaccaagatctttttttatatataataacttgtggaagaacagaagatattgattcttgtgggttctaggtactgtaattaatagaatattttccatgtgagtataggcggatattgtgtatgaagtagttaaatagtaatgtgacgtggggatagtgatattcaaaatgtttaacaaacagaagtgcagaagtgcctgagcaccagcactcccctgcatggacaaggggcatttgggagctaagggcagcaagataggatctatttgagtatcatccatagaaaagtatgtatttaagaaatcagtgttcaggtagggcaggatactgaatgttagctcagcagtactctcgctgagcaattgctgatggaggagtgaagggaaaatatattaaaaatgacacagaggacatgcaaggcataacggggtgctctttataaacattgtgcctcaattaagaggtgtctcaatgaaaagaaaattccctatctccaggactatgactctatagactaaaaatactcaagttaaagaaagctaacagataaaaatattatttctggctgggtgtggtggctcatgattgtaatgccagcactttggggtgcccaggcgggtggatcgcctgaggtcaggagttcaagaccagcctggtcaacatggtgaaaccctgtctctactaaaaaatacaaaaattaccaggcgtggtggtgcacatctgtaatcccagctactcgggagactgaggaaggagaatcgcttgaggcagaggttgcagtgagccgagataacagtgagccgagattgcaccactgcactccagtctgggcgacagaacaagactctgtctcaaaaaaaccgtttctcaattaacaagtaaaggtgtagccaatatgttgcagagaatatgagagacaaaggctaaagagtatcaataatataaacaacaataatatcaaatgttaatggtttacttataatgtgccaaggcctggactaagtagtctataaacatcattttactgaatgctttcaatggccccattaattactggtaattatatttttgtggtatgccataactaatcttattatatgagtatattattctcatcttaggatacagtattggtcattccaaccacatattttaatcgtcttaacagaatttggaccaaagaatatcttcatgtccaaaccaaactcatgaccttcccaccaaaacgtggatcccctcactgtcagccgtgaagtgccataagcccaaaatctagaagttgcccagactcctgcttatccctccaattgtacatcaaaacctcttatttacttctagaatccattcacttttacctttaccatcgccattacctcaattctttattgcttaaattaatctcattattccctaattggcctacctgttactttttaccctcccagtgttcaagttaatgtcctagcccccactctacagccagtgtgatcttaaaataaacaaataaacaattagaatttctctttgtgtgatacccatttgtttaaaatccctctgtttacaatatgctcctctgtttaaaactccatttaaaaccccttaacgggttccctttgaaggattttaaacagggagtcaaatccttaacacatcctaaagctcctgtatgatctggcctctgcctaaccatctctccagctccatctcaagccacctcttctctttactctttgtgttccaaccattatggctttccagatagttaaacatgtcattcccttcttctccacagggctctggtcatactgatccctcaatttggaattattttcccattctttacctcctatattcttatcctggttatttcctactcattcttccaatctcaattccaatgccacttctgccagaaagccttcccaaactcagcacttacaaatgcttaacacagcttgtaatgataaactcattttttgtaattaattgattaatgcatctctcccccaatagatatgaaaatactagcagggaagaggaataaatctgcttttattcactgctctcctcacccccagcatgtggcatatgccagacactcagaagccttcataattaagtactgaatcagttagtgaattaattacttgtttttataagaatactgaggatttttagataggcctccttacaatcaaggttttctcatcagagttagcagtagtttgtgaaagatactgtcttatcaaagctcatttctatatcgttgggttatatactatacttatgcactataatccgtatacatataacttgtacaactgcaaagtgtataatatttcactgaaaagatataacatcatatgaggaaaaacaccacttctatagaactattttgtaaaataatttttaaagactcataaattataagtcatgatgacacatttacctacagaaaatatttcatcatttgcatgaatagctttaatatgccacatgctgatttaaaatatcttactctctaaaaaaatataacctcctttaacatttaccttgtaaaagaatcattttttttctgaaaatgggtaatctacatttggtcctgtcttgaggttagaaaagacatttgaagttaacaattatttgtaagaacaactatcgtcatgatgtctactaatattcctcgtatttcattattttccatttgtgattcagcatcaataattcagataaagcatattttttaagtgtcctagagtattatttctcaaatcttaatttgcataagaatctcctagaagagcttgttaaaatgtagattctaattatttatgtctaggtggggcctaaaattctctatcacccacaagctcccaggtggtactcacacagcaggtacacagaccacagtttgagtagcaaggatgtagagtaagtggaatactccaatctaaatccaacactgttcagatacccagcattttctgttcttttgcttttggctttgagttctggcacacaactctatacaatccacttaatgttgtgaatgccaagaatcaaaagtcaattaccacttggcaacatgtacaaactttctgtttttaaaatatcaaaatctatgctggagtagtagctgtaatattaggcaaaatcagagatgatattatcaggagtaattatagtattctaaaacaaacttctaaagattgcctcatcacctaggtctggacagaagtttgattaaaagccactctatttaggtaatcatcttctctagaagtttacagagatgttgaagtgttttcaattatggctttttattggccagtaaagtatgggagacaaaaaaatcttaataaatatgtacagaaatcactttgttttataaatgttgaaactaagtcagaaacttaccaaaattaaatagctaggtaatgatagggctatgagaattaggtttgtaatctatttgtgttggatgtccaatggtaatccacaggtgtaatgaggttttggggggagtaggtttttgtttcattttcttgtttgttgttttaagacagagtcttcactctgtcacccagactggagtgcaatgatcacagctcactgcagcctcgaccttcccaggtgcaggtgatcctcccaccttagcctcctgagtagctgggactacaggtgcacatcaccacacccagaaaatttttttctattttttatagagatgggcttgtgctatgttgccaggctgatgctgaacttctgggctcaagtgatctgcccacctcggcctcccaaactgttaggattacaggcatgagccactgcaactttatatcctgaaattcctaccatgaaactggcttccaatattttttttttgcttaaagtaaacttgtctaaataatatttacctacttgtccagtatctattatacaccaggaactatgctattcctctgtataggtattttatctagtttagtagccactctgaaattgattattattatttacctttatagtcagataaattacaatgttttcataagtggtggagttcacattcattacactttactatacactatgtatttgaaatgtttataagtatttttaaacattttattgtaacttttttttaacttgagctgttattgagatgtctcttaaatagacttatgatatctgctgcattgttgtgtcagtacagtcataattctgcaactacataaagaacaattctatttattccttgtactgggatcacacccttggcctttctccatactggaattatatcagcttggttttctcattagctattagtcacaaatatagcaatacacaagcaaatttggaattttgagtcactgaattcaaactttccccctcaccttctgctgaggcttccacttaattacagactagtacgttttaatactaagcatttaagattaaattacctggccagaaatagatcctgaaaaggctggttaaagcagaactagggcatggtttagacagacacagaggcaacatgaaaagaaaattcaaaatgtaaataagccccacaaaactcgagtaagatgcttcaaatgtggggccttaaacaaccaccatcctttacataacaagttgggaaaatgtcatagataaaaatcaagtacaggaatacctcaaagatattcgggttcagttccataccaacacagtaaaagaaatactgcaataaagcaagtcacatgggttttttggtttctcaatgcatataaaagttaagtttacacaatactttagcctcttaagtatgcaacagcactctaccacactatagtctcttaagtgtgcaacagcattatatctaaaaaatgtacataccttaatttaaacatatttattgctaaaaaatgctaacagccatatgagccttcagcaagtcaaaaccttttttgctgatggagggtcttgcctcaatgttgatggctgctgactgatcagggtggtggttgctgaaggttgggtggccatagcagcttctgaatataagataactaggaagtctcctgcatcaattgactcttcctttcaagaaagagttccctgtagatatttgagagttttttactagcggtagaacatctttcagaactggagtcaatcctctcaaaccatgtgtctgctttaccaatcagtgttgtaagacattctaaatccttttttgtcatttccacagtgttcaaagcatctccaccaggactcgattgcatctcacaaaacaattcctttgttcattcatgagaagcaactcctcatctgtcaaagttttatcctaagattgttataattcagtcacatcttcaggctctacttctaattctagttttcttgctatttccaccacatcctcagttactttcaccattgaagtcttgaagcccttgaactcatccatgaggtttggaatcaacttcttccaaatgcctaatataatgttgatattttgacctcctctcatgaatcatgaatgttcttaatggcatctaaaatagtgaatccattccagaaagttttcaattaactttgcccagatgaccagagttattatccatggtagttatagccttatgaaatatatttattaaatagtaagacttgaaattcaaaattactccttgatccatgggttacagaatggatgttgtgttaccaggcatgaaaacaacattcatcaccttgtaaatctctaacagagttcttgggtgactagatgctttgttaacagtaataatttgaaaaggaatccttttctgagcttcaggtgtcaatagtgagcttaaaatgttcagtaaacggcaacataaacacatttgctgtcatctaggctttgttgttccatttacagaatacaggcagagtaggcttagcataattcttcagggccctaggatttttggaatggtaaacgagcactggtttcaacttaaagtcaccagctgctctagccaccaacaacagagtgagcttgtcctttgaagatttgaagccaggcattgactactcctctttagctatgaaagtcctagaaggcgtcttcttccatgagactattttgtctacattgaaaatatgttgttaagtgtaactacttcatcaacgatcttagctattatcttctggataacttgctgcaccttctacattagcacttgctgcttcacctggcattttcatgttatgaagctggcttctttccttagacctcatgaaccaacttttgctaccttccaacttttcttccgcagcatcctcacatttctcagctttcataaaatcagacagttagggccttgcagtagattaggctttagcttatgggaatgttgtggctggtttgatcttttagccagacctctaaaactgtcctcatatcagcaataaggttgttttgctttctcatcattcatgtgttcactggagcagaactggaagagttcctacaagaacatttcctttgcatgcacaacttggctaactggtgaaaaaggcctagcgtttggcctgtcttggcttttgatatgttatccccactaagcttcatcatttctagcttttgatttaaagaaacagatgttttactcctcctttcacttgaacacttaaaggccactgcatggttattaattgacctaatttcagtatttctgtgtctcagggaacagcaagcctccaggagaaggacagagattggggaacaccagttggaagagcagtcagaatacacacccttatcaattaatttacccatcttatatgggtgcagtttgtggccccctaagacaataacaatagtaaaataaaagatcgctgatcacagaccactgtaacagatataaaaataatttaaaaatttaaaatattaaaagaattaccaaaatatgaaacagaggcatgaaacgagtttatgctgttggaaaaaatagtacttgcctgaagcaggatttccacaaaccttcgatttgtaaaaaccaccatatctccaaagtgcaataaagtgaaactcaatataagctcaaaataaattatgcctgtatgaatgcaaatctaaaagagagcagtcagaaagaccaagtaggtattaacaaataatgaataaatcaataagtgaatatatgaaataaacctcagctgtgtccaaaagcacaaaagcttctgaaattataagccatgtaacaaactaaaactgatctcagcaagatgatctagtgatcactccagcggaatatcaatgctttagcctagtacacacatgttctgagctgtgaaggtttttcatgattattatttttatccttcgtaattatctttcagtttatatttctagccttgaaacacataagttattctttgcatttagagcctattaacacaatttcaagaagaaaactacaataagcagggcttgtaaatttgttttttttttcctactgaaaagcaaagagaagtcgatttgttgacaacaaaagtgcctcaagtgattatgttttctttatttattctcagtgtttattcccaattcctcagtcccaactaaaggtctactacagagagtacatatttcttaaatctggaaaataatttaaatacatcaactaacacttgcatggtgcaaaataccttcagctagttgatgccaatgtggtacttaaactatggttcccaggatggcaatcctacatttccaccacactagcagccccacaagatagagttcactgcctcaatgagttcaaaagtaagaaaaaaaaaaaaaaaacccacatttaaatactaacactattgtgcatgaataaatggcaaaacaaaggaaactaagtgctttccaatggtttaaccaagaaccattcaatgtccctttttctgttcctccttaataactttttccctaggtgaaggttgaaaagaacagtgccattatgacttcgaatttggtgcaaagccagtaacacatattgatactgtcagtagctgtgcacgtgattttgctgtttttaaaggagagctacattttaaaaaccgaggttggagcttgctctctctaaagtgtctgtgattgtccttgccctagacctcaggttacttatttcatctctatttgaagagacagaggcagggttgttcctcagtcaatttttttttcagtctacaaatcaagttaagctcaaaattaacataacaattatttgggcatgtaaaatatgatgaattcctatttcctatctcatttaacattccttccaatttcataatgtcaataaaccagggactaaagcccttgtaaattattataaatttctccatatatgcatccagattggcctttgacaatatcttaccacaaggagactattttcattatacactctatctactttcttcatgatatgtcttacaattagctcagcagagctatccacttacaggttggaactttaaaaaattgctcaagtctccatgaattaaatgaagatttagatgaaattcaatgaagatcaaaagcttagaagtgccaaatctcatttagctaacacatattattcagtctcctctaagtgtttactaaaatacccatggaaacatattttaagttgaaaattgataacaatattattactaatatttataacaatatcttgcagttaatatatttagaactattaacctgtttagatttattaactattaataggataaggatagcttaaaaaaagttaattgatttaaagtttctgtaaagaaagatactaggcaaattatagcacaggtggtgtttaaaggtggaaaaaaattgtgaaaatggtgtaaaagtgatggaagtttgggaaactctggagtttattgccaatgccactattttagttaggtaaatggctgtataactcaattcagatcaatcttagttctttcgacatctaattggaaactccaaatcccagaaaaaaaaaatgggtagaaaagagaagaacttggaaatagtgcattgaattctaggagttgaggtgcatacaggtaaactttgattagtgaagtgatgaaaaaatgattctagtatcagtatatagtgagtattggagtcttttcaccatgtacgttacctgttcaagtctccaaggtagaggtaaaaagtaacatttcagtcctattgagatatatgagataaaagacatatgagataaaaacctgctagacaactacaatttttctataaaccttatgcatcaatctgtcatcatctatagaactgaagggtgattcggccagcatacaagtaaagagagtataattcaaagtaatatatatgtactgtttcttggtaaacaccaaactatgagagagctttctttgcatgtagagtaaaaaggaaaagaaaaaaccacatggcttaaaaattacaaatgggacctaacccaagctttgacagaatcaaaatgatctgccagtgacttaattcactgtcagaacaaacctcaacactcctgaaatgaaattaaaacaatcaagagcttctacaatatatgatccactgtgaatagcttacaataaaaaataaatagtcatgtaaaggagtataaaagtgtgactaataaaaactaaaatagacaatacatataggcccagacattttctaaataatgaagttaacggacaaggacttcaaaagagctgtaattaatatttcaataaaaatgagtaatagagagacaaaatgtatgaaaacatacagtatttccacagaaaattagaattaatcatttatgagatagatattttaaaactgaaaaatagaatatctgaagttaagaacttattattggacagaactaacagtactggacatagaagaatacaaaattagtaaatctgaagaaaagtcaatgaaaaatatttaaactgaagcattgtggtgaggagagggaagaaggtagagacaagcattagagaaatgtgggacacggtcaaaacatttaacacaagtttaataagaatcccaaaaggagagtgtagagaaaatgaaactgaaagcaatatttgaagaaataatggctgataattttccacacccgaagaaaggaaaaagcacacagattcaaaaatctcagtgagccccaactaggataaattcaaaggaaacagaactaagaacattctagtgcaattattctaaagcagtgataaagataaaatcttaaaagcagccagagaaaaagacaattacctttatggaaataataacataaatgttgaacacctttaaagtacttaaagaaaaaaaaaatcctgccaaccaagaattcaatggccagagaaaatacctttcaaaaataagagaaaaagtcattctaagataaaagttcagagaattagttctagatatcacacattatagaaaatactaaagaaaggtctttaagtaaggttgaatcatcagtgtttttgatggtatacagcacaatttggatacaaaaacacatgtacaaatcaaaaagacatttagaagaattagattgaatataaatcattctagtaataatttaacccatgtactctgcttatattttcctctttgttatatatactacactaataaatgataacacaatatgttcaattactcaaaagaactcttttgataaattaatatcaaaagcctaagtgattagaagatgcttatttggcagtgttttattttctttcttagtggtatttcagttaatgatctagtttatccatggaattataggttttataaaatacagcaatactttaaaaatcaaggcagcagaattgaaaaattcaataacacttctttagataaaaaacaatgaaacaggcaaatatttgagacacttatctatgaaaaaaatacataaacaaaataaggcaaaagaaactgatgagataaataaaatatagaaattttcaaatattcctaataaatttgaaggtattgaaatttaaaaatgtctacaagaatataacacaattttctcattaaaaagtagataacaatcaggaaactacaactatataggaactatataaagacatgaataaagagattttgaagttacccccattaagtccttcataactttaatcctacgtagatttatacattgtcttacaagtatttttatttgctgaaacaaataaaaatggaaaagcttccccattcatcctacttgctagcataagcctattcaagaaaacttgacaaaaatggcaccaacacaacaacaaaagatatcgtaagtcttatttatgaaaacagatgaaaaacattcctaaacaaaatataatttttcacatacaaaaaaaaattccagacttaactggctccactagttaattctatccaaaatttaaagaagtcatactaatcttatgcaaaatctctgaaaaaatatagaaaggagcactaagttgttctccacacctctattcaataataagctggaggtcttagtcaatccaatgaggcaaggcaaaaatattagggggaaataaatataaagtacaaagaaaaaatgtctcacacatcgtgatttacagacaacaaaataaaatcacgtgaaattaatcatcaaagtattataactagtaagttagccagatcacaggctacaagttcaacaataaattatatttttatataataaaaataagcaaacggataatggaatttacagacaacaaagtaaaatcatgtgaaattaatcttcaaaatattataactagtaagtttagccagatcataggctgcaaggtcaacattaaattatatttttatacaacaccaataagcaaatggataattgaatttaaacataatgctatttgaaacagcatcaaaagttataaaatacacaaaggtaaatgtaataaaaagtttaaaactttactctgaaaactatgaaatatttttgagacaaagtaaagcagtcaaataaatagatccctatgccctatgcatgtattgaaaatgtaaatattgttacgttttccaatctgccaagattactcaatggattcattacaatcacaattaaaatccagcaggcttttatttcagaaattgacaagccaattctaattttatgtggaaatgcaaagaatctaggatggacaaaagaatctcaaaagagaataaagtgaaagaataatagaacctgatttcaagacttcctataaaactacagtaattaagaaaatttcctattagcaaaagtataaataagtacatcaatgaaagagaagataatccagaaagagattcatatttacatggttaataaatatttacaaagccttcagagaaattaataggaaaaaataagtcttcaatatgtggtgctagaaaaactagataaccatattttttaaatgaacctcagtccctttttaataccacaaacaaaaattagtttaaaactgtccataactgtaacacctaggagcaaagagcttcttgaagaaaacataacatgtttacagtattggagagggcaaagattttttggatatgataaagaactacttaaaaatgacaaattaaattacttatagaaagataagaatatgaataagcatgacacaaattgagaaatattattcacaatgcatatatctaacaatggacttgtaagcagaatatataacttactctttcaacacattaataggacaaataaaaaccataaaaagaagatatgcaaatgaccaataaacacatgaaaaattactcaacatcaaatatcattacagaactgaataccatctcaacacccactagaatggctaaaattaaaaagactgaccgtaccaaatgttggcaaggatgtggaacaatttggaactctcttacattgctggtgggagtgttagatggtaccacgtctttgaaaaaagatttgtcaattcttacaggaataaatacatgtgtatagccagataattctacccagcatgtgtccaagaatattaaaatatatatcaaaaagaattgtacaaaaatattcatagccatctgaatcataatagccccaaaccgaaaaaaaaaaaccctcaaatgcccttcagcatgagaatggatacatttgctgtatattcattcaaaacaatactagccaattattaaaatgttccaacgattgatatagccacgaatgtggaggaatttaaaatctttttctcaatgagagaagacttacacatctagataaatctctaaatgggtaaaactgatttatgttcaaagaaatctgaaccttgatcatctgaggggttgtggtgtataagatttgactgtaagggggccccagtgaacttaatggtatatcggaaatattcatttttttttagaaatatgagttacacccatgtacatatttttcaaaacacatcaaactgtaacatttaagatctctgcatttaatttaaacatatttcaatttcaaaaatgcaaaggtgttgcatcgtttttatcttcttacaatagataatttactttttattttcaggcagggcaattattaatccatttggtttggttctggatttgtgtctcttttcctacctctaactctcatattttacaatccgccgtcatcaactacttacaattccccaaacttacattagcacatgaattctgtttgcttggaatgtccttttcctctttctccacctacacaactctcacttcgaatttctgagactctgcagagacctcacttcctttccaaagtccttccttctctcaggcaaagttaatacctcccacctctgttcaattctgcactgcataccagcatttatcactacacattgtatattttgagagtttatttgcatgtctctcaccatatatagtccttaagggtacagaccatagctacagatcctataaagcaacaataacaacatgaaccatttattgaatagacacttattgcaggcagagacaagcaccttgcataaatatctcatttaattttcaccataatccccattttacagatgagcaactgaagcatagagaagtttattgcccatcaataatcacaaagctagtgtactgaataaagttaattttaagcttttaattttcagctctttctgattccaaaatccattctcttaatcactaagtaggattaactacctcttaaatcttccatttaaaaacaaaataggcatgaataatgattgcatttaacttgccaacaattttttgccttcattatgacactgatatacaaactaaagcagttacaattaaaagatgccagttgttttttttttttttaatttaagcagtggtgtgcatgtattgtttttggttttcatctgttgccactgacatttgtgaatatgatcagacaaaagtgtattttttttacctctactaggtgtctagtttattgtttttccccagaatactgcctactataattggctctgtgtatgacacctatctgtctgtggttcaccccctgaaaaagaaataatatatttcaagctcttaaactggtttccagaatactgaaacttgaccaacccaaaacttgctggttttatgtttcaagcagttagtctaggttttatatattgttttattttgtttattaaatcgtttggctttgtgacattggccctggtctctccagctgccccagtgcctcattagtgaactccagcatcatccctacatccgcgcatctgtatccttgctcagtgtcacttctggaaaaactctctgttctgctttcctaatgataagaacgatacctcaaaccctctctcctgcaccccacatgtcccttatttgccttttatgtctacaatatacactttattttgccttttttctttgaacaatctctgagaagactagtgaaaagatgatccttcctttcctaaaatactagttggagaatataatggcactattttttctaaaggggtactgactagatgaacgtttattaaacacctgtaacataaaatctatattgctctccctagttattttcagacctaatcccgttgcattgtagttgtcattaaagctcaatttttagagattttatggagttagaaattggctctatttagctcctgtttagaaaagagttaacatagcaggagtgaggctccttttcttataaaggcatgtttgcaaggctggcccttgactggaacttgggagcttgaagagtaaacagtttctatattgatacaaaattttccccaattgataagagtagttcacagtgcctaaatgtttgtgcaaataatatgctttatgttgaatacctattttcctacctgacttatgtatgtgctcagcagagggtgattacatgattagctcccaatagaaactttggacttctgtgctcagccaagattccctggtgataacatttcacacgtgtcgtcacaatttgttgctggaggaattaaacatgtcctgtatgactccactgggagatgacctctggaagcttgagactggattcttctaatctttgtcactttcatcttttccctttgctgagtttgctttgtgtctctttgctataataaatcatagccgtgtgtacaactatatgctgagtcctgtgagtcctccttgcaaatcatcaaacctaggagcagtcttagggactcctgacacagctaatgttcagttttattctttaaaaaaaaaagaaaaagaatattcagttaaaaatctcatttgtttgaagactgaattaattatgtgttcatgattttttcactttctgtctctagattccatatatatacacatatatatacatatatatttatacatatatatatatattatccttcaattgtattcttgattatacaagtaaataataatggtaatttatgggggggagaaaaacataaggaaggattttctgagatgtctatttttctcagaaaattcaagctatctcttttatagattcatctgtaagctcaaattttaagaggaatcattagatccagataacagtcagaaagtacaagctgaggttctaaagagttggttcctttaaatagtcatcatcctcagcaggagataatgttttgaaagagttataatatttatttttccaggaaaagaaatgcacatctgtgtttttgtaccaggaggctgagagaatgaaatgtaacagggacagtgtgagcagctagaaaagtatttatcgatcaagttcctgtgatacaaaatgccaaggaagttttttcagctttcacatttacatttcattttctaatttgaatggattagatgatactcctctcatactattcataagggtaatttgaactatttcaaagcaataaaatggaaaattagttgggaaaaaggtcattctaatatagtaacgtaaaatgctcaatgatgaactatcaaataaatagctatttgattataagagtgctttagggaaataaagaagcaaaagagagaagggaaatttaaaaagcattaaatactgaagttagagcatgatataaataataatgtctaagcacatagtatttactgtgtgccagatattggtgtttgtgtgtgtgtgtgtgtgtgtgtgtgtgtgtatatatactcatttaataatggcaaaaatcctaagaggtagttgatatttctatcagtgccatataacaatgaggaaattgaggtttagagagataaataagagtctttaaagatcacacattgagtggcagaaccaaatccaagctttaatcactgtactatgttgtacacttaaagacgaggcatattgtagaaagatttctcaaaattgtgctaaaaattgttttggcttacttaccaaagttttattttataaggaacgaaagtgggtgaagggacccaaattgactattgtaacttttctcacaggaccaaacactgtgccaggattccatacgcagatatactcaatggaaggctaagactttcctgagaccacattctctataaatatagatggaaatatattcatcaatatagagggaaatatatccatctatatttatagagaatgtggcatatatgtgtgtgtgtgtgtgtgtgtgtgtgtgtgtgtgtgtgtgtatacatatatacacaatgtggtatgtgtatataaacatacatatatatattcggcaagtattttgtacaatcatagcttcttcgagtttatagataaacatttcaggaaattgagagagacatctatgttgatagaaaccaaaccagtaaaacacaggtaaatggatgagaggtgactgcaaaacacagagaataggatgaaagctaatcaaaatgacaaacgctaatcaatgtaggcagaaagggcaaaaagataattctcatgaatacttacaaagtatattctgaccttggaagtcttaggttggtgtttatcaatgatgaggccaaaagtttgtacctgtgtaacccagtttctctgagttttgggtgcgcactgtgaaaaattacctacttgttaactgttgtacctggagctcctgcttcaaaaaaagttcagcctcagaaataccaaaactgcttggatccagagatacctgagatgatgaattttggtgaactcccctcactactgtactaaaatctctgcacagggaggaccttattctccattttctacataagtgacgtatgttgaagcatgattggtgactgtgccagcacggcctttactccaacctcagctaaccaacccagtaaaagccctgtttccaccattgttcaaggagggactactttgggaactatccctggtgtcctcttcgtttgttgcaagtaataaaatatccttgttaaatcctccttgattgtggtcattggactgttacctgacaagcaactgaacccacccgttgtgtgggtaacacctgtacttggaaaactaatgtctaactaaattgagtaattagaccagtgtctattagctcaaaactattttccctcactatgagtgagatctctgggtctattttccaaaataaaaatttttaaaatacaaaattcagagttaaaaagttatcttccccaggcctgtttcttcctcagaaagttgaattagaaaaaaagcttgagtttttatatcatctgataagctttctcgcattttttaataagagctatataacttctttaatccactttgactcgggctatcaataaactcattttcaggagtttcccttagtctaggttttctattagtgtgatctcaccactcttgcttgcttggttctagcctcagtatgcttaatttagttattttattgtatttggagttctcatgataagccactgcaacttctcttttgaagtatattaaatataatatgtttatgaaatgaagcgcttaaactgaggataaaaaaggcaggtctcatcggcaaaaatgtaagagaatagacctagagattttattggacagtaagttcaatgtggttaagcagtgtgctgtgactgctaagaagtcaactccattttactcaagctgcatccaaagatgtatattacctacaataaagaaggatatgtccctggcaaagtagttagaccagagcataccatttagcaagtatgtcttgtaaatttaattggacaattttgtttagaccacacatggaatattgtgttcagtgagcaaaagcacactgctaaaaagatatatctgaccatactcagtgttggcaagtaggtaaagcacctgagactctgatacactgctggtgtagatacaaaatggtacatctgtaccttcgggagtggtttggcagttactcaaaaagttaaacatacagtagttccccttatctgaggttttactttccaaagattcagttactcaaggtcaacagtattctgaaaatctcaagtgaaaaatgaacaattcataagttttaaattgtgtgatgatatctcgtgccattctggtctgtcccactcaggacatgagtcattcctttgcccagcatttccacactgtatatgctaccaatccaatagttacttagcagccattttgattatcagatccattatcacagtgtctcagtgcttgtgttccaataatccttattttacttaatggccatcaaaatttggaatgacttattcgcttactggtcatttaaaattatgaaaaaatccaatgataaatataatcaaaactttaaaatgaatcttcaagtgtatatttaaattagtagaagatgttgctttattgaaaccaaattatttcttgcagcatgaatgttataccttgggctgttacagcagatggttgtcagcattggttacctccacgactatgtattatatgaagactctcagtgtcgttatcattttcttgttggaacttgcataacccttctttcttaaagcttgctgacatcatttggaaattctcaaacacttgttctctatatgaactttaaaattgttgtattatgtggtatgtgtgattgtgtttaaacaaaagcaggcaatttgactggaattattaaatacatacatctatctggcaagaaatgacatcattatgatattaagtcttcttatctaggaacatagcatttatttccagttacttaatttttattttatctattaaataatttttaaaatatcggtttacatcatttttactaaaagtattcctaggtattctatatttttattgctaatatgaacggattttttccattactaactttttactttaacgtatttttcttggatctgggatcctcacaaaatattcatttttgttcttttaacagatttgaattgtttagatttaccattgaatcacctttaagtaatggtgattaattcctttttccaatatttgcacagcttattccatttacttaagtgattcactagaaatgctgaatgatatagaatagtcacgctgatagaaagcatccttgatttgtgtcttatattaaaggatcaatcttcagtatttcttaatattatatgatggttttgattagttagacggtctttggcacatttaggaaaatgttttctattcccatttaatttatgtttttacctagaattgctgatttctttttttttttttttgagacaaagtctcgcccttgtcctccaggctggagtacaatggcatgatctcagctcactgcaacctccgcctcctgggttcaagagattctcctgactcagcctcatgagtagctgggattacaggcaactgctaccatgcccggctaatttttgtatttttagtagagacggggtttcaccatgttggccaggctggtctcaaacccctgaccccaggtgatccacctgcctcggcctctcaaagtgctgggattgaattgcagatttttagcaaatgtttttcatgtctctgtttctacaattataggattttgctctaaaattctcttttagtataatgaataatattgatacattattaattgtgaattacctatccatagaatatagcctattttaagcagaggagtgaaagttatagttccaacatctaaatataccaatatagtatgaagatgttctggcttagcagtagttctggcaagcacattagttcccccacatccctaaagccacttctttcccacattccctagctttctggaagatagcaccctccagccagctggaacactgaagtcatcttagatcactctttttctgtgaaccccacatccaatctgtccccacattctgctgattccacttcagaaacatctctcaatttcagatctcccatccattgacttattttaggttctcaatatctctatctctttgcccacagatttcttattgggtttgtggtttcccatgttgctcccacatcccctaaaataactccaacacttcagctagaaactgagtaaaatattttgttacttaaaatcttcaatgttttctcataagtaagatctgtgtaaccaatgaatgctgtagtaacagcaagtatgttagcatgccctccacattcatggtggtcttcaatgcccctctgtcattgcccatgacctccatcccatagctaatcagcctcctgcctatgtgtttctccccacaagcctcttcactagaacttgtgtccttctttccaagaaatctctcttgattcccactctcatagaatgagttactcttagactgttatattagtcatcttcctccctgtcttcatttcatctctacatcctaggtattaagcagagtatattgtaccatgtggagactcagttgggtttcagtgtatatagtggaactttagataaacgcaaattgaaattatcaatgtaggtgctgatttgcaagttaaaaactaaaggtcaaagtcaacagtaagttcacagtatactgtgcaagcactagtccatgtagtatacttgcactaaaatcaggatgtgcattttaaaagaaacagtgaaaaattagaatgattctagataaggcaaccagtgtggtgagggctctgacaacaagggcacataagattttcaagatgttccagatcctgggaggactagcaacacagctgcaggaacttagatgtttaggttagagaagagaaacaaaagagaacaattgtcttcaacacttagaggccagtggaagagaggaaaagaaatagaatcacagatcatggaatgaagagccaattctgaatctacgcaagaggaatttaaggaattttaatccatatggcagaatgcatagtaataaaatcactataattctttagcttcccctagtgggtttcgaaatggagtaaaggtagtttgaacggaagagttcttagctgtatagaattagtctggacatagcagaacatttagcgtctctggctcccactcacaaaaatccaatactagtcctaggtcattggaataaccaaaaaagccctcactcatttacaaacgctctcagttgagaaccactgaaatttataccatgtgctaggaattgtgcatgatcgctttaatacattttttaattctctcaataaccaagcaagatagaaactgtcattcccatgttaagatgaggaaattgaaactctgctactagcagacagaccttctgaatcagattgcctgtttatatctctgatagcagagcactttaagatttatcttagattaagataaccaagactctgtattaagtttctgagatactatcggtttcattcatgagtatgttcagtggccatactattcacatttgagctcctgcttcctgagatgaatttacctcttgtagcagctttactttattgagatgatctagttttatgtcccaggtgctcctggttttctttatctcactgtagtcagccttaccatgtaccaacatgggaaaattctctccttactaaaataaaacaagtagtttaagtggagaaatgaagtaacttgccaaggataataaggcaaatgaaaccggagtaaaatccatgccagtactaaattcaataatacattgaggataaagggagtcagattgtagttctgtgaaaggaaaatatctataaattatatataaacatatcttagaaagatgtcttacttttgattgctaaatagtgctcatagaaatctggtattttgttgacacaaatacaattacatggtattctgctatgacaataatgctaaatcctaattcattaagcaagagagagtgaaaggcaacataatacaatggttaaatatttatgaactggcttaggctgtataagtttgaattccagcttgacaatttattaatttcacgactttcggtatgttattcaaccttacatacctcagtttcctccttgtaaaatagagtaattgtagtatctacttcataaggtgagaattaaatacgttagtacataaaaagtgcttagaatatttttgggaacagtaaaaatattaagtattattattattaaggagcttatatttccaacttgctatctcaggaaagtccttttatttctctggcttgctttcttcatcactaacaatggtttgcatgaaaagccagtccagaaattctagatgtataactgcaaatttatcacaatttttttatctccacaatttttcactggatacatctcactgatgtaacaaaataaggatatcaatcatcagttgtacatatcctcttgaatattacataacttttgttttctctcactattttgttgaaacccaagcagcagttatttttgtctgttccttgaattagtaggttctgttaacaccttataattgttcatagttcagttttgtagctgctcacccaaagaacataaagtgcagactggctattacaaattttgtttgcttaatgagaaggggaaaggataaaatgtttgcaggtacatcatgttcagagttttggaatattcaatttgcttatcttctgagagacttgctcatgtaatatctatgttttatgtcttaatctaagacagccttctctgcaaaatccacactcaaattgctgcattttatcctgtcagctgcgtctttgggatcttgtctaataaaacatacaagtgtctttttctcctcctattcattatcactaaaagcatttcagtgtctcatttggtgaaaacaggcgtctactcaatttgtgaaatgatagggtatctatgttttaagtcatgcttgtcagccacctgattttccactagagttaggaaagtttaactcacaatgctgctttaataaatcagctcaatgaattattccattcagcataaaataatagctttgctgtaaagaagaaattcatatgtaattatttaataaattcaataaaatttttctggaaattactggtcattcgttaattaaaagttaattatgtttctattgtattccaaatactgtactgggaatgaatttttctagaaaattaataaaacatggctcctgcccttgaagggatcatagtctgatgagagagagtaaaagaattctaaaataaaaatcacctttttaaagattctaagtataaagtcggaaggggcagaatcagatttgccttagagaaagactatttgggggaagggcgtgtgtgtgtgtgagtgtgtgtgtgtgtgtgtgtgtgtgtttgaaaggagacagagacagagaaatgtgaaatgtagaggcaaaaaactcacacaagaagctctcatgtgaaatgaaggaagcctaaattacggcagtgacattggagacaaagatgtgtagtatagattgtagagctgctagaaaatatattcaataagactgaagacaaattagatggggaaaattctcaaggatgacttataaggttgctaaaccaagagactgagtggatgatggtgccattgaggcaactggatatatggggcaaaagctcaggaaaggtattggggcccggtatagaaacgtcagaggcagtaataatttagggaaagtgaaagcctctggggtgggtgacattattcccagaagaatgtttaaagtaaaggaggaaagaaaaaaaaaaaaaaaagaaacatcaatttttgagaaatttgcaagacagaggaaactagagactgagaatgaaagaatgaaaagttaataagaaccagaaatttcctttagcatttcatttaggggtcaagcctatgatgaagaatttatataaatatcattcatttaacaatattttaaaatgcaaaaagacgggctgggtgcagtggctcagctgggtgcagtggatcacacctgtaatcccagcactttgtgaggccaaggcaagcagatcacttgaggtcaaggagtttgagactagcctggccaatatggcaaaaccttgtctctactaaaaatacaaaaattagccaggcgtgctagcacgtgcacccgtactcccagttatttgaggggctgaggtgggagtattgcttgagcctgggaggcagaggttgcagtgagctgagatcgcaccactgtactccagcctagctgacagagagactctatctcaaattaaataaataaataaataaagcttaaagacaaatgaaaatctgaagcaaatatttgaacttttgtaacatataaaagttagcattcttttttttttttttttttgagatggagtctcgctctgtcacccaggctggagtgcagtggcacaatcttggctcactgcaacctccacctcctgggttcaagcgattctcttgcctcagcctcccgaggagttgggactacaggcgcctgccaccacgcctggctaatttttgtatttttagtagagacggggtttcaccgtattcgccaacattttttaaactttcacccaaattaatattttatatacaaaaatgaaatgatgaaaatctttaaaatggtagaataagaacctccaagaatcttctcataaaacacagcaaaatcgtcataattaactttttcaaaactctagaaattaatcaaagacttgcatcaaaatctggggagtgtgtgttctagaaaaacggttgaatttcagtaagaacagcaaattttatggtatatgaacttttcctattcccatcccctcccttcatccccagttctgtggcggccttgaaaacaaacaattcacttcgctggtgagaatcagtagcctggcagccaccaaaggggaaggatggggctaaagttccctcaaagccccattcctcaagaactattattgtttgacttgtctggtggttcttgggaagacttatctttcatattctctttatttgacacgatttgaaatattcgaatctttcatattcaaatattctccttatttgacatgatttgaaatgtcagcccacgtgaacagtgtcttcccctaggtataccatctttgttgattgaggtggtaaataagttagggcaaaaaaaaggcaatccaaaaagcttgtaaataaaagtttggaaataatatatttaaactgctaaaattaatttaaaaactgccacataatcgaaacgtggcaaaactatccttcaaaaaatgaagcagaaatgacattctcaggaaaagaaaaagtgagacaattggttgctagccctacagcaaataccaaggggcaatttccaggctgaaataaaaggacataagacagtaacttgaattcagatgaagaaataaagagcaccagtaaaagttaactacataagtaaatataatacacagtatagctatatttttgtttgtaactaattttctttgtgttttaaaacaagtacataaagtgataactaccaattcgtgttgacgggcatgcacaaaggactgggggaaaatgaatctatagaggagcaaagttttgtgctctactataattaagttgctattaatttgaattaaatttccataatttaatgtgttaattgtaatttccaaggcaaccactataaacataactctgaaaatatagtaaaagaaaattataacagtacactagaaaatacatatttaatacaaaaaagcaaagtaaaatggaggaatggaggagcacaaaatatgtaagacatagaaaacaaatatcaaattggtagacgtatattctgccttatcagtattcacatgaaatgtaaatgggttaaacactccaattaaaaggcaaaaatcgactaatggatttttaaaaataatacaacatgctgtttataaaagagacatatacattcaaagataccaatagaatgaaagtaaaaggatagaaaaagaaataccatgcaaacagagccccagaacacatgaggaaaaactgacagtattgaaagaacaaatagaaatttcaacaataccagttggaggctttaatacctcatgtctaataaataatagaacaactaaacagaagagaaacaaggaaatagaagacttgaacaacactataagccaactacacctaatagatatttatagaacactccatctaaaaattgcagattgtacattcttcccaaattcacatgaaacattctccagaataaaccatatgttaggcagtgaaaaagcctcaattaacttaaaaggatttaaataatataaagtacgtcctccatctatgatggaattaaattagaaatcaataacagaagaaacattgggaaattcacaaatatgtggaaatttaaaacaatcgtaaattgccagttggacaagaataaatatcaagagacattagaaaatattttgagatatattaaagcaaaaatacaacataccagaatttatgggatgcacctaaagcagttcttaaagggacagccataactgtaaatgcttatgttagaaaacaaatgagatctcatatcaataacagaagattttatcttagggtacagtgtatactgctcaggtgatggatgtaccaaaatctcagaaatcaccacgaaagaacttattcatgtaaccaaacaccacctgtttcccaaaaatctactgaaataaaataaaacaaaaaacacatccaaattttttaaaaaacaagttagcaaaagaagagcaaactaaacccaaatcaagaaaataataataattaaactagaaataaatgataaaagaggataaaaaacctacagataaaagtcaacaaaaccaaaaattagtcctttgaaaagataacaaaattgacaaatttctagttagactggccaacaacaaaaaagagagaattctcaaattaccaaaatcaggaatgaaagcatggacattactattgacttaacagaaaatgtttaaatattataaggaatagtatgaacaactacatgccaacaaattaggtaacctatacgaaacagacaattcctagaaactagctacactcagggagcaacaggcaaatgaataaagctataacaagtgaagagactgaattaataaataattactgacaaagaaaatctcaggatcagataaatttactgctcaattctgccaaatattcaaaaaattaatactaattcttcacaaaagaattccaaaaaagaaaagaggacaaaaaacttccaacttatttcttgaggtcagcattacattgacactaaaactaaagacaccatgaaaaaagaaaactacagataaacatcctttaaaatataagtacaaaaaccatcaacaaaatattagcaaactgtttccagaaacacacaaaaagcttatactatgaccaagtgggatttcattccaggaaggcaagaccgtttcaacatatgaaactcaatcgatcccataaactatatgaatagaataatgaaccaaaaccacatgatcatcataataggcacagaaaataatccaacgctcttttattattaaccaaaaaaaaaaaaagcagtctaggaatagaagactactttctcaatctgataaatggtatctacaaaaacctcacaactgagaacatacttaatggtgaacactgaaagtctttccctaagatcaggaacctgacaagaatgtctactctcatcactttgacttaacattgtgctggaattctaactggggtaattagacaagaaaaataaataaaagtagtctttggaaaataactgaagttatctttactttaaaatgaaataattttgcatataggaaatcctaaggaatacagacaaactatttatgataataaattctgcaaggttgcaggatgtaagatcaatatgtgaaaatcatctctatatctatacacttgaacagtctgaatatgaaattaaaattccacgtacaatggcataaaaagtaaaatagaaacaaatttaacaaaggaagttcaagacttgcatactgcctacaaaacatcactgaaataacctgaagaagttttaaataaatggaaagacattctggggaatggattggaagaattaatattctcatgatgtcaacaatatccaaattggtcacaaatttaatgcagtccctttcaaaattccagctgtgttttgtgggtttttttcagaaattggcaagttgatcataatattcatatggaaaagcaagggactcggaatactcaagacaatcatagaaaaaagttaggctcaccatcgtaatcccagcactttgggaggccaaggtaggcggatcacttgaggccaggagtttgagaccagcctggccaacatggcgaaaccccatctctactaaaaacacaaaaattagcagggcatggtagtgcgtgcctgtaatcccagctactcaggaggctgaggcatgagactctcttgagccacggaggcagaggttgcaatgagctgagatcgcaccatcgcactccagagcctgggcaacagagggaaactcttgtcttaaaaaaaaaaaaaaaaaaaaaaaggttggagtagtattggcataatggatcaaatagatcaatagaatagactggagagtccaaaaataaacccatacatctttggtcaattgatatttagaagagtaccaagataattcaaatgtgaaaaatattattttcaacaaatgggtctgggacaactggatatccacatgcaaaagaatgatgttggatctctatcttaccccatatacaaaatctaacttaaaacgaatcaaagatctaaaggtaactagtgaaattataaaatatttataagaaaacattaagtataaatttcttggctttggattagtcaatagtttcttaggtatgacatcaaaagtacgagcagcgaaaaataaataggtatactggacttcatcaaaatgaagcacttttcaaaatgtgcttcaaagaacccaatcaagaaattgaaaaaaacacacaaaatggaagaaaaaatatttgcatgtcatatatctgataagggtctagtatacaaaatatataaagcaatattacaactcaactatttaaaagaataacccaattaaaatacaggcaaaggatttgactaaacatttttctagacatacaaatggtcaatacaaacagatactcagtatcaattgtcattagagaaacacaaatgaaaaccacaatgacatatcatttcacaaccactaatatgactataatttaaaacacagaaataaaaagggttggccaggatgtggaaaatgggaaaccttgcacatcactgatgggaatgtaaaattgtgcagccactggggaaaacagtctggcaattcctcaaaatgttattcatatagttaccagctcatccagcaattctattcctaggtatgtaccaaagagaactgaaaatgagttcacacaaaaacttgtacataaatgttcagagcagcattagtgataatagcaaaaaaaaaaaaaagtggaaacaacccaaatgtctttaattgatgagtgaattaaaaattacagcatattcatacaatataatattattccatcataaaaatggaatgaaataatgatttctgctacacatcatggataaactttgaaaacattacgctaaatgaaagaagctggtcacaaaagctatgttttctatttacagaaatgcccagaataggcaaacctataaagtacagaaagtggattagtggctgctgggggtgagggtaagaaattgaagtgactggtaacgattaaagggtttttttttgaggtgacgaaaatatactagtattagataatgatcatagctgcacaattttgtgaatatattaaaaactactgaattatacaatttaatgtgatgaattttatggtatatgaattacagctcaagtaaaaataaatgacaagcatgtacacatacacagatatatacatatgtcatggacattatgaggtgcttaataaatatttgctgaatggctgaaaagactgagagaaaagtatatggtaacatactccaaaaaggaagtgaaagtaaaaaaaaaaaaaaaaaattgtccatgttagttgtatattggtgacgggatcatgagtggtttctactttctatggtatggtttcctatttcaaattttttaattacttctacaatcagaaaaaatcataatctgtggttaaaatttataaaactagtttataacttctgattatgaccaaaataaggttaatttatatacaaaaagtcttctagaaataataagtcttaaaaataaaaatgcaaatattggacaaaagctccctctggtatatacaaaagtgttagtcttccttacaaaacacccctttatattttgcctcagttccatcatcattaacttattagtcagtctccatccactacaacatgttttaaaatattatcagcatacgtgatttcttagagagatttaattatggatatacctgaagcaaatttaaacctgtgtacatatgtgtactcatatccatagacaacaatacacaaacatctaagtctattcatgcacatagtttccttgtaaattttgtgattatgacgtatttgaaaaaaattgtaattagatatgcttgacattttaaagcaaagaaagatatagatttgacagtttaaccaatttgaaaacccagaagcccatacaaggtatggtatgtcaaattatttccaaatgtataatgctttgccagcaggtcccttgtctttatgggcatattctggctataaatatctcagtgagtataacagtttggacaacggagatcaatataaaacaagcagtggaatttaataggagttgatgtgaaaaaagtggtaggaaagatataaactgaggaatccaggtattcaagaattcaccacagctgaaaattcacaggggaatcaatttgcaataatagaaaaccagcagcaacctaacccactgatctttattacatacaaaagagcactatccattttcaacagggttgttttgagtcataagagcaaatgattcctaaatgtttagcattatttctagagacaggaatgacaccatgttgtcacctctttgaagattcctcatgaacttatacagggttaattgcttcttcttttctgtgaacactcagtctgctagtatgcgcttttatcatcgtatttattaagtctttgcaacggtttccacaccatttgctctagtcaaccaaagcaccttcaagacagacacaagaatttatttagctctagatccacagcactggagcacacagaagttgctaaacaagttgtggctgaacaaataaatgagcagagtatttgtttctgtaatttaaattttgtcctgaatattttttgaagcacactgtttaaattttccatactatgtaattaacaacatcattattaatatattattgtttacattatataaagtatataattatgttatataaaattacatatattatatgtaaaatttatgcataaatattacgtttatatttatgtcaatatataatatataaagtatgtaatatgtttatattatatattttagcaatataaataattatagcatcatgctttggcctagcataaatggtgattctacggatgacaaatatttaatatataagatgtcatttccttgttccatgaccacggcaagcattgttaatcgatcatggcattcttaactggagttagaacgggccttcagaatcctcatcacagtgtcccagggagccgctactgatcaatcaggattggcacaagagttgtgactaaccactattcctgattttctggatactttcagaggaatattttctttggaaacccattaattttcaatatttacaagtacaattaatgaagcacacccattctcctatacatattatcagctttctaaaactctgttataccacttatgtgtcctagaattctgcaatgccatgtgaaataaagttctggcgacacttccagtaacctgtaattaaacactttcaatagtagactattatcagtcttcactatttttaacgaaagggcacagatcctattaaagaaagttactgcttttacttcttatggagagaaagggaaagagaacaaacaaatacttgtggataaggattcttgaactatccctctgctagtaagacctgccaggaatgaaactgctactttggctgggcagagcaggtgctgctgattgattcagtaagtaaggaacctttacatttttttaggtgtaagattatcttcttcctgctgctctgaaacatctgatccacaggccagcacaaagaaagctatgttttttaattgaggaagtaacagacagaacaagaaaggctctatggtacggcatactgagaagacaactacaattaccaccctgcaaagctgggatttgtgagtcctggcagggggcctgcaacaattctggtagtagcacagtcccagaccagtctctcagagcctccaactaatgcagaactgtgtttaggagtctggaaaatccatatattaacagcttgtccacattcctagctggtggtgagaactgagcagtgactctgagagaatgccaatggtagacattaactcaagctggtttctttagaaagtaaaacaaaacctgaaattctttaaaattttatttgttcataaattccatgtcatcaccaagacaaaattctgaatgcaaaatccttttgttattaatttcctaactcaaacagatgttttatgtgaattaaaaaaaaatttcttaaacaattatttcctatttactaactgtggaagcagccattcttcttctacaaggaggatgaatgtagagttgtgatgggctagtggtcaggcagctggaggctggagcagggagacactgagcataggaatgtctgagcaggatgcaaggcagtgaggagagtcggaaacatcagctgctgttattagaatcatggccaatgcatccagttttttcttaattagtttatcatactaagtattaaaaataacaataataacaatagttaatgtttattgagtgagttttgtgctagacactgcgctggacactttatatgctttatcccaattgattctcaaattgaatttaggaagtagatattattacctaaatttatggatcaaaatagcaaggcttaggacaggctaactgacagactcaatgacacactgctaataaccagaggggccagaatcaaacctaagcatacaccatccacgggtaaaatattggagagttaccatattccctccaagggtcttaaagctcagattgaattcaaatttatgtaacagatagaaagggaaaagaaaggaaaaaatgtgaatgttctttcatttgtctcaaagaaagaagaaccctataaatatgccatactcttttttttttttcctagagagtgggccagagtccatttcttaatggttaagaaatgtcatgttaaagaaactatgtatggggttctattcagcatgtctttgctcaactttaggtgtttcaattcatgagagggtttgagagtatataagaaaatggcacagtggcctgtgtcggctaagactgtactttgtcattccagtgcactaatctgtgatatagcagctagaaacttataaaacattcaagcaaagccatgtgctgattcaagtcacggactaggatacagctaagcattttagcctctgttattgaagcaataagtacacaggtgactgaatgatggctatctcagaaggatttcctggaattggtcattcaaatctctactcatttaaaagaaagcacttctttacaggaaaccctggtaggctgaaatggttaagtatgatacccaaaatgaataggtaaggaaataggtaccttgaacatgatttgaggggaatatgaggcttactgttcagaaaagattaaagatctatataatccaagcataaaattaataaaatgaccttttcttttaaattgtggatggaacttccatttgtttcttcaaaagcagacagtatgtgggaaacatcagacaaacccaaattgaaagacgttctataaaatacctaaccagtactcttcaaaaccatcaaggtcatcaaaaacaaggacagcctgagaagtcatcgccgtctaaagaacctaaggagacgtggtgactaaatcccataacgggatcctgggacagaaaaggggcattaggtaaagactaagaaaatccaaatgaagtgtggagtttggttaacattaatgtgctaatgccagtttcttaattttgacaaatttaccatagttatatcagatgttaacaataggggaaactgggtgaaatgtatacaagaactctttgtaagattcctgcaacttttctgtaaatctaaattttcaaaaaaaaaaaattatttagaaaaacaaattacacacacactcacacacaggccagagtgtgcccttacaaatggccacatattaaaagcacattcataagcacttagaacaatgcttgacatatagtgtaaaatagcatatattttttaaaaatacatatatattttaagatatatatatttatataaatgacaatatatattatataaataaaaatgtatatatacatatatatatatattttttttttgagatggagtcgtgctctgtcgcccaggctggagtgtggtggtgcaatctcagctcactgcaacctcctccttccgggttcaagcaattctcctgcctcagcctcccaagtagctgggattatagctgtgcgccaccacacccggctaattttggtatttttagtagagatggagttttgctttatgttggccaggctggtctcgaactcctgacctcaagtgatctacccgcctcagcctcccaaagtgctgagactataggcatgaaccaccgcacctagccttttgaatgaatgaataaatgaatgaattaaatcactttccgtagttaaaaacaaaagtcttcaattgttcctttttatcttaaacctacactcagcctcatttaagatcttccacaagctagccaaacttttttttctacaggtcatcagaacactgcctctgttcgggtcaaagaagtcatctcactgtcccaggattgtggagccctcatttctggcttcgctttgtcatcccttaccccaaagccaaaatgctctcccaaatcattctgcctgttccagattgaattcaagctccccaggccctaagaattgtttcaaaacactcctgtattctcctgaaatcttccttctctgaattcctactgtctacttttttagttcaacatgtatatataaaattgcttatagtggtcaacctaattccttcttatccaagtgtcatttagaatggatttttaggggaggagtgaaaggaactttcatttgctccttcaaaaggaaggggttacaaaagggcactaggaaaatttaggggtgttcagtatgtttcttgatggtgttgtcagttctttttgatagacatatgtcaatcttacgaaaattgtacccatttagtatgtgcaatttaccctgtgtcaatggtagagcaataaacctgctaaacatgtctatgtaattgaatgtttggtttgtttgtgtttttttatttgtttacgacatggtcttgccctgtcgcccaggctagagtgcagtggtaggatcacagttcactgcagcctcaacctcccaagctcaagtgatcctttcacttcagcctcctgagtagctgggactacaggctcacaccatcacgtctggctaatttgtgtattttaatagggatgggggtttgccatgttgcccagcctagaatgtttgttttctaatttattatttatttacacatttatttattataattactgtaagataatagagatttgtgttattttctgaggtttaagccaaaagtaagctccaaacaaatttaatgtttgaactattacatgagtacttgagaaatagtatgagtattctctgattttaagtagtttgagatatatattttagctcattaatctactaaaaactgaaaaactgtctctcactgtgattgtatcctggtaacttcaaagtgattgcagttttagaaaatgaacacattagatcactgcttacggtataatgccaattatatgtcatggagtagtcattttatctggcttttcacagaaacctaaataaacttaacctaaacccttcaaccactttccaattactgtcccactcccagcctccagcctggctctttcatctggagacagtgacatgacttgtgtggctgtactgtaccaagttacttatgattttccaaaaattgactatatctttactgaacatttctccttgaccagcacctgcagcatcaaccttggctatggagaactggtgcataagagaccacaacctcagaatgaaggtggcacaggctccagctgcaggctatctactagtctcagtctccttggccagctttctatccacgtccatcccgcattcagaagccccctttcttttcctccactgctgacttgtgttcttttgcaatttttactccttttgttttaacttgtcctgctggctatgatgctgcttcatcaaacaccaaatcagctccaccttcttgccctcctttaccatacttacctcccatattagacatgtttattaatttgcttgctttctctcatgccctgcacaatctcttccactcaaatcattaacaatgatactttcaatttctgattttgccttaccaaacactctacttcttcatattcagcttccctttatacccagcacatagtaatattgtcctgctatgcaatatagtggaaaaagtctcgtaattggaaaccagagtctgtttgagtcatggttctgtcactgactcaaccatgactagttatattatctggaataactcactaaacctcactaagatccagtttcctcatatttcaaatggcattgtgagagttacataaaaatgatgcaggtaaaatacaaactacaaaatgctacatggatgcaagatattgcaaacaggcaatgtgtatttattcccaatacaggtgtatgtctttgagctctttgaaaaattaagtaaagtattccatttctgaaagtaaaagctataaaacctttctaaaagtctcacagtaacttggtagacataaaagtggagaaagaaattgcctttctgaatactagagctttgtaagagatgaaaccgagatgatataaaacacaggctgacttcaaaatggagaagtgggtaaaattgaggtactaatcaaaatgtttgaagcctgtcatccttataagaataatgccatgcttaagagccatgtgttcaacatctgcaaagcaaaagcaaatgaaaaattctattagcttgtaccagaaatgtgaacactcagctgaaactaacactattgtgaggggtataattcaaaggaatatcaagatggaaatgatgagtgaggagaaaaggtaaaaattattacataaacacaatttattttggaaaagcacgtgagcatatgcaaggcagcaaaatctagactatctcctggtaactgaatagcagactcagcatagggtttcagaagaaaaatcagaagccagactaaaccaaactagttttttctgtgaaatctttcctaattcccctaggccaacttaagtactttattctttatgctccaattgccccttgcacttacctccatggtaactattaccacaatgtattataaccatctgtgtacgtggcaatttcccttaaactgttctacttgaaaagcagaaaccattcttttttcctttgcttccccagtgcccagtatgttgcttgccacgtggttattaagaaattgttggtaaatgatgaaggaaccacattttggccaatggtatatctaatgatgaatatcagcttcttctgaggacagcaaataaagatacacttattttaaaacgcttaagtgttagtgtattgcttatggaaacagcttcatcattttattaaaacccaactattttttactgcactattccagacaaattattagggacctaccacttggagagtcatagtctgcccaagataattcacaagattgatttctgattctagtgaaaccagagttacagggtcagcccccatacaggtcagacagagcagccacagagggcttgccagattgcatactatgactgcacagctgtatggaggtgccattcacgtagagtaaatgtgaagaggcatgtaatgcaatacacacaacccacatgacagccaggtagcttgttgacaaaataaacctgcctattttgcatccaaagtatttatctgtgttccctcagtaattccacaaaggtgtgtctttgcttaaacaataaaggaaggatatccttgggccactccatgtcaatagctagaaaaaatgtctctggtacaacaccttgtaaactccctttatggaaagcaagttctaagggctgttaatagatactccagtaaaagtggttcagggccaaatgagtcagaggaacacaggaataaagtttaactctttctttcatgtaggatatcttagaatttgtaatatgcgaatacattaatctataaaagacattataggctgggtgcggtggctcatacctgtaatgccagcactttgggaggctgaggtgggcagatcactttaggtcaggagtgagaccagcctgaccaacatggcaaaaccccatctctctttactaaaagtacaaaaattagccggccatggtggcacacacctgtaatcccagctactgtggaggctgaggcacaagaattgcttaaacccgggaggcagaggttgcagggagccaaggtcacaccactgcacttcagcctgggtgatggagtgagactctgtctcaaaaaaaaaaaagacattatattatacagtgtttctcaaatatattttacctctaaacactttttcaattaacattttggaaaaaaaaaaaaaaggactagtgcaatttcatgaaccacactttgggaaacactgccttagactacagcacccattcctattagccttacaccaccacctactgatcagaaactatgaggataggccagggaggtgtatttttaacaagctccccaggggatttgttgttgttgttgttgttgttgttgttgagacggagtctagctctgtcccccaggctggagtgcagtggtgcgatctcggctccctgcaagctccgcctcccgggttcacgccattctcctgcctcagcctccagagtagctgggaccacaggcgccctcccacaggggatttttatgtgaccaaatgggcactactagtggacccaagtttggaaaccactctatgtgttaacctcatgtctcaccactaaagatttccattctcaaaggttaagtttctctggcttatatttcacagacctcaaaatctctcatgtctataagcaggtatgcaagatagaaaaacagcctgatttctaataccagattaatacttttgtagtttctgatttacgatactgttagcaaagcttctcacttgttgaatctagaatttaaatatgtgtaccaataaggattaaaacagtattaagatatttaaaatgcaaacaaatacctgaaggtttttctttcctagagttttcttacaggagcactcatagaatcttagaagattagaattgaaagaagtaccgacagaggttaagttatttacctgtagtcccagagctcattactagcaaaactggggtttaaattcagagctcccactctgcttctactcgtgctccttcttcagcataaaccaatgcagcatggagaattctattctaaacacctcaacccctcacaactactaatttctctttttttttttgtttttcctttttgagacggagtctagctctgttgcccaggctggagtgcagtggtgcgatctcggctcaccgcaagctccgcctcctgggttcccgccattctcctgcctcagcctcccgagtagctgggactacaggcgcccgccatcacgcccggctaattttttgtatttttagtagagacagggtttcaccgtgttagccaggatggtctctatctcctgacctcgtgatccgcctgcctcggcctcccaaagtgctgggattacaggcgtgagccaccgcgcctggcctactaatttcttctttaagcaacctttatgtcctcaaaaagtcataaaaaagggaaaaaaaagaatttttgttttatatgtttttaaatgacagctttaaagacagttacctgaaaatgaaacaaagaatgattccaaagctttactcccatgaaatagcctcttcaatactcccctgatccaatgcatcaccatcatcctctttcacctggactactacaataatcaatcttatgtccttccaaataagtctctaatctgcaggaaaaacaatggtctttttaaaatgaaaacctgatcatgttattttatttctttaaactccccagtgattctctgatgctctttggatccataagcagtaaggcctttgtaagcttgtgatccttcaatcccatttctggcccatcttcccttgtgtgccaggcttcactcgttctgacttttcaaatttcttaattgtgctatgctttttcccatctcaagactttaccatacgcttgctctctgtctagaacatttcctatgcccaatccaagctttcactccactaacttttaatccacccttacctctcaggtttgaaatcttttctgggatgctttctctggctttcattactgagctgtctctctaccagttggcacttcaattgtttactggtttgattcctctcctagactataagcaccatgaaagcagcggatattttactagacagtaaatcctcagcctacctagcacacagtagcaattcaataaagagttgtgcagagaagaaacaaaaaaaaggggaaggagcatgagatgcaggaaagcagaggagagaggaaagggaaagagggaagaagggagagaagcatgaaaacaatccactatttttccagcacaatgtctttaatatgatgaattctcttttatctgatatcttcagggatgagatattctgattaattcattcaatttaagacatagttcaagctttcaaaaactaatgaggataaggcaagcagattaaagaagacaaggaattcaattgtatggaatatagagcaaatcctttatcaacaaatagcataaggaaaggaatgaatttggtcaggtgctctgaaacactgaacaaaatacctacgtacacagccactcatcctgaaaaacccagcacattctaacacccagaagcactgcaaaccactaagtaattcactgctcaattaaagttcatatcaaagacataatatttctataagttgggaagaaactacactcattttggcagaaaaaatgactctatagttttgatgataaattgttattcttacaaagagaggtctgagaccctgtatatatctataagcagtagacagggccttaatttttgaaagtctcatgtagatatctaagatcacgcactgtaaaagcacacacagctcaatttatctgtcttagaaggaaagtgagccagatggaccctgctgggatttgtacctgaaagttacgggaaaatttgaagttccggaaaaagttcttaaggcacaccagttaagaaaaataagttgaaaaatatattgtttttgaggaggccatttactaagccaacaaaattaaattaatgccacaatcactgagaaaataaaaagatatacacgttataattttagttctcaattattctcctgtaatcagtttgtcttcctactagttgtggatatatcaattttcaaaaaaaaaaaaggaagaagaaaaggtttttttatgacccaactcaaagtcacagattcttctagctagtagcaatccagaaataactcagcctaaacttctcattttaaaggtcagaaaaactgaagctaagagacattaaatgaccctagcaaggtgacaccgtgagacattggcagagtgaggaccagagctctaatcccctaactcagtagctagatttctgagcactagatcactggaggaagcagccatatttttctattcagaaattttttttcttcaaagcaaatgcatcacattctatttgagcttgtagacacctaaaaaccccagatggtctcatatcaacttcctccaaggcagttcacccccttcctgaatttgtgcgatagattatttttactctaaaagaagaattttatttatatccatgttatattttatcttggtgctttcagatcattgtttctgccttttaagatcaaattgaattttggatctgccattcatgttgctaggtagtcctctgaggtctgaatcattgaagaatctaaagagcatgacttgtgtgtcttcattcaggtcacagtgaggacactgaatagggagagcagagctgctgctagccagtctgccaggaggcttaatgcatgaatcaagacctacttcattgactgttcagtaggcattgaatccacctaaagattttttcatccaatccacatttttctatcttgtttatatctctataataagcataattgcactgactacgtgcaaatccttatagaataagcatttaaaaacaaaatattacatttctaggaggttttttagttgacaaagtattttatgcacattatttcatctgaaactcagagaaagtaaacaagtcagggtttattatttctgttttgtagattaggaaactaagtttcagagaagttcattgacttactcaccatcaacaagctaatacgtattgaagtagtgtgttcctagacacttgctccaacacttttatgttatttcatctggatagtgtaggtagctgtcaaatacatgactgagatgagtttcagtactgtactacaaaatctcaagtgaactacatatccaattttctgaacaccaagagagcccaacagggagagaaaggctcctcttccatgtgttttctcaagatggactaataggatttcacgaatcctgtttcaagtattgtaaacacacacacacaccagcttgctatttttctattttgaatacctaagaagcttttacccatcccgccctttgtcccagtaagtaggcctttactgtcaagaaaaagagcctagttgtcttgccaaaatgttattgggaaggtaccttatcaaagaccaacaatagggtgtattgttcccatgttctttcaatgacacactcagctccttggtatgtctccctggttcctagatagagaatgccaatacaggttttaagggctgcagccaatcccccacttttcctgccttctacagttgagctaatagccagcttttgtacctattatgtgtactcacatacaattgtcaggttagctattaagtagataatcagatgctgttttgagtgttggctttcacagatctataaaagacaccctgctacacacatacatgtgcaagatattacgtcctaagggtccactgtgtatcctgactgtgctgagtattacaaggggcattaacaataacacttcacagttacacaggattttagaattgacaaaatactttcatagatatcattgtgatcctcacaatagttatatgaaataaacagtacagatgccatcatttccattttatagatgagaaaagtgagatacagcaaattcagtgacctacccaaggttacacaactattgagtcactgagtggtcttaatctaaaatctctgcaatccaatttagcggagaacacaagttatttgaagatatgactttaagaaatgaaacagtcaacagcatgaaccactcatattcaaatgctgcattctaagcgttcatgaaaaaagttgtagatttcccgattgagctcaacaaggcatgcaaggcctgctagagctctcgtgaaaatcttttaaatcttttcaccctagaccacagttcaaaccactaaacactttaaactgtgcttttcatgcactagaaagagctcttattctgttgtggagagtacaataagacaaagatgcaactcaggtgcattaagttatcctattcaaagaaaataagtaaattctattcaaagaaaaggggaaacaccctgttcaacctggtgaattatctgatggcagttaaaggtatgaatcataaggccatagacactgcagtgaggaagcatctgagtttcatctgacacaatagcaaagtactaagcctgtaaaaacttagtaagacaaggaagacaaatgacaaagtgcagtatgactctgaataatttcttgacagtaaatggagggctcagcagtttcctgcacattaaaaatcatgccctatatgatgtgacctgtaccctccttaaagaaaaattacagtcaagataaatgtaataagagagaacaaaaagctgagaagctgaattcacaccaaagcagataattcaaaagatgttctagagcaatgtcttcaagggtggcgcctggaccagcagcatgatcatcacctgggaacttgtttagaaatgcaaattctcaggccccagtcagacccaaggaatgggaaactttaggcctggggcccagcaatcaatagtttagcaaaccctctaggggattctgactcttaggccagctaaaaatatagtagtcctgttatcatatttactgatatcacttgccctttggcagtgccttcagatgaagaaagttaatactggatgatgaatggtgtgtttccatctgctatgaaccctggaagtgatacttttgacacacccccaccaccacccactgtgggtgctataattagcaatctgtggaggaagtatctctgaaagcttaataagtacaatgggacaggtatgaggtaattaatcattcaattatggtcatgatacagttaattaaacatagtttctcctccctcaatcacctagctctttcttagagcagtgattatcatattttagcatacatcaaattcacctaggagggagggcttgttaaaggggaatcctgagacccaccccaagagggtgatttagtaggctagcgggtggggccagataatttgcatttctaacaagctcctaggtgatgctgatactgctgatctaaggaccacattttgacaacacctgtactagagaaaaaaaaaacaattaaattaattttttaggtactggaccactggtgtgctggtgaatgtttaataactggctttccaggaagaaaacaaaaagtagtcaatgatttgtagcatttgccaattctgtagcaaatatttcaaccatgatctatattaagctacaacatgatgtcactgagctgagagttaggtagaggtgtacacagtccatgtttgctagccagctccagtgcagctctgtagccactccacatttctctggacttgatacgtgcaaaacctgcagcatcacactgtttaaattccacagtcccctgaaagtaggaatttgctgagtcaaacagatgccccatcttaattctgcttccttgtttggtgagtcactgactctttagcaggagagtcatgtgaagatccatttctcacaataaaactcatagtaaatttccccaaatggagctccattatcctgagtatccaacactcagaacttgatttgggaatggtttcggcagcagactgtccactagaaaacgggataccataaaagtaaatggcaaaatataaaagctgtattaccaggcgagtcctgcagtggggctcctaaagtaaaatataagtgattccatctgaggaagagttcagatatcaaatgtgacaaacccactatgtggcatgtagcgaataacccagttcctttttaaatatggaatgcatgctcttagagtgaaacactcagaaattttaaataagttccaataagaaaagatgaaaggaaaaaaacagattcctctttcctttccatttgaacctctactaaactattctgcataaaattctatgtattctgtaaaaacttctgtgttgcctcggtgaaatcatgacatcttccttacccccacgtatcatttttttaatgcaattaatgctgccacaactggccaatcatccagtcttgtcagaaattctggtcagaatccttactcatacactggataactagcctttgaataatcaaaaggtgactgtaaaagtgaaatctgcttcaggtcttacttgctttgtgaaggtaaaaaaattcctgatcaatgtgcagagaaaaaaaaagtggatcagcaaaacagttgcctttaagacattctcttgccttaaatttacttatcaagagagtctccttaccttgaatcccagccagtattattatcgaataagcaacatcagaaagtttcaccactacgaacaacagaataaccatcacaagccttttggcaaaagataatgtgacactccatttgaacaacaattttctctacatactaattaaagtagttactgttgacccacattttcatctggtactaggggacaaagataacatgtccatgtatcgtttaccagcaccagatttcccaagctttcagccagccctttcaccaacttgccatcaccaagcagtgaccccttcctgaagagcttaacctacagagagttcacttggagtcattcagcacagctccgtaattccacacttgagaagtctctcttgttgttggaccacagccagaacaaaattaaagcatttcctattcaattttggcaactgcaaggacccactcacttaaagcttgataacagtgagttgattcaattgccattcaagaagaagcagttttgcaaaatgggtttcctgtcagcagcccacattaagcttccatttgttctgcctctctctttctctccttttccaaagatttaggaaaaggtatgtcccaagaacttagcttttttggtggtcccactgaggacatatagtaaccgaattccaagatatatattattatatgccatgtacataccattgcacagtcatcaaggactataaatatccctaattctctgccgccacttgtccatgtctctgtctacagattcttccatattcatagctttcaaacccacctgagttcctcctttctctcatttcaaaccccagtgacggtacaggtctaaatctgaagagtcttcattattcgtcttctccctcattcactgcatcacctagggcaataaggcatttttcaaaagaaactatcaagcaaataaggcctgagtggtttgtttatgattctaggataaaactcaaaagttgcagtcttttgtgatgcatgatttaatagaataggaagcaggccaagaaccacagactagggagagggagtgagaccattaatcaattacagaggagcactcacaacagtggatatcatagaaagccatgttttccacagttcagaacacactgaggtaatgttagatgattcatgtataaacaattttgcttcagtaattatgtgtttagaacctacaacaataataaatgttatctattattagtactactgttacattattttgtcttctagaagctaattctttaagaaaactattagtgctttgatgataaataggttttaatgtacttgacaattctgaaagataaatagtggatgcctgaagagctatgttggggaagatggtgaagccacgtctaaattcagcaaataaataaataaataaaatgccttcatcagttagagataactatcataggcttggacagcatatgtataatacatttgcccacctgcccccaggactagcctttacggttctctaggagaggaaatgtgctgagctgctgtgttttacactgctgtattatcaattcctggtgcatagaacctacttaatacatttttgttacattgaatgcattgatgtagaagcactaagacttcgctgaataaacactgagcaaaatgcaagtctgtattctggaaccagcaggaaaaagtaactaatctattacctcagactaatcactgaactatttcaggctggtgcttataagaagttggacaggatgatctctaagtccttgggtagccccaaagcctatcactatttcattctcccttctgtttctctttggcgaagacttttgtaccctatgttatcgatgtatgccaatacattcatacttataaaaaaaaaaacagaatcaagagtaagttctgaaagaacagagaagtttgatatttaaaatagttgaaagttgtgaaagtatcaaatagaatggtctgtgataatgccaaagggccacagaaggttttaaatgagtggctgaaccttggtttgctttttagagctgagcctttcaaatctgattctctttattctgtgacatttgtcagtgaccactgctgattacctacttgatgatgtttgagctatgggtttatactggtgattggaaaggagagaaggggtagctgtcagaaatgtgaccaaagaaagatcataacctagaaaatgaaaaacaggatggcaaaaattctagttcttagctgacatatgacatgaatatgagtaccttacagagaaggcataaaagtatacagaattactaaccatgcaacctagtgaaatacaatccaataaatctcttatcaaagcaaaaagacacaaaaacttcataataataaaaatttttatctgttctatctagtctggaatccaaaatagtacttaatgtccccagaaaattatacatagacaactcttccatgatattcacacagcaaaaagtgtgaaatgtgaaagcacttaggatgaatattcagatgtcaatctcctaatatcctcaaacatctcagaaaagaacattcggaaaaacacaaactggaaaatcaaaataaagagacatatggacagaaaaagagaacaaattataacaggcagatataatccacatataaataaacacaagatcatgtttttctgtcttaataatttatacactttactccttagtgaaatccaggacttttgatgatatcagctctaaccaggaatctacactgcccattcatagttgtctgtgaaatttagatgtttgaagtatctgatttggggtggtaggtcttcacccattaattagctctggtaatgaaaatccctcaagttatctgaatttgaaagattttatgtggcttcaaaaactaatcccgaataggccaggtgatgcccacttgagaagctaaggagaattacttaaaacacattctggctgcaatattattgttcatgctgaaatgcaagaagccctcactgcccaacaaggggcaaatgatcccagatcagagtagactgactgaattagatggaatattttttcaactgttatttccttcacattatggataatgtcaggcagactctggcttacccttaacttaaggacttagatcctgcatttcttcttccaagaagccatctctctctctctctctctctctctctctctctctctctctctctctctcacacacacacacacacacacacacacacacacacacacccctcggtataggttggaagtccttcctcagtactgcatttacaccctttgcaaacctgtatcatatcacctatattttatttgctttgtattctcagcacctgatgtacctgaaactttgtaaaatcagagaaacaaaatgaaacctagtcaaggttggatgagtgaaagaagtcttgaaagtgatgtgtcatatcttttgcagaataacagtaccctattttcattcaatacatgaattcgaaattctaatttatttgctttcaatgtagaatttcccaaggtctgtatatcaaaataatagtcaaggctgttctcttttttaaaacttaagatacatcttcaatttcatatttgttctctctctctctctgtcctattttgttgcttgtttgtttccacaaaggacagaattaagacttatgaatagccaaagagaagcatggcttagcccgtgactaaccataggaactatagagtaaatcaatttcttcctcatctgtaaaatgagatgattagaataactgatctgaaaggaaggtttctttctaattttgtcattctacaatcatgtatgttacctgttctatgatatatattcaggaaaccacattaatttgaactatactgatttggaatgggtcagaatgttgactgagataatcaaacttatgttagattgctttttttccttgttttccctattaaaagaagagaagcatgaataaataaattaaccacataatgaaaaaggttgagggcacctctactctcctaagaatgcaaactggtctttaagtgctttagaagtgtctatttacttacaaacggtgtaactgcagtatatgtagggttgatactgtttaaagtattttgatgagctaattagagatcatccttatctattaattaaaactccactacacagtgtctgaggagttataatagttgcagtttttatatattcttaaagggattaaaactaaaacaagtattcatcaatttaattagctttccttccaattcattcaaatggatgattgacaatgcttatgttaaatgaacttattttggaaaaagtagctgcattaaataaattataagaatgttgatatattggtcattggtttcaaatgtcaagattacaataaaaatagcattaggtagtcaacccttatttcccagagtagagggatggctcagcaaaacagggggacttatgaattaagtctgtctatgcaaccattcatagaagtattttgttgaatcaaagcattctctatgtaatgagtgaataaagcatttcaaatcaataatcatgcactaagggctaacaagtgctaggttcataaatgggctagtataatgtatgggtaatacattttttgaaaacacaattaagcacttacacaaacaaatataaagtatactaacaactgccataaaatggatatgaaaaaatgatttatgagggtcaaaggtaggaaagactatacctctgtggcaggaaagaatttcccatgtgctactttttttcttttttcctgatacagggtctcactctgtcactaaggctggagtgcagaggctgctcactgcagcctcaacttcttggctcaagcaatcctcccaactcagtttcccaagtagttgggaccacagcacgcacaccaaacctggctaaattcgtttttctttttttctttttttttggagagatgcagtctctctatgttgcccaggctggtcttgaacctcagggctcaagcaatcctcctgcctcagcctcccaaagtgctgggattacaggtgtaagacatcatgcccagctgctactttcttaatctacacatcaacctttcaaataatatattagtattgtaatggaatatatagacacaatcagatgaaaagaattactacaaaaaggaaaaacaacgaaaggcaggaataagaaataggcatgaagaatcaggaagaaaccaatctgaaagattaactgcctcgtattgagaagtagaagagaacagaatcacatgatgaatcaatgccagtaacccaagaggaaagtaagatggggaaaattaaaattcgctgaaatctaaactggtcagtgtggttatgtagccacaaagcaagtagagaagaacttaattggttttgctgactaagggctgcaggtgggcatggtgatacataaatatatgaagtgatgtgtgattaatgaggaaggggtggtttgtaggcctaactggcagtttgaaatgtagtaggatcactgttgtgattttattctaagtataatttttgcattatagctaagggcatcagaaatttgggaaattgttatattcagggttaactcttcagaaacctagaagggaaagagaagatgacccttccatgaaagggatgaaaacactgaggttgaagagactgaattatggctccctgagcactgcctgccctaagagattttgatatggctgactcaaaccaggaagcgcttggctaaaataaggtgcaccaaaacaagacctcatgaaagaggggctagtcaaatccagagcaaagagtcacttagtgtacaggtacttctctcccagactaaacagaccaaaaggattttccagaactctctcccctagacagagacagaggttggaaaatcaataccctgtgtaagcaaaaggacgtggatgtagattggcagagaaacagaaagcaaggaatacaatacagtagctcatgaagggattgaaagagggtccaaaacctgacatcttcactttataaatgagaaaaccaagctcaggggggtttacgggctcacgatcacaggggatcagtagttcttaggattcaatcccagacccctgtcactccaaaggcaaactgcatatttctttaacaagcaggcaaagtttgagatgaacaactggaaagcatttgcatatgtgtaaaggcatccaggtataagaatcaggagcaaaagatgggacagaaaatgtgagatgtgcctgataaacaccaggggtgcactgtactttgtgaatcatcactcaaacagatgatgagattaagctatgaaatggatttctttgatgggaaagagcagacttctgaggatgtgcagaaagaatgtgaccataagggaatagaaagtcatctaggaaagagacaacagaggaacttgacagagtagggaaagcatcttgatgaggcagaatcacaaaaaccaaaggagaagagaatttgggcatgtttttcaaatgcctaacttcagaatcagaaattacttactaacagagaaggacatgacccttttatttctcattcttttcaaccatccgggtcttcaggcaatttttttcattcctttctcatttcatgaattgtttttggaacgttgatttggtgagaaagggagtgcagtatttatcagcattttcattcagaaacagaacctaaaatattctatattcactaacggaagatgaagagtaaccagtttcttttatttctttgtttgacaaataattgatgcccaatagggcatttattggagaacaataatatctctattatagctataaatgtctggatccagagagccctgttttgcctcttgtcggaaaataccaagcttgtatagctggctagtaatatttccaagtactactgtttgaatttaggcataaattcttctaattagattagatttcttctaaataagaatttactgtgtacccttagattgcactgtttaaaagaattaggcactttcttaaatccgaatgactactcttgttctttttgagtagtttatggtttttccaaataatattcattaggcagttcaattacagggtatgttctattccttggttattcttagtcaatacctgagtgaaagtagtgtatccttttcatgtttctgtttagcattagtcattatttgctaacagagtagcctattgattggtgagacttgtaaaattaatggctgggaaaacaacttaacctcatggcattctatgaaatccccagagttccttggaccttgcttgcaaattactgtctttatgtcactggtttttacatacatgtaatatttcttgtttaaatcttgggaatttggctcatgtaaaggctcttcttcactcagtgattagctagtcctttgtggaatcttcagaaagatttatattaaggagtcagtcagtaatctaagagttatgaaaaaatagtttcatgaatcaaaccatgtgtgtcagtgagaatattttcatgctgtttcttttcattacattacatgacagagttgatgatttacaatgcaatagccccctctctggtagtagaacagggactaaattgatattctctcacaaacacttgtttgcaatatttgtttaaagataaccccctactatggccctaactttttgaatggttaagtgtccttccttctaattgatatatttcatttataataaacctggtttcaaataggaagaacatgttgggtggtatagaaaggggtggaatgagaacaagtaaaggtataagataatatttacatttattttgtaggaccacaaaccatgcaagtctaaagatcacaaacaatttgtaaggaagaatacaaattataccaacaatagagaacacactttctttaggaaataagacatgaaagaggctttgagaaatgggtagactttgcactgacatggagaaataaaggatggcatactaggcaatgagaagaaagaaagaacaaaggtatgcactgaatataacctgaatcgacatttctccacagaagacataaacgtgaccaacaggtacatgaaaggggctgaacatcactagtcatcagggaaatgcacagcagatatcacctcacacctgttagaatggctattgtcaaaaaggcaaaagataccaagtgttggcaaagatatggtaatggactaaaactgatacataaaaatgtgatatataggctgggtgcggtggctcacgcccgtaatcccagcactttgggaggccgaggcaggtggatcacctgaggtcgggagttcgagaccagcctgaccaacatggagaaaccccatctctactaaaaatacaaaattagcctggcgtggtgacaggcgcctgtaatcccagctactcaggaggctgaggcaggagaatcgcttgaacccgggagggagaggttgcggtgagccgagatcgcgccattgcactccagcctgggtaacaacagcaaaactctgtctcaaaaaaaaaaaaaaaaaaaaaaaaaactaaaaaggtgagatatatatacatacacacacacacacacacacacacacatatatatgtatgtatataggtgtacacacacaataaaatattattcaaccttaggaaaggaaatcctggctgtaagcggtggctcacgtcagtaatcccagcactttgggaggccgaagctggcagattacttgagctcagaagtttgtgaccagcctggccaacatggtgaaaccctgtctctactaaaaatacacaaatttagccgggcatggtggcatgtgcctatagtcccagctactcgggaggtcaaggcaagagaatcgcttgaacccgggaggcggaggttgcagggagccgagattgtgccactgcactccagcctgggtgacagagcgagactctgtctcaaaaaaaagggaaatcctgccttttgcaacagagatgaacctggcggacattatgctaaatgaaataaaccagacccagaaacacaaatattgcatgatctcacttatacgtaaaatctaaaaagtcaaactcatagaagcagagtatagtgatggttgccaggggctaagggatgggggaaataaatgtacagttgcttatcaatgggcataaagtttcaattaagcaagataaataagttttggagatctaatgtatagcgtggtgactatagttaataataacatattgtatacttgaaatttgctaagagaacagattgtaaatgttctcaccacacacacacacacacacacacacacacaaaatgaggggatagatatgtttgattgtacaatcatttcacaatatatacatatatcaaaacatcacattatataccatatgtgtgtgtgtgtgtgtatatatatatacacaaatttcatttgtcagttatacctcagtatagctatgaaaaaaaagaaataaatttgttttcaagtgttaatactgtgactctctttttaggaatggatttctggaattttaccttgtagcttcctccaatccaaccttcagtagcctgtcagtctcaaatcaggtcatagccatttgtagtatctgtcctgaggtgataccaggaatattataaatccagttacagagccagggagtggctttgttgtagtcctggtctgaaatccctattggtaagttttcttctctcagagctagcagtttacaataagcagtagtccccactcagctttcaaaatcatgttttcccccattcacaaacaacagattcttacagcagcttttgactttgaatagtgagcttgaatctagtggtccatcttgcatgaaatattttaattccctacatccacaagggagccagtttctaggctgcttgcagaagtgtgccccactagttgatgactttggtcttgcctgacattttatgtttatgttctatttcaagtccatagagatgttatttcatttttgaaagcagcaatgagtttttgtgttttctttttatatgactctattttctatatttgaaacacagcattcttgtcatggtgtgaacttactctgccacattgtctggaagtcttttcagggctatatctatcattccaaattgacaggaagccagaaataaaattatacagaaaacatggtgaccaactatattttgaatatatagagagaatatcttaatttatgtcagtcaactaaatactcaatgaccatctactatcttgaggtatataaatgctaaaagtatagcctttgtagccaaaccgtttgcatttgaatggtagttttgttgtttgatcttttgagttcctttgaattgctttacccaagtgcttcaattcctcatcattaaaataatactcatctcagaagttggctgtgaagaatatattaggatatgtgaaatccttatagtaatgctgggtctaataacaaatatatttaaaattttcttatttatttaccttagtgcaaaatggtaccagattctgtaggagatataaaaagtgctcagtacatatgtcctgcatgtataaattttattttgagttggtaagggtataaatgtaaaacaattagagaataataaagccattatgtcacacttttccacatactattttatcaattctaaaatgtattaggaattaatagataatgtaatttattgaaaactgagatagctgagaataaatgtcttagagagagacttgaggtatgttataatagatgagatagatggagagaaaacccaggtaaggaggcaacacaagctgagattaggggaggaaacgagagtgatgtgtaggatgaacatgctatatgtggagaagaacatggcagaggatctggatggtaaaaatgagagaaacagcagcggattatcatggatgagattagggtagatatatttaaaagccaaatgaaagagtttagacttaggtgaatgattttcaatagggaactgtggttcttctttggggtaataacaaaatggaaatcatatataggcaagattttttgagatagttacacataatttaatgagccaaaaacctaattttatgcccaggcaagttcaagtttgcctataagcatcttttaatttgaaacaggaatgatctagtcaggctctgtacacggttttagtgatatgagacagagggcgctggatcctcccacttgtctgacagtgaagggcacattcccattgtttcttatgttcacttgtgaaaaatgagaaatacagaatcagagacatgacctaatttaaagtccactttgcattattaccaatggaaatatcccaaactctcccagtggcccttaaatattgttttaaaaatgctgctgtgaaaacaaacaccaaattcttgcagataaaatatatttcaccttatgagcttatacagaattcacatcaggctaataaaatagaacatgttgacattgttaaagttaatgtacagtaatttagtacttgctgaagatacatttgaaatttaacatatcagaacagtaggtaggttgaaacaccttggacaccaaatagatattttcgtgtgtccttgaggagtatctatgctgcaatattaattctggaaaaccaccaaatgtaactataatgacaacagtgctgttagagttccacagaattattttcaggttttctttcataattgaatcatattttattattaccctaagatacttagattgcacaactgtgcataaaatcccctgccagaaaattgaggaaagaatgaacgaattagaaggaaataatgaagccatccccagattccagatggatacaaaactaatttcatctttaaggtcctgccatctgttctttttatttattttagcattacacatttacataccttcaagtgaagaagtcaaaaagcagacgcatttgtaatggaacacctcatttaaggggagaaaaggtcaaaaaccgtaatttcttttgtaatgctttggtggagtctagttgtttgttcaagatatgcaaatttttccagtaactgagaaataatcaggctgacaagccatcaggaaatagtaaattaggaaaagcaataaaattgtagcaaatcctataatatggtagtcaaatcgttaatgtgcttttaaattttttcttgttgttcccttatgtttgtttcctttttggtaaatttgaataaggtgtcaaaaattttcaagctggtatagtagattgaatagtgtgccccaaaattcatgtcaacctggaacattagaatgtgactttattcagaaatagtgtgttgtagctttaatcaatcaaagtaagaatctagatgaggtcatactggattggagtgggtcctaaatccagtgactagtttactcataagcagaggagaggaaacagagagacatacagaaacagagaataaggccatgtaaagtcggaggcagagccggaagccaccagaagctagggagggtcaaggaagaattctttcctagaactgtcagaagaagcatggtcctacagataccttaatttcagacttccggcctccaaactcagaggaaaagatagctgttgtcttaagccaccaagcttgtagtactttgttactacagccctaggaaactaatatgactgctaagatttattgaatgtagattttgaaatcttttgaaagcttaaattttttactttcaacattcttacatagccatgagtaaaagctgtgtatggaaatttgaagatatgagagcatgtttttttgcactgagtaatataaatcaaaccagacacatggggaaagtcaatgtaaaaatttacacatgatccgcattcctaaactatgcaaaatgcatttagctactattctaactaaagagttaatcaagaaataaagaagaaaaacaacaatataggggaagaaatgttgtccaaagttatttttaaaagaataaataaaaacgaaaaatctggtaagatcctctcctgtttccctgttgttttaaatctttatcttatttcacagagtatcagttttgaatctgaaatttaatgaagataagcaatatctgatagcatgtttatacttgcattcctaactgctacgtgcctatgggacacataagattgtgaaggtggggagagacacgtatagaattaacagctttcattttactcttcaaatttaagagttggagagtttttcttttttaaaaaatctaaattttaatgaacccttttatagggcaaaaagctttgctattctatatgccttaatcatgctaggatgtgttttgttaaccaatgcatagtgttgtgtggcctcagatttaggagtatgcttgtgtgtggtagtgtatcctatatgatttttttatttgatcagtttcttaataccattgtattttgactactattcttaaataataagacaaccattttttttcaagctgggtagagtatgtgaaatataagaaagcacacttaattaaaataaaagctgaaaattaaaatcttatcaagcttgccttattttaaggagctcagaccattgcaaaaataaatcttgctttctcatttagtttcaggtgaccaagtctctgaatccaacagttctatcttctgcctccaaatgtagcatgatatttccttcagattaatgaacagaaatacattgccattgtagcaacaatcaatcagttaaatcacactttctaaggccatttcagggattttaaattatttttctaaactattataccctgttttcatcatcaccctctctaccaaaaactttgcatgacatttaatgccctgtgaaagaaagtccagactcctctcaccctggcaaagacaaccttcactgataacctggcttggaagatcctttctgatttcctctcctactattattgcctatctgagccctcctctctgtgaagttaggctcatccattcactgttccccaaacactttatgagcatcctttcttctgagattttcttcactcatctcaccagaaatgcccatcactctttgaatgcatccatatccacctaccttgaagccttccttctgcttcctttgaaatcacagctgttactacttggcccagtaatctggcattcaaccacataggactcacaaacctgaaaaacgctgttttttaaaattgtcaagtgatatagatagatatttggatatttgtcccctcccaaatctcatgtcgaattataatctccagtatcggaggtggggcctggtgggatgtggttggatcaggggggtggtttctcctgaatggtttagcaccatccgcgtggtgctctactcatgatagtgagttctcatgagatctggctgtttaagtgtgtggcatccccacccacctctctctttctctcacatacacacacacacacacacacacacacacacacacacacgccatgtgatatgccagcttcccctttgccttctgtcatgattgtaatcttcccatggccttaccagaagctgagcagatgtccagtgccatgtttcccgtacagcctgcagaactatgagccagttaaacctcttttctttataaattacccagtctccgttattttttatagcagtgcaagaacgtactaatacaccaattaatgagtgcaatagatacatttactgactgctcaagtctcactccatgcttgaccatcaccccatgcttgatcaactgggcagttgaaatctgaatcaaagacaacaatgggatgaagtatggcttgacaactggctgaggaatgaggatgaggttccaagccaaggtggagcccaggaatacagtgtcacgataaaggtcaaatgattccttgcaaacttactcatttacattttgaatggttcaattgaacattatgataaaaaagctcaattcaaatggtcatgcaaaaagtatggtacttgattatattttattttatggtacaggtaccttctactatttcttgatatcatatgttattactgaaattcaatggctgacatggatatcaacttgaatataaacaatctgatggaaggacatttctctgacacccctcatatttctcaatatggtacaatctgtgattatacaaatatttgttattaggttagtgctagactattaggtctttgtgaagtacaaatctaaaagaaagcaatatatacttgtgttcagaaatatattcaagaataaaacataaatgccaagaactagtctttcaaaaggcaataggtacaggaacaaaaatttgaatattctcaaaaggataaatattgttattcatgaactgatagcaatatttaaatggtatcatctcctttgcagtgacataatataagctaaacactggggagacgcatgaagaatgttaaaatgtattaatcttgcagaatatactgtggcatattttctaacacatatactcaatagtgaaattgatcatttcaatttaccaatacttgtagtagtactgtaaaacataagtttacataaaaatctcatttttaaaataaaagacactcctgctattggtaaaatttgtttttatgaattaaaaaaaacttcacactgggtttttgaagcattgcattagcagtaatgtttttgttaatttaactcctcatcccttgtaacatttcaaaaattcaccactagtcataattctcttaagaaaataaaaagcagctttgagagctatagttagagtttaagacagaggtcagccaattatgtttgaccatgtctggctgaccatatggccaaatctggcctgccacctgtttttgtatggttcatgagctagaaatggtttcacatttttaaagagttgaataaaacttaaaaatatactattttatgatacaggagcactatatgcaacgcaaattttattgtccataaataaagttttattgaaccatggccatgctctttcatttatctattgtctatggctggtttcatgccatgcagtacttgcagcagagagtatatggctcacaaaggctaaaatatttattatccggcccgttagagaaaaagaaagttcttatctataatttctgagaaggaaatacaaattaattaagctttgcaaaatgaaaaattaattccagataactctcttttatgtgcaattagtcaattggaacattctacgttcaagttatatatattcccagaacatgcaagcacatactcaacttaaaagtcataaattcaataacactaacttaaaacaaattttccaccacaatatttagtgttataattttaacacaaaccaatgagcaagatactacatgccagatgtgacctgaaagtaacaacccgttggtcagaaaaaactcactggactgtgtaatctctaataagtacgaagtggtgatatctaaagcaaacagaataaaatcactctttgtggtaatcagaatgactttctaaacaaatgttaagacaaaaaaattctgccgaaccaccaaggacatcccaagcaatcattttatttttctctctgctttgctattagaggctatctgagcattgtttcttctagatattgagaaaagtacataatttctactaagtatgctacatgcattagtgttcccttaatgattacaagttgtagatctgctaagtgcatcctgaatgcactgaatgtgcaattgttttgcataaacgtgaaaagcagagattctaaataaaaagccgctatttaaccatttgcgattatgctatcatcccacaccatcgcatgtaaatgcacttttctattctctttccagttgctaaagtaaatgaccaggaacagagaaatgccctcatttcttatttattggtcacttacttccttggcttgcatataaaatcaaaccatccataaaatccctttaaaaagttgacacatttagggatcaaattatttcacacaaaattgagatatttccaaaaataggcatgttttgaagaatatctcacattacatgtgcaattgagttcttttcctgtcccaggtacagatttgttaggtgatcttaatcaaattgttgctttcttcattcactgcatactattcctttggcaaatatgtttctgccttgataatgaactaggtactatgtgaagtgttatacagaataaaaagatgaatcagacataactatgatctctaggattcgacaaacaagtaaaagtattaatcatatatatatatgtacaaataacggtgaggtaaaaaatgctgagtgcacctaagagaggtgcagataagatattttggaaagtcagagggagaagccattacctccaactgggaagatccaggaggaatttattggtgaggctgcatttgagctgtaccttaaaaaatggttaagaagagtaaattaaattgactgacaagggcatttcacaaactgacaggtatgcaaatgacaggtaagaatgtggtagatgtgtgtgggtaaagaagaaaatgtcattttttttttttgtccataggcttggatgtgtaaagtggagcaagttatagttaaatctagagacatagcatgagaacacgaagatagtgcggtctggaaggaagcattggactcagacagatataagttagaattatggccctggatactggctgagtataccagagtactttacttaacctctaagtctcttctaatgtctagaaatattacataacttgcaaggtccttgtaaagataaaaaatatatatatgcacattttataacacaatgtctggcacattatagatgtctaataaataatagctattattgtgtcaatattatattgaataacaggctaaaagttttagatagtgctgtaagaagttatcacactcactatggaaagtaccacaaggttagcagtttctgaaactaggaactatttggaaactaaagcagttggagagttagctagtgttttcaactgggactgcccattaaaattatctagcgatctttgtaaatcgtggcataactaggctttaccacagaacaattaaatcaagatctctatccgtggagcctgggcatagtactttataaaagattcccaaggatttctcaagcatacccaaagctgagagctactattgctctagatacaagttgttacaattaatatgataagtgtaataagtccagcaaaatatattttatgatcataacttgagttattttcactctgctacactagtgaatgtcacttttctagatggcctttctctgtcatagtctcctgtttgtccaaagacccatttagcaccaaacaggacccaacacaatcaaggccaaatccatgtttattgaatggtgaataatatcactgactcatattattaccattccccattagatcaaagtgacaagatgaaaaacaatataagataggtaccatgtagcaataattaaaatatttatattttgatccttgttttctttttcaaaagctatcttgcattaaaagagctaaaggttcacatcatgttcttaagggttatagtaagtaatcagctatgcctaaaaattaacatcatgaaccaacacatgcaagggtaagtgcaagactagtaacacatgtcttcagccttatcaataatattatcaataatatcaaagtagtggtcaaccacctgttttcatttttttaacttttattttgagttcagtggtacacatgcaggtttgttatgtgaataaattgcatgcttcaggggtttggtgtacagatcattttgtcacccagataataagcatagtaccagataggtaggttctaaatcctcaccctccaccctagagtacaccctggtgtctgttgtctccttcattctgtccgtatgtctgtaatgtttagttcccacctgtaagtgagaacgtgtggtatttggttttctgttcctgtgttagtttgtttagaataatggtctctagctccaaccatgttgtggcaaaggacatgatattttcttttatgactgcatagtattccatgttgtatatgtaccacattttctttatccagtctgccactgatgggcgtttaggttgattccacgtctttgctattgtgaatagtgctgcaatgtgtgcatgtgtctttatggtagaacaatttatattcccttgggtatataaccaataatgagattgttggattaaatggtaattctgtttttagtttcttgagaaatcaccaaactacttcccacagtgactcaactaaattctcatcagcagtgtataagtattcccttttccctacagcctcaccagtaactgttatttttttactttttaaataatagccattctgactggtatgagatggtaagacattgtggttttgatttgcaattctctaatgattaataatgtcgagcatttcttcatatgcttgttggctgcatgtatgtcttcttttgaaaagtgtctgttcatgtcctttgcccatgttttatggggttgttttctgcttataaatttgtttaagttccttatagattctgaatattagacttttgtcagatgcaaagcctgaaaatattttctcctatcctgcaggttgtctgtttactctttcaatagtttcttttgctgtgcagaagctctttagtttaattaggtcccatttgtcaattttttattttgttgcaattgcttttggcatttttgtcatgaaaatttttgccagggactatgttcagaatggcatttcctaggtaatcagccagggtttttgtagttttaagttttccatttaagtcttaatccgtcttgagttgctttttgtaaatggtataaggaaagggtccagtttcaatcttctgcatatggctagccagttattctagcacaatttattaagggagtccttacctcattgcttgtttttgttcattttgtcaaagatcaaatggttgtaggtgtgcagccttatttctgggctctctattctgtttcattagtctatgtgaccgtttttgtaccagtaccatgctgtttaggttactgcagccttgtggtataatttgaaatcaggtaatgtgatgcctccagctttgttctttatgcttagtactgccttggctatttggactaattttttttttttgttccacatgaactttaaaatagttttttgtaattctgtgaagaatgtttttggtagtttgataggaatagcattaaatccgtaaattgctttgggaagtatgaccattttaacaatattgattcttcctattcatgagcataggatgtttttccatttgcttatgtcatctttgatttctttaataagtgttttttaattcttattgtagatatctttcgcctctgtggttttctgtattcctaggtattttattgttttgtggctactaattcaaaatttcattcttgatttgcctctcagcttggctcttgttggcgtatagtaatgttagtgatttttgtacgttgattttgtatcctgaaactgctgaagttgtttatcagatcaagaagcttctgggaagacactgtgggattttctagatatagaatcatattgtctgcaaacagggatagttggacttcctctctttctatttggatgtctttaatttcttgctcttgcctgactggtctggctagaactttcagtactatgttgagtatgagtggtgagacagggcatccttgtcttgttctagttttcaagggaaatgcttctagcttttacccattcagtatgacgttggctgtagattttttttgggctgttattattttgaagtatgttcctccaatgcctagtttattgaggatttttaacatgaaaagatgttaaattgtatcaaaagccttttctgcatctactgagatgattttgtggtatttgtctttatctctgtttatgtgatgaatcacatttattgatttgcatatgttgaaccaaccttgcatcccagggataatgcctgcttgatcatggtcgaatagctttttgatttgttgttgggtttggtttcctagtattttgttgaagatttttgcatctatgttcatcaaggatattggctttaagtttttttgttgttgtgtctctgccaggttttggtaccaggatgaggctggtctcatagaatgaattagagaggattctcctctcctcaatattttggaacagttttagtaggaatagtacccgcttttttatacatacagtgggtacaattccgctgtgaattcatctggtcctgggctttttctggttggtaggctttttgttaatgattcaattttggaggtcattattgatctgttcagggattcagtttctccctggttcaatcttaggagtttctatgtttccaaaaatttatccgtttcttctaggttttctagcttgtgttcatagaggtatttgcagtttttgtacttctgtggggtcagcggtaatgtccctttgtcagttctgcttgtgtttagttggatatcctctcttttttctttattagtatagctagtggcctatgttatctattctttcgagtaacaaactcctggatttgttgatcttttgtatggtttttcacgcctcaatttctttcagttcagctctgattttgcttatttcttatgctctgctttgagttcaaccattttgaaaaactgcattccagattgtattttatctagaccccatatatagagatcttttaaaaagttatttcatgtttcaatagtcctacaataacattttgtggggtgatgcatcaatcattgttatgatgttaaatttaataataattttacagaaaaacacttttgtattcaaatgtataatagggaatgttgaagtatgctgaggaatatggagactgaggagtgtgtattaagaaaatcccaaaggacccatagcttcttagaatttgaaggcactttcgaaaaggcaacctacaaaataggagaaaattttcacaacctactcatctgacaaaaggctaatatcgagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgcttaccatcactggccatcagagaaatgcaaatcaaaaccacaatgagatatcatctcataccagttagaatggcaatcattaaaatgtcaggaaacaacaggtgctggagaggatgtggagaaataggaacacttttacactgttggtgggactgtaaactagttcaaccattgtggaagtcagtgtggagattcctcagggatctagaactggaaataccatgtgacccagccatcccattactgggtatatacccaaacgactataaatcatgctgctataaagacacatgcacacgtatgtttactgcggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccacatgttctcactcataggtgggaactgaacaatgagaacacatggacacaggaaagggaacatcacactctggggactgttgtggggtggggggaggggggagggatagcattaggagatatacctaatgctaaatgatgagttaatgggtgcagcataccagcatggcacatgtatacatatgtaactaacctgcacattgtgcacatgtaccctaaaactttaagtataataataataaaataaaataaaaagaatttgaaggcactttagagataatctaaaagaattgacttcttacaatttgaatggactttagaaataatctggcagaatttcttgccaaaatcaagaaatgccatttctcttgaaatctaatagcgaagaagaaaaattacttgcttctttgtaaaaacatcgaaaaacctacaaaaatatcaaagtttatttccaacatggaggcctggattttgggacttccttattaaatcttaatatattgacagcacttgtaaggaccaacctcattcaaaaatataacaaacagatggcaaattctacagtcggcagaagtaatgggggtattaaaatgctagcagcagtctccctcatggctcttgttttgacaggtgtctactcaggtgcttgtgttttctaagcaatgtttctctgttcctgtgtataagcggccctcacctttttatgagtatctatgccattgcagtatttgctatacataagacaatcacaaccattaaactgtctctaatcctttcctgttgtggttatataaattatttgtttacactgagagtacatgaaatttttataggcacaatctaggattgcatctatccagctttcctctccaataaattttttgtaaatattcaaactcatatatgcctcaatgtaaccacattgtaaaccctatctgttgctttcacagaaaccattcaagctggataaatggcccacctcatagcccagggaagaactcaatgatcagattctaattatctttcttggttcacttaatagccttctcctctctcatgggggaggccagggataccctgaaaatgtggtctcagggaattcattgcagtcatgtcttcttaaacattcatatacaaatgattcctttaaagttattcatacaataaaatgtcctagacactgtgttaggatactatgatgaatactgagggtgctatgatgaataaaggcagtcactgccctaaaagaacttgcattaaaaacaacaataaacaaataggaattacagtagaaccttgaataatattgttcttggtcaacattgttttgttacaacattgataaggaacttcccactggggccactgtctgtgtggagtttgcacgttctgcccatgtctgcatgtgttttctctgggtacaccagtttcccccacatcccaaagctgtgcacattcggttcactgacatattaaaactgtccccgtatgaatgagcatgggtgtgtgtgagtgagccctgcatgtaatggaatggggtcctgtcctgggctgcttcctgccttgtgcctgagctgctgggtgacactccagccatctcagaccctgaactagaataagcaggttgaaaaatgagtaaatgaatgaatggatagatggatacatattgtaaaaattcataaattatgtgataatcatacaaccctacaataataaatgatgtggcacaaaagtgcttactgagcccatcatatttgttgtttgtttttgagctgtgtggtggtaggaggtgcttcttacaattttcacttttcagacaattattccttgatttaacccaccactatgaccaccatcactcactgattcaccaaaatttgggtaaataattatcttacttgtttctttaatatttcttaaatgtatgtatatctcacattcatttcaatgtttaatattagaagtggtgtgggttatttctttagaagtttggtgatgttagccagccactgtgggtcacacctgtaatcccagcactttgggaggccaaggaaggcttatgacctgaggtcaggagttcaagatcagccagactgatatggtgaaaaaccgtcactattaaaaatacaaaaattagccaggtgtggtggcacatgctgtagtcccagctgctcgggaggctgaggcaggagaatcacttgaagccaggatgtggaggttgcagtgagctgagatcacgccactgcactccaacctgggcaacagagcgagacactgtctcaaaaagaaaaaaacaaaaagaagtttggtgatgtttttgtgaccagaaatatgcttaaaatcttaactcctgtttatatcaattagctttgtgataaaattggctttcattatatgtatgctgcctaaagttacagtttctaagaacttatcagtgatgttaagtgaggatttactgtatgtcagataaaaatatgaggtatgaataaaaataacatacattaatagatacagagagtgactagggcaggggatactactctagaatgatggtcaacaaaggcctgtttgtggaggggatatggaacagagacttgaaggtagcaagaaggtcattatcaaagagaagactattctagagagagaaaaaagctaacaaagtttgaagaccaaagtgtgctgggaaaaaatgagaagcaagaaagacagaattactggagcagaaaaggagtggaggacagtagtaaaagatgaaattcgagaagtttggagctgacatggttaattttacgtgttaatgtgactagaacaatggttcccagctgtttgatcaaatatcattctgagcatttctgtgaaggtgggttactggccgagattaatatttgaattggtagattgcataaagcagattgacttccctaaggtgggtgggccatatccaatcagttgaaggcttaaataacaaaagtctgccctttcccaaagtaaggaaaacttttgcctcctgactacctgtgaattgagacagtagctttctcctgcctttgaactcaaactgaaacatcagctctgcttgagctgcaagccagccatccttgagactgcaatgacacatccatttttcttgttcttaaacctttggactcagactggaaggacatcattgactttcttgggactccatcttgctgactcacctgcagttcttgtaaattagcctccataatcacatgagccaattctttacacacacacacacacacacacacacacacgcacacacatatatatatataatacaatatataatatatgtattcatcctattagttctgtttctctgaagaaccctgactaatacagaagcttaggagtagtatgttctacttactatttaaaaaatcatccgctatatggcatggtcagactgcagtgggatgggacagggataaaatcagggagagtagctaagaagctttgcaataatccaggcaagagacaaatttgtggcttttactagggaggtagtggtagatgtagtgaaaattagtgaaagtccatatatatttgaagattgagccaacaggatttgctgatgaggagctggagaagatgaaataagttgaaaattatctcacaggccttttgtccttgggccaaaactggaggaatagagttttcagtttctgagatgggaatggcttgagctgatttgcagggctaatttgaagttcagctttagagcattttattttgagaaatgtactggaaaagcaagtagggaggttgaataagcaatcaggcatgttagtcagaagttgagagtgaaatttagcaacagggtgtctaattgtgtcactaggaggagacctcctagtgatctggtgtggacatagaagatttcttcagaaacgggggtcatctcacatagttggtaagaaatatttcataattcatatagcacctaacaaaatatagtttatcacagaattcagtcatatgtagaaatggcattgaggtaattaacagcttttctgtttattttgtgtcaatttctaccaaaatcctaccaaatcataagctgctttacttatttcatgagtcatattaaggttattcaagtatgtgattaatgtgtatgattttctatgccattattgtttttagattatatagatctaataggcagatagctcatatgctatggttggaatatgtttcccaaagatcatgtgttggaaacttaatgtccaatgcaacagtgttgggaggtggggcctaataaaatgggattaggtcaggagagctctgaacaaaggattaatgttgttatcacaggagttggttagttaccatgggaattagttagttatcatgagagtgagtttgttatcaatgtaaattttgccccctcttgctcaccttctcttgtactctcctccccttccaccttcccatgtaatgacatagtaagaaggccctcatcagaggacagcaccttgatattagttctcccatcctccagaactatcagaagtaaatttcttttctgtataaattacctggtctgtgggcttctgttatagcaaaacaaaatgagctaggacatcatattaacatacactaaagaaattattctgataattatattttgtaggctaaccttaacttgaaatttgactctagctagtcatccctattttctatcttgatctgaaataatttattttggtttcattatctataaaaaaaaagtttctattttgcaacattgcaaacactgcaatagaacgtctcatactcaaattctgttatagagtgctcattaacatagatgtagcttttagatattttatgtagacttagataaattaaatagcttcccaatatacatagaaaacctaaaatacatatatattctttttatgcccatgaaaatgcaatataaaatgtctgttataaaaatgattgttatattaaaatacggaattgtatacatttagatattttataggataatgaaattgttttgctttttctcctcagcagttagagtggcatattttagagaaaaaccataaaatattggaaagagaaaaggattgagggtcccaattatgcaactgttgggatgacaccaaaaaaatcatttaacctcttaagacatcatttttccatacttataaaatacagatattgaagtagattgttaatgttctttatgagtctaacatttatgaatgctatcatttaacaggcatggggtgtgtgtgtgtgcgtgtgtgtgtgtgtgtgtgtgtgtgtgtaaatgcagttccaaaaggaagtatcattttactccaggcaaattttcattgaccatattttatgcaagctacatagtagaaatacggtcagagtacgtatttctatcatcatgttaaaaagacataaatataaaggtgccagcattttgtcagtaaataatcagagaatcagtcctgaacagtaaattcgagtatgtgtgcttttatcacaaccacaatgtttcattaatgtgttttttcttgctgaatattctcgattccttgaaataaattttaattagccactttatgcatataattttcatattttcataattatacttaattatgctcttggcacaatttatgtaatcaaataattgccatatgcaattatattatataaaatatgtaaacgtaatggaaaaaatcacagaagatgtattcacacaagatatttcctttttcattttcagctatccacattatttagtattgattttaacaatatttatttttagctcaaatcactagatatcaaagagaagattatattcttaaggggaaaatttgacagtgattctgcatagagatggtatattattaaaatacaccataagttgaacatttgaataaaagtaatatgtaatatgcattttttcaggtggttttaggaaaaataaaatttacgttttgcttttacccttaatattattgatttgtaatgtgttaattttatttatagctttatacattcttatctatactcttaattgcctatacctaaatatggaatcacagaaatgcaaaaaaatcaaagaaattaaaataaatataaaggttatctaggtcatatccacctaacactacaccttgagaaaatgatgtcctgggaatttgactgacttcacatagtcacaaagctagttcagttacttcacatagtcacaaagctagttaacagcaggacacagcctaacctcaggactcctgcctgtcagtacagggccttgtccttctataccaagaggatactcagttcagcacttataggactgtgttttcaatgatctgcttttgttttttatcttcttcccttgattgtgagatctctgaagaaagagattaggtcttcacctttgcatcctccactagagcttagaatgttgcctacgcatcatcataattgctcaacatctagctttttggaggcttttattttgtgcaacttttgtgaccattttacaaaaataagtaattgtctcctcatctattttgtggatacacaatgaatgttgacctaatgacaactggttgaataccttattgcaaaattgagacttaatatttgaaacacgtattttatttgactctacaaaatataaaatgtgttatgtacacatctaccaagaactcacactgaatggtaattgtagggtattgggtaggagccacgaggtattataaattttctggcactcccatggcagaactgtttaaatgatgaaatttcatttatagcaaaattatcctaactcaaacactagtgaaaaggaaaaataaaaaaagaaaaagaatagctgatagacagaaaactaacatgactgatatggtttggctgtgtcctctcccatactcatcttaaattgtagctcccataattcccagatattgtgggaggaacctgatgagagataattgaatcatagaggtggtttcctccatactgctctcatggtggtgaataagtctcatgagatctgatggttttataaggggtttctcctttcccttggctctcattttctctcttgtctgctgccatgtaagatgtgcctttcaccttctcacatgattgtgaagcctccctggccacgtggaactgtgggtccattaaacatctttttctttataaattacccagtctcaggtatgtcttcatcagcagtgtgaaaacagaataatacaataactatatacattttcattatcttcagcatgcaagttttctctctgaaacaactcaaaaactccatgtgtattagcattttgttattaagtaaatgctcctctgggtttctgtcctgaggttccacagggtggacatgcttttattttgtttctattgaataattcacagaaagttattaattgactaacaccaaaccaatgacaaggttgaagctcttaattgcatattgtcctcacatttgcaaatgggaaataaggcactgcccaggacattccagggggagatacaaagaaggataaactgaggctctattagctctcacattctgtgttatttttatggagtgtaactttggcttcagaggatgagggtacagagaggaagaacataaagcacctgactcctcgcctctattttctgaggtagattgctcttctagccgagactgaaataaaaaatagctctcacgtctaagttcaagcctcaccatgtcgttattgggaacaaaaagcaagtatcaatgaacaaaataaacaaaatactctgaacatgcaatatgagtctactatatctcttaaaatcaatatttttcaatgtacagatacacatttacatttaaaaagaatagttccaattgtcattctcttcacgtgtctgccacacaaaaactttttaccattacagattaagccaaggcactaccaaaaaaaaaaaaaattaacttagtaggaagaattgcaaaatgccaaatatttttctgctttaaatttgaatgtttttaatattagcatgtactttcattaaggagtgggcctactagatacactgaaggtatttgagtatttatgataataataatgattgctatataaaactataattagccaggcatggtggctcatgcctgtaatcccagcactttgggaggctgagacaggtggatcacctgaggtcaggagttcaagaccaccctgaccaacatggtaaaaccccatctctactaaaaatacaaaacatagccgggcatgggggtgtggtagctagcacctataatcccagttactccggaggctgaggctggagaattgctgaaacccaggaggcagaggttgcagtgaaccgagatcgcgccattgcactccagcctgtgcaacaagagcaaaactctgtcgcaaaaattaaaaaaaaaataaaaaaaactgtaattaatagacaaacactggcagagcagagctgcactgtcctgggctctgtgtgttgacataaagagtcaaacaaggccaggcacagttggtcacgcctgtaatcccagcactttgggagtccgaggcaggtggatcacttgaggttgagttcgagaccagcatggccaacatggtgaaaccccatctctactaaaaatacaaaaattagccaggcataggggtgggtgcctgtaatcccagctactcaggaggctgaggcaggagaatcgcctgaacccagaaggcagaggttgcagtgagccagtatcaaaccattgcactccagcttgggcaacagaatgagactccgtctcaaaaaaaaaaaaaaaaatcagacaaagtgcctaccttcaaaaaacttactgtgagcatagaggagacaaaatggcacacaaaatgcacttgacactatgaagcattagtgctaaaagctaaataaaagttagagatgatgagctcataggagttttaaaatgctagaagaaacagaaaaacttttctggagaaaatgaaacaccatgggccttaaataagagacaaaatgtaaattcacaggttgcaaactcaaatgcctatcaaagtcagctgaatattgctgggtaggaaggtacctacagtgttaccaaatttttcaagagaatctagaattctagtttgacatgtaacaaatactgactttttaaatagtgtcaattaactcaaacaattaagtgctgtataagccaataaaaacactatataattatggtctgcctgatttatattttttgtcatgtcctcaaatattagaacagggatgagatggcaagagaaactgcatgagctacatggctgtgatgagaccggatatagttaatttaaaagaacaatcagggctgggtgtggtggtcacacctgcaactcagcactttgggaggccgaggctcttgtttttcaagaccagcctgaacaacatggtgaaacctcatctgtattaaaatacaaaaattagcccagtgtggtggtgcacacctgtaatcccagctactcaggaggctgagacatgagaatcacttgaacccgggaggcggaggttgcagtgagccaagatcatgccactgcactgcagcctgggtaatagagtgagactttgtctcaatacattaaattaaattaataaataaaataaaagaacaatcagaaggctggtgcaggaggtaagtagtagaggagacaaactggggtcaggttggagattatttggggcatgaataaaagcatttatattgattctggaggcagattagagaacaagtacatacagaggtgtgagaggctaagtgtatcatcttgaataaagtcaaacttctctttgtgttggcattcatcctgtctgccaagtataatagctgagtgtaacccaaggcattttagaaatgttagaagtgtcaggaaccatgtaccacacatagacctcaaagcaatgttgctatattagtcttttttctttaacttacctgtaatcataaaatattgatttaaaaaccaagactactaatatttcacaacactatattcacttctaacatactactgtcaggttaacatttgataattccaattaaaagggtttaaaatttttataggatttaccatggcagtatcccaaggaaacatcgtaccacccagcttggccaagcacctaggccatgtttcagctgagaatttttttttaaacttcattatatgaacatttggtgtctcctataaactgacaatccagtttgttagagatacaatatgcaaattaggaaattagcaacaatttctgatgctagtcattactatcctattctccacttcagatttgcaaaaacgcaatgatgcagtaaactataccaacggatgttttgctacggctattaatggacaatattttattgtaatgttaaatttactgcaaaacttgggaatttacaatagcatacattatcctacacaatctaatataattcaatttcctttgtcctatgagaaaaacaaataaaggcaaaatatattgcaaacatactcacttgtgtgctaactttaccatcttattaactattcagtcaaattcagtatcaccccaaatgctgtgaacaaatttcatattcttcaatgggaaattgaagaatttttggacttcataatattggtgaacattctaagctttagccatgtttttctgcttaatctaatttcaccatctctcctctgttcattgattattcctattgttactccacacactgatgcctaactcccactcaagaggtactaagtgtatcagaagccattattgtaaatgtgcagttcaaattttttcctttgctgcacatttgtttatgattttctttgtagggccctttgaccatagattctcatacctaaattcaacaacaaagtcagaagtgcttttgtttggaacaccctcaccattgtcctgaggagtctacacagagctaaaaaaccactatgcaaaagttcaagggaaaccagttgatgcactgtggactgaaggcagaagctgctgacttctacatttcaataaaactattatgaattgcattttagaaaaagggctttgttgctggtttgttttgctctgctggttttgttcatgtgtttgtttgtttgtttgcttgattgcttgtttagagagctaaattacttctgtaaaactcattggcagaaagcagagggcgaataaagctgaccatcttaggttgaagaaaatcatataaacaccaggagagcatcatcaggtaatttgtattctctgatttaagctatcactctgctttatacaaagaaatttaggctgggcgcggtggctcatgcctgtaatcccagcactttgggaggctaaggctggaggatcacctgaggttgggagttcgagaccagcctgaccaacctggagaaaccctgtctctactaaaaacacacaaaaaattagatgggcatggtggtgggtgcctgtaatcccagctactcgggaggctgacgcaggagaatctcttgcacctgggaggcggaggttgcggtgagctgagatcgcaccactgcactccagcctgggcaacaagagtgaaactctgtctcaaaaaaaaaaaaaaaaaaaaaaaagtactcaacaatatgtttttctaatattaagtacatatggacaaagaattcccatcaaaatttggagataaaagcgacaaacttacaaaatgaagtgctgttgaagtacatgtactgttctggaatctttacattgaacaaccacagaaagataaatgtcagagaggagaactcatcaataactggcatctattagggattttgaaataatcataaatgccagagtttaaaaggataattttctttgactatgctactatctcataattttatacgataaatttcatgcaagtatttctgactcagtcaaatcaatcttcatctttactggacaaaaatattctgaccaataaattttgcacacaactatagtattatctatattagcactgcacaaggtataaattctgagactatattctctattgaaacactatcagccaaattcattttatagcccaatgaaaataggtgattttataacaaaaccctccgtaacatacttttaaaatgtctatccacctgggaactaaacatccattaaaatgcccaaatcctaatcttcatgatctttgcttatttggagaagcaatttattttttgtttttgctctttgcataaataatcttattttatccatgctgcaggtgttgttaaccacattttatgtatgaggaagcaagactcacagaggttaaaaactttcttaatttcacacagctattaattataaacatcaggacacaaattgagatttttctgattctagagtttatgttatttttcaaaaaaataattttcgctgggttcagtggctcacacctgtaatactagtattttgggaggccgaggcaggtggattgtctgagctcaggagttcaaaaccagcctggccatcatggtgaaaccccatctctactaaaaatacaaaaattagctgggcatggtggcgggtgcctgtaatcccagctactcaggaggctgaggcaggagaatcacttaaaccccaaaggtggaggttacagtgagccgagattgtgccactgcactctagcctgggtgacagaacgagaccccgtctcaaaaataataataataataataataatttcaacttttatttttgattcaggtggtacacgtgaaggtttgttacatgggtagattgtgtgatgctgacatctagggtgtggatattcctgtcactgaggcagtgagcatagtccccataggtagtttttcagcccatactcccctccttcccttccctgtctagcagtcctcagtgtctactgttgccatctttatgtccatgtacactcagtgtttagctcccacttgtaagtgagaacatctgatatttggttttctgttcctgtgttaattcacttaagataatggcctccagctgcatccgtaatgctgcaaagggcataatttcattgtttcttatagctacatagtatttcacgatgtatattaccacattttctttatcccaattcaccatggatgcacacctaggttgatttcatgtttttgctattgtgaatagtgctgtgatgaacagaggagtgcacgtatgtttttggtagaatgatacctttgggtatatatacccagtcatgaaattgctggttcaaatggtagttctgctttaagttctttaagaaatctccaaactgctttccacagtggctgaactaatttatattgccaccaacagtgtataagcatttccttttctctgcagcctcaacagcatctggtttttttgtttgtttgttttttgttttttttttactttttaataatagccattctgactggtgtgagatggtgtctcattgtggttttgatttgcatttctctgatgtttagtgacaatgaactttttttttcatgtttgttggcatcttgtaagtcctcttttgagaagtgtctgttcttgccctctgtccattttttaatggagtaatttggtttttgcttgtttcaaagaacccagaaataaagccacataactacaaccatctgatcctcaacaaattcaacaaaaataagcaaaggagaaaggacgcccccattcaacaaatggtgctgggataactggctagccataggcagtataatgaaactggacccctacttttcaccacacacaaaaattaactcaagatggattaaagagttaaacgtaagacttcaggctattaaaaatctagaagaaaacctaggaaatatctttcttgacatggatcttagcaaagaacttatgtctaagttgttatttatttccttctcttctcaggggcttcttgatgaaaggatgagttagtctggattctccaagaatcagatgccaacacaggattaaacatgtaagcattttgagcagggtaggaaaggtaccagagctaccagattcaagtctgatgcagagacagtgagggacgtttgggtgggagcctcctagaattcacattctaaagaaggttaataaagccatttgggagtcctcaagtcacagtcattcaatgagaggggtccatgagtctcaggaacaagtgtaccttagaactcctgctgtgctcagtcattgtctgtgaacagccctcagagagcatggccagggtacaaacatagtgatgaatatcagagctcagcagctggaaactctggccaactaccgcctccataattggaggaccattaggtgtattcacagggctgcaaaaaggaacaattcccaattgaacctcttacaagttttgtcatatttggaatattattaatctctctgagtcatattgaaagaaaagaactgttatagaaataaatgtaataaaatatgtgacagtacctactgcagtacctatgcaaagatattagctatttgttttccctctaacatccagttgattgcctgtgtacagtaggtggttaagtaaaggtattatatttaaacatgtatacataaatatacgtaagaaaaaactatacccacatgcagtatgaatataacttcgtttcaatttctctgtttagaatttaaagaatatttctactgaatttcatgttttctctttaaactgaattcatcctggtatataccaatctatataattttcttttctaccaaaagaggtatttgaccaagtgaagtactagactgacaaggttctgtctcttaaaaacaaacaaaaattacacatttctttacctgctgtgtttattcgttcatttatgttattcattcaacaaatatgtaaaactctgtgctggaatccatgctagggaaccagaaacagacactattcctacttctgcctccatttggcttacagtctagtaggaagaaatactttagccaaggttcacgcaaacaaacctgaaactgcagctgccacagtgctatgaaggacaagtgcagtctgtaatgagatcctatcataggtggattagatgcagccagggagatcagcaatcgattgctagacaagtggtgctgatgacgaatttggaaggtaataaggataggaaagaatgtccaaagcagaagaaacaaattacacaaagtccagtggtgggaagaaagatgtgggagaagtttcgtgtggagaacaaataggagaggagcaggttgagaagctgcagacatgaggaagggccaggaacatagtggttacataactgtcccaaaaggctacagctgaaaaataaacctgggtcctattcatggattctcatcacactgaatgaattaccagtgtccattttgtcacttttgcttttaatcactgttatttaaaaaaaaaaaaaaatagaagaaagtaaatagcagaaaacagggaaaatatcagtcaaccagttccaaatcattcaatagtatttaaatggcataagaaaagtgatcaaaactaccaaaacaggttaagcctcacttgctttaagcctcttgctgattcaatctatcaatccaacatcttaattattattggaccatatggaaggtagttattcaataatacgacaacataataaaaagctttaaaataaaaaaaatagtaaatctgctaatccaatctcacagagcaaaacatttaaatgtcatttgagatattattctcagttaagtatcctattcctgtgcttatggcatgacaatccgattcatgcaattattgtggagaaagagtagtaaaaagaagcaatcatccactggctcagagaccactatcatagctaagacaccctatggattaaaagagtccttaaagcataagagcacattcagagttttatgtacagtataaatgcttagctgtttttcagtgtcaggtgcctacagatttgtggtgtgtggctcattggctgacgtgttaaatccccaaaggttacatcaagcaggcccaagacttgtttaagaaaaattgagaccatgccctcagtctcttaagggagtgatattactaagcagaatacataataaatatctgccttcttccagaagaaacaggaaatattttcctattttccttactgttatttcttcagggaaagatctgatagttggtaaaatgggccatagggtagcttcactaagcatttctaagaattccgctctgaaaacttgtcggaaaagaaaagcaacaacaacaaactagttaaacagaaaactgagcatatattaggataaacaacgaaacagaaagtgctaggcaaatcactaactctcctaggaaattaaatgaaattgagataaagaacatttgaaagaaagcctttgtattaattttgtttggaaaaccaggtattgttgaagagtcaccagatacttctaaaagtcactatttcattttaaaatgcatctgcctacacaatatgcaatccttatttgacctaattctttcaataattcattagaatgacttttgtcaagaatgtaatgtggatatatccttatacacatttatatccatgcaaatcaaattttagaatatgttatagtcttcaactcacctgcagccatgattgaaatctgggccttattagaatttttttttaaattagagaaattctaaattcggccctaacaatgtttaaccttagcaggatcaagaaagagtatggttgctgccaggtgtaaagaaatgcaaagatgggcaagcaagcaggagcaagggaacagaaataggaacaagaggaaaaagacaagaaagagaagtccccaggcacagataaggaggaaaaaggtaacttataaacagttgttctgtgacatgcaaactctggagattcttattaggttctctgcataaacctttgctttcctcaagaacagttttgtttattttgttcttttaaagactagagtgagttacctgggaagccctgagtcacataattcaaaaagcagtattgctctctgcctttctctgaagacgctcaggacagagaaatggactgagctgcctgactttcttacctctgcatcacctggcacctgtctttccctcctctcactcctacttcatggttggccagcttgttttgataagaaatcctgcctgtgttccttttgtgaccccatcctggacctcagtatggtaagggtttgggcactgtgttctggcctattcttagcaattcctaaccaatagattggccaagccccaaaacgtaatgccaacctcagagtttctaaatagatggatcagggtatggcgagggtttaatagggaagacctaggaagcatctcttgaaactgttcttttgcacagcaggcacattgcttctcacctgaattatattttcttgaagtggactggggccagggattaactccagctctgatgctggctccagcgtctctttcaccaatgcctgctgccttttattactatctcatgaactgtcacctatcaatgcttgcactggagccaggaaaagtgacaagttagaagcctgataagattctctcaccatttatctgtgagatggccatttacattgctcctagggaagcaatgaggaagtctttctaagaaaataaatccagctttcctgcttcgggcctcatgaccattctcaattactgacttttgaactcagtttagaatcacccctttttattccatatcctctattcttgtcttgatttagaaaaataggaaactccaaccttaggagagtaattttagatcctatgcaaaatgcaagaaaatggattctatttttgtacccagatctaacccagagacaaggaaagtttgtttataatccagatttatagagatttataatgttcaaaacttagaaatattaagtttgaaagtctaaactgttaaagtcgctaaggcactagtgctttgtataatttacccactacagaaatgatttgtttctatggtgggtaaggaaaatgtagtttcaataaatcgttggcagttcttgccaggcactcggttttcggaagtcaggaaaggaaagcaatagcttggatacattaaaggaagaaagtatcaccactcaccacttccattgtcccttcatttttttccatgaatgggcattttggacttgatatcaaatcctatcttccacatttttctctgtatacttgttgaagttttttgtccgttaaaactcagataaatctgttaaatgttttagaatacaatagagttctaaatccggctcacggcagcctcaacccccactatttgcagcctcaactcccactattgaaacgaggcatcacacccatgaaaacatatgaaacagagcagtgcatacaatttcacaagcttcacggtaattcaaaacgtttgtaaattccatttttccccagcacgctgccagtattcacaacaaattaaattctcattcagctgatctgctaggaagcataacaaacaagagtgggcatgaaccaaagtgtcttccttttattactttttcttaccatttattttgatgttctaaatggagctgccctctgcctgtccatagccattataaccctacctgattctaggagcaactgtggtcaaggtcgtcacatcacagtctcctcccacaataaaccatctctctcataattcaggctggccctgcagtcaccacagggaacaggtccaacaccctactggaccagtagaggtggctttttcatacctgtacagtggccctagcatgtgagttttggtgggacacctactgccaaaattattttggatagagccccctttgtgaatagattcatccacctgcctgttttgcaaagaaactacagaaagataaatgtgactttgtacaaaccaataaagtgatatttatattttcttaaataatgtgagtggtaaattaactatttttgagcaataactgtcaggcactgtgattagtgtcttgtagactttgtcatttcatcatctcaacaattctgtgatagaggtagttattcttaccattttacagaaacacattcaagacagccaagtccccaaagccacagagccactagttgcaggttctaggatttgaacccacaactgtctggctccaaaggcttgtgctgttacctgtgtagccccttcctaatcatggtattaagacattgatttaaagcataatacagcaccaacatttactactatgaaccatgaacttgcctgggccattaatgaaaagactttaaaactctgcttataaaaaccaagcaaagatagtatcactaggaatcacaatattcatcttaagacttctaagccacagacctcacactcgaaataaaagtataaatcccatcataatgttaacattaactttataaggaaccaaagtctatggatcgtataaagcaaattaagaatacctagtcaatcattcaggcatctattctcaataaatcttaccacacactactgtgtatttagcatcttccagagatctttgggatgtacaagagtatatatagcacctgttctgcaagtgacctagtagaagagataagacaaatacccatgaagagttaagtaatgataagagtcaggaatgccagctgaatgacacaaataatagatagaatgagcatacaacagagatagagcaattatcttggactcttgtactgggaacactcaggaatagatagagacagaaggcagagtgaaaattatgatgcagaggtagacctgggcaacgcatgtttagaaaagcatgagtttaatgctggaattgggaattgaagttgagtgttcatgttggagatagatgcatagggataagcttagaaatgtagcctggagccaaacaataaagtcttacctgacacatactgggaaatgtagagagtatacataatcaatgctggaggaaggaaggttgaagatgttgcagcaaagaactgatataaaccagtgtttaaagaagattgttctggcagcaacgttcagaatgtactatagatgtcagagaacaaaaccaggaagacagtatggagacaactgcaggtaattgaacatgaagtgatgaagtccagggaaggaaagtgaagagaatgaactgaaagtatggttgtgataatgctctgtgtttatcaggtcccctttcatcctcatctacctggacacacattccctagttagctctggactatgagctataagaaaaaagtaggtacaagctctttaggtctctttcttttccatgtcatagggaactaaaagccacatttaagagtaaagagccacaagatggtatcagagtgtattccccaagtcactgcataaagagagctaccctggagagctgatggacaggcagctgactttgcacgagcaaaaactagacttgtgtatgttcagctattaatgtttcagggtctgttactcaaacatagcctaatctcttcctactaatacaaagataactgtgtcagaatttatagctgtgctcagggactttgatgaccctagtcttggaaataaaactaaaaatagacagcagctagaatttgccagtgacttaaaaaatggcactaacacatcacatttagagaatacctgctaggcaatgaaagcaatgacactttttttctccatttgtgtttcattagattaactgtgggttttttaatcataatattaattaagtctttgacaaaattcagaatttcttttgctcatagcaaatggcagccgtttgcataatagcagttttcctaaaatgctaaattggaagctaagtagaactacacgtaaccctgaagttacagccttacaactcttaggaagttctttcagttttctaactatataataatagaattaaagtagataagaaggaaaatgctataagacattcatctgcatgtgtcagcacagggctagccatggagaatgttgaattaagcaagcagagtttcatcctgccactcagttcacactctacgtcagctgtcagacactatcaggcagcatcctgggtgacctactggcaggtttttccaaatcattctaattgcccaattccagtacccatggatgtttctactcttggagtctctaaaaggaaggaaacaggatgaaaacaacataagaaacagtttatatgaactcagttccaacattactcaagataatgcactggtgttcacacacaaagccaaataatctgagttaaatggtcttccaacatagaaaatgcagaacaaacaagcaattatatacaatctataaagtctatgagtaattgagtgcaatttatttaggcaaaagctagcagagctgtgtcctctgtcatgatgtagctgaataccctgtgtgctggattattcttatcacagtggacaacctcacaaaaattcagcctacaaaggccttggcttcagtgatcaattgaggactcacaccatataacatgattctactagaagctaagagcacttcatctgtacccagaaacatattcaaataaataataactttagatttgtggtgcttgtcatctaatgtgctgttgtcattcttgggtgtgggcccttgggtataggctttacaatattctagtaaggtggctgcaatgacactgatcagcaactctctttttcaaaagagaagatgctcacaaagcctccagcaggattaaaagagcaatctgtgataatgcaatagaataaagctaaataactcacatggaaactaaattcataatcttggaaactaaattcatgatacactaggactgagcttttctttaactaatagagctaattctgagaacaataaccaggtaatgtacgatgacaaacttcaaactgcaaactaaattttatactatatctttattttagaccaggacctagcctgaaatagttcagaaagccttaacaaatgaccttctcgagttgtggaggagtgccaaatacacatgctgattctatgctacattaggtcactggcattttccaagaggacacctacagattctctacataggacatggacatgaaaatgccctatacatatcaaaatatttagcagcaacatgccactttggatagcattttaaatcaggttcttaggggtctttggtgggggataacgaaagggtggagacttcattacactaatcctgatcaggcaaacccaaaatgtacctcatgtggtcatggaaactatttgttttaattcaaaattaattaaatttgagttagagcagaaagggaacagtcccatagctttaattgcagacactcaatacaacacaaagactggcatcccagtgcttttggccttgaatttcggccatcaaaaccattagtcaattcagagacagagcttgaacacttgactgcctacactcaaccccatctgctatgtgcaccattgccaatacacagtccagtgtgccaatggcaccatgcattgacggttcttacagagcatgaaagatgcttacatacttccaccaaagcaacatggtatcatttctcctactggaagaatattctacttaaaagcaacactgtgaatctgtacttgcttattcctttcttattgcttcaaaaagtagaatatataacagcacaaaggagagtttggggtttgagcaaagcaagaataataaaattagaagctacagaacaaatgagtcaaatatatattgagagaagtgaaataatttatcaaggggaaaaagatgaaagcacaaaagcatggaaacataggatgtaaataattgtatttagactattttaactttggcctaattgctttcacaactgttataggagataaaattattaatctaataagcagttcttaacatattaggaatacctaggaggtttttaaaaaccccagatgtgtgggcaccatctggcccctagatcaattaaatcagaatctctggggtgggaccaggcctcaggaattttttaagagctcctggagattgcaacgtacagccatgttttagaactactgccttgaacaaaagaatgaagtatcagttgtagagacaatgttgattcactgtactgcaagaaagaaataagtattcctaaatatatgtatgagaaaagatgacttacaaagcttggaaagtttgcctaaggccaccagctcataggtggtacagcgagtgctcagatccaggaccttacgtggactgacattttcactaagatgtactgaagcctcagggcagagatcatggaaggacaggctgagtgggggaagaaagcaagtctttggactgaggagagctctgataaaaatgtcacttcacatccatctgccacagtgattcctaccatttagaaagttatgccaaggtcaccagaagtcccagatataatgcaaagcctacagtaataattaagtgttattgttattacaactacaaattatcacacacctgttgcacctaaaatgctgtcttcagtgccttacatgtatgacctctgctctgcattacatcctgcaaggtagataccaaaatgcccatattatggttgattaaagtgagtgttataaaagttaaataattttcccaaagtccttaattattaaatggcagagctaggatataaaatggctgcctgctcttttttcatttttatactatgttgcccaaaggagttaaatattttaacacaactactcctaattattttagtttagttagcagttatatcatcagctgaggtcagaagatgtgagagagatgaattgaaggcaagggtggagtatgtaagatatggtggtgtcttagttcattatgtgttgctaaaaaggagtatctgaggctgagtaatttatttttttaaaaaaagtttatttgactcatgattctgaaggcttgaaagttcaagactgggcatctgcatctggtgaaggcctcaggttgcttccacttatggcagaaggtgaaggggagcttgcataggcagaaatcacatggtgaaagaggaagcatgagagagggggaggtgccaggctctttttaacaactagctctaatggaaactaatagagtgaggaagggcattaatctattcatgagagatctgcctccatgatccaaatacttcctattaggtcccacctccaacactaaggatcaaatttcatatgaagtttaaaggggaaaaaacaccgaaaccatagcaggtggttttaaaatatgcacatcaattatttgatgcacctcccttcaagagtggagcttaattttcttccgtgtgtgtgtgagctgtatttagtcacttgctaccaatgaagagaatatggaggaattgtatgattttcaagcctaggtgataaaaggtatcactcactctgggaaaagccagctggcctatcaaaaggatatttcacaaaccccatggggagacccatgtgacaaaggactggggcctcctgccaacaaccatgtgaatgagccatcttggaagcagatcttccagtcccagtcaacacttcacataaacacagccccagtcaatgtcttgacagcaacttcctgagagatcctgacccagaaccagagctaagttgcttcagaattcctatctcacagaaactgtgagataataaatatgttatttgaagttactaagtttcagtgcaatctgttacattgcaatagataaccaatacagaggggcaagaaacagagggaggaagataacaaaaggtcaagattatgtgattcaatgatgcattagagtttgggcaatcctgaacacccaggggatacccgtgtggtagtaggcaagtcataagatatgagaaggggttggggtaaagtaagagcaaggagggtcataagttatttacaatagctcttttgcaaaggaaagaaatactgatttgagggtaaattcattttcccaggttattacatagcttgacagcactgtatgtgatgtatcaaagggcacccaagaacctgaagcaataatgcatcatccaaagtcaagtaatttacaatttactcactggcaagatgagactactgtatcagagagaatcaaaagacatccctcatcgtgtggaaagataagtcaggaaagtcaaaatcatttgcagcaaagcttgtttctgtaatagttgtggattcagaagtagtcttatttggacatatgatattcagcaggacttttaaagtccttttgctattttacatagttcaataaggttttttgtgagagtatgatgttattaatatggactgtattaatgtgaggctaagagttatatgtaatatccctttgcctatttatcttacatcaaaatggtatttatatcttaatgagcaaccatatcctcctgcagatatagatctttgagattccattattcgctcttccttatttagggtttcagttagggaatgtccagattcagaactcaagtccccactgaattccatataccatgctctaatgagtctgttagagaaacactgggaagataataggatatactacctttattcttaccagtaaatcacctccccaggtaactgttcttacaataaaactaccagctgggtggcaagtctctagaccaagataaggttgtattttagccctcttgtgcattcagtacatatcttaaaaatcataagaaagatgaaaaataaaataaactcctgctgaataaaggataatagaaagaaaaataagaaaataatttgagaaaattctttgtaacacacctctggcattgcagttaatgctataaaaggcctttgtttctttaagaaaatgaatttatcacaccagttactgataatccaatctctgcccaactggataactgcccaaccaactttcttcatttgataattatttgtaaaatatcccctttcaaaaatgtatagaaatgtctatgtcaggacttcccaaaatggttccctttgttgcaatattttccttactgccgccataacctcatagcctctaagtccttttgccaagaaccaaaggagagaagagaaagggataaaaatgggtttaaaagtaggattagagtggcaaatgagagaaaaattagtaaaataaataaataggagtgccataaattttggagaatgctctggaatcatttttcaataaccctgtgactggggtcctgagcccacttataagctcaacagacctggtctcttattgcgagaaacccatttgtgacctcaggcaggatagactaaagaagctctggctccatgatctgtgactgagcatgaaatcaacctaatggtcctgtggttttgtattcaggtatcttcactctgtctccaatcccaatgtctgccttcatcacatccctgatactgggacccttatgttgaactgcatgctttagaccctcagaaacagggtactccctcattctgcctacatgcttacctccaaggactcataaagttctgcttttcactgttatctgctcatagattttccatcgacatgttatgaattctacctccaggaccatctaattcactgttctgccaacatcctcagccaatcaatagccttaacaagtgctagttgacaggagctagatttttccagaaaggctggaattctgtctcatgtctaatcccattccatacctgcatcccgtttcctgaattccagttcttaccccatttcagactggcccatttcattgttattacgtcagaacatgtcctgagatacaccattttccttactcagtgtgaagcaacagaattaaatgcaaggcttacatttctcagaatataaatggagaaaagcttttttttcttcagtccatcaaactccaaatcaatcctgaggccaatttgtttgtctttattagaaaaatggtactgttttaaagggagagattttgattgactgattgatttaccagtctcaaactaatgttgagttgtaaatagcaatggcatttctaagaactgtgctgtatcttcaaacatgaggtgatggatgtctgtggagtttcatcacaccaggagagctgtcacaccacttgcttcattctatatgctctactggtttgctagttaacagttatacaatatatatttgctcactctccatgcaaacagataaagactaacaattaggagctcattattatttgggaaaaaatccttagcaactcagcaatatacactttaaaacaaactggtatccaaaagatgaatgatgctctcactctttctcagtagtaatgccctctttctttgagtatgtgattcagtttcaaaatatcactagcctactaactctttatgctaaaagaaaaagtctagtattagagaagaaaaacaatgaaaaaatgaagtttcatgattacttttgttaaactcttacgtaattattttcttatctgcaaagcaagagtgaatgtcagttgcaggaaaaaaaaaatgtgtccaaaactttctccaaccttaacaattcatcagggccaatgtacccgagaactagagaccaacagcccaaacagataggagtgagtaaagttattactatcatacttgtcagactgaatcttttgtctatagcttctgtcatccccaaatctttgtaacttcaactccctgaatccctatgggtttaatctgacttacttttagaaccatccctaactaagtcagctgtcatgcacagaaccagaggaaaagatcctaggaggaaggcccaggaaatgcaaattctctgaggtagtggagtgctttgcagatttgaggacaggaaggaggttactctccctggaggctggagttcaaggttacgtgagatgtgtgctaggcagaataacagccctccagagatgctcatgtctgcaggaatctttaaattcataccaaaaggactgtgcagatgtgactaatggtatagacacaaagagagaaaattaccctgggttatatagagggcccattttgatcatgggagttcttaaaagtggagacgcttcccaggctgtggtcagagaaagatgtgactatagaagagtggtcagagaggcaacagcctgaagtgtataagatggcttattgctggttctgagctgtagtggcccatgtgcaaggactagataaaggcctcaagaagctgagagtggcctggatgtcacccagcaaggaaataaagacatcagtcccacaaccacttggaactgaattctgtaaacactttaagagtaaggaaacagattctcccctggaacctccagaaaggaagccagccctcctgacacattgattctagcctagtgatgtccatgctgaacttctgacataccgaactatgagaaaataaatgtgtgttgttttaagccactaggttgtggtaatttgttatagcaacaagatacacctagatgactaagctatacaggtaccagatcatgcaggcctttcaggtcatggtagtttttcattttttttttttaagcaatggggaaaaaataacaaatattaaggaggaaaatgattttcctaaaagattactgtggaaaagatgcttcacaacctcatagagaaatgcaaattaaaacaagataccactacacacctattagaatggttaaaatccaaaacactataacaccaaatgctggcaaggatatgaaacaacaggaactctcattcattgctgctggggatacaaaatggtacagccactttggagaacagtttgacactttaacgaaattatacatactctcaccatacaatccagctactgcgatccttggtatttgccccaaaggagttgaaaacttatgtctacactaaaacctacacacggatgtgtatagcaacttcatttatacttgccaaaatctggaagcaaccaagctgtccttcacttagcaaatagataaataaactggggtatatccagacaatggaatattattcagtgctaaatgaaatgagctatccagccatgaaaagacatggaagaaacttaaatgcatattactaagtgaaagaaggcaacctgaaaaggcttcatactgtatgattccaactataacgttcttggaaatacaaaattatgaaggcagtaaaactataaatacatccagcagatgccagagcttgggtaggagagagggatgaataggtgggacacagaagattcttagagcagtaacactactcggtatgatactgtaatggtagatacatgtcattgtaaatttgtccaaacccacagagtgtacaacaccaggagttactactaatgtaaactgtgggctctgggtgatatgtcaatataggttcagcaattgtaacaagtgtaccactctggtagggatgttggcaatgggggaggctgtgcctatgtgagtgcagtgtgtatgtggtaaatctatcttccattcgattttgctgtgaacttataattaatctaaaaaataaagtctattaaaaaaagaaaaaaagatgaccgtggctcctaagtggattgtatgtgtagggtagcaggtacttgcaagaataagaaacagcaagattggagctgaattttagaggcagaactataagattttatgatgcataaggtatgaaataagtgaacgagagggagaaatcaaaaagggcttttgtgtttttggcttgagaagaagaaaagctgagagagatggggaagatcaggggaaccacagaccttttttttttttttttttgagacagagtcttgctctgtccccaaggctggagtgcagtggtgcaatattggctcactgcagcccctgcctccggggttccagcgattctcctgcctcagcctcccaagtagttgggattacaggctcacgccaccacgcccagctaatttttgtatttttagtagaaatggggtttcaccatgttggctaggctggtcttgaactcctgacctcaagtgatccacccgccttggcttcccaaagtgctgggattacaggcatgagccaccgcacccggccggaaccacagatttaagtgataatttggaaagcaaaatttccattttggacatgtaaggtttgaaacaacctttagacatctcagtggagatgcagaatagatagataaatgaataaatctggagctcagggttgaaggcttggcagttaatataaacttgagaatcatcaacctacaggtggtttcaggctcatggaacggaataatattacctaagtagagaagtatgcaagtgaacgtaggaaaagaggagaggctctgaggcattcaaagatttcagaatcaaaaaaaaaaaaatagtagcaaagaaggaggagaacatgaaaacatttcttttaagtgcatgatggctaggagggcaagaaaggagagtggttcaacagagaaagtaggcaattgtattgatactggtgagagatggggtaagattaaggcaaagcaggacagtagatttggtagcatggagatcttcaacaagaacaatttgaagggtgcaatgggagtaaaaagagattgaagtgggttgaagagtgaatggtgtatgaggaattagcattgatggataccgacaaaacatcaaaaaggttagtatagaaagaacggagatgagcagttgtggtttaaggaaggtccaagagaaggctttagattattctctttttaagaagaaagattttgaaaaatcttggtgaactattaggaatgatttagtagggagagagagaatggtgatgcagggacgatgccaccactgaaggactgaagtaaagccctttgaaggagtcaaggtgtgaaattcagagcacagagagaaggagcaggggcaggataagagccatttgtgtgccccacccacctcaattctagaagagacctctggccagtccccaggctcatctccaacctaaggtatagttcatattaaaactccaacccttcccctcccatcttttcctcatggacttgtgagtggaagtattaccatatctccaatccaaatcttaggaccagataagaataattctggtaagctatttaccccactgtaatcagtatttctatttgagcttttatttcaattgtgcatcaaagatgttaatatagagaccattatgtagaaacaaatatattttactttatttttacatattaaggtgaatcatacagcttggaagacattgaaaagatgaagggaaattgaaagaaatgcaggttaggcatttccgtagaaatcagtctaagtcaatttaagttcatgatgagggtctgatagctctcataaagcaactctcactatggaaggcctcattcaaagaaagtcaaacttttacacaaatttctaaaacagaattttgaaggatattttgattatatcattcatcatttttaatcacattctgaaaaacttcaaactttgtcttcactgtaaggataatcagtcaatttgttttatcctaaaaaaactagccatttcccttgtagatgtcataagctgcttctgtaccttttccatgatttcattttattttcttgtatgtagatttcagagaaagttctcactttctgaaacagtgaaagcaagaaagaaagagagggaaagataagttggaaacgagagaatgagagagactttttaaaactacggaatgttttacaaatgtagagtgtgattgtatgtatataaagcttagcctaagtcaccactcaaataaagaagttaccattcctgtaccattcctgtctgggctagaaatctcttaatgcctattttctgaaatttaacaaatcaaggaatcacaaggcaccataagttcagataagggaaaaaacactagactggatatctagaagccgcattttagtctgccattgccaaacatgtaaccttgtgcaaatcactttacctgtcttatttatactgatctatggttttgcctattgtataataatcactaaataaaaaaccaaaacaaaaatgttaaaattattaaaattttagacacttattctgaaaacagaaataaccataattcctttacatcttttatttaaaagctgagaacccctatataagaaaggagaaggaaagctttaagtacaatggcaactaaaatggcggcacaaacaaaacgaaattgcctccaaaacactgaacttttaattacggacgatgtcaaaatgcaatgtgttcctttagcttcattattttgaatctgtttcttgtttcccaataaactgaataaataaacagtgatttttaaaattaattatgtagtgcaatttccctcccggaaaaccaatatagcttaattttcattaactatattgtaaatcgcattactcttttggaaaacgttcaaggatgcttttatttataaaccaatagatgagaactataatgcatttatagtaagtctggacacttttacagggggcttcctatttgaaataaccaagaagtagaattcaacaatgatatttttccttctaaactttttaaagtgaaaaaatccaatatattcttgaagtcagaaatagtggcatccagggttaaacttcagcattcatgatgctaattagctagccatgactgtatgtataatgaagatattaagctttctctaagaacactgcaacttgaaattcaaataactaacgttatggaataattgtgaaatatgatcaactgatttaaacactacgaaaatgtagcacaattccctttcaagaggaagaacaagtatattctatagacaaatgccaaaatcagaattagcacatagtcaagaaagaaggtgactaagagtacactggtaaccattttgaataaatcactttaaaactagtcacagtgtgaatgagcataattatatggctctcaactctgctcatgtttttctctttcacttgcaaatcccctcaactgtcatgtttagttgtctctttgagatgttactatacatggtaacagatgaatctgctcttctgtgagttttatatttataaatgatcttagctcacgaagccatggcattaaatttacattagaaaaggtttgacccttgggtccgtgcatgcagttctctgttgcagaaaagcattacaaagctctctatagggagatctgaaaagacatcaaaaatattttgaaatgcagaaagcagccaagatgccctataccttttcattgcttgcactgattaaccgcttacataaaagaataactaaataaactaacaagtgatccccagagagaagctgtcttaacaagaatgtttaattttggccctctgagttcttctagaaggatctaaataattatgtgtaatgtctctaacaaccagagaattgccaataaaagaaattcaataaactcagtctaaagcatagattaaggtacaaactttctaggggagacaggccaagagaatattgtaaacaacagaatttcaaaaaaaaaaaaacccatttaattacagtgacttgcacttactagctacttatgagtgttgatgacaaagactaagaaaagtaagatttacaagataagattagagaattgtttactctgtccagcaaatcaatggggggaaaatatgagggaaacctaatgtactcaaattcaatgcaagatgaatcttttcagtactgaatgaaatactcaaattattctggctacatactaagtccttttgatttgtcgtggatactacctaaaagaacacagataatcaagactgagtccaaggaagtccttctgccagaggtcagcagaaaaagtttacaagttctttgcaatagcagcacaatttttctcatccttatgttttttgtatctaatgctgtaagaaaagcaataggtgtttaatatatgtatttttaaaattctctgaatcaactggtatcatctacaaatttatttttggagaataaatcataacagaaagaaaaaagttattgcatgttaccttaaatcatgtgtctaacaaaatatatacaaataaaacaaaaatattaattaggtgtttatccatgaatttattagatggtgtcacatgttctcaaaacaacttcagaagtaatttatacacgttaatttttataattaaaaaaaagaaagctgagttgcagagatggttaataacttgagcagagttttacaggtaaaggagtttgaacagaactcatgacagggaacaataccggaaaccatattctatccactttatcactctaaagtctatccagaaccctgattttctgtttctttaagttgcttgttcttatgtcttcttatataagcctttattttacaagcttccctctctcttcctttctcttaaatatgtcaaaatgttacaaaatatctgactcaagcttgtttcttcattgagaagattttaaaagttatctaaaagacaaaagaaagaacttaaagatataaaataagggcaacttaatatagtataaacaaaatatttttgtaaccggatgttaaaaaaataataaaacattttagtataggagtctatatacttactgaaaaattaattttcttattcctcatatttgtgtgaatgtatattttaattaagacatttgcaattatatttctgataatacgtatcactgattacattgtagattttttcaaagcacaacaagctcaacaaagaaaggaaagacatagaactatgcagtttgggctttatttatgcataattaaaaccaattagctgtggcaccaaatcaaaaaatcttgtttcccttgaagcaagtctttgtagatactaatactgtaatttatgtgtatatatagtaggcgtttcatttgcaagaagtttagaaaatgatcagagcattttcaatattgaaaaatgaagaaattcacaataaattatatatatttatatataattgtgccattggcgagagctatagagaaaaagtgaaacaaataaacaaaaaaaaaaaaaaaaaagaaagtgtcctacttggaaatgtagcccctgaagaagatgcatcctcaattccatctttcacttctctagagcatagaagggtctagaactaaatataatcctttcggagtgacctctggttacattgggtctcaaagtcccaaaagctatgccccaattctcacactttattgtgtgagacaggaggcatgaattgcagtctttttgttacaaaccagctgtgtcactatatcttgcaagactgcaggtacctcatccgtcaaacattgggtatcaatggatcttcaaccaatgcctttaagagtactcaaacttttatgaagtagatcaaaaatggattatcagtaaaatcaagaaagatttgttcattaagcgggaaaatgttaatattaaaaatttcttaatataaaatgttctttcacatattatcttcacctttattatctttcagcttctttctttcttttatattccaggagagagacatggtatgctattacaattaacagcacccaccctggagtcagactgcctacatgtgaatccctaccattcaccacctataattgatacagtccatttctttatgcctcagttttcctcgtttataaaatgaggataatacaagtgcttctttataaagaagccaggaggattaatggaagtaatacacataaagcactagaacagtacagacctaagcatcacataaacaatagttgggccaggcatggtggctcacgcctataatcccagcactttgggaggccaaggtgggaggataacctgaggtcagaagttcgagaccagcctgaccaacatggagaaaacctgtctctacaaaaaaaaaaaaaaaaaaaaagaacacacagaattagctgggcatggtggcacatgcctgtaatccaagctacttgggaggctaaggcaggagaattgcttgaacccaggaggtggaggttgtggtgagccgagattgcgccattgcactccagcctgggcaacaagagttaaacttcatctcaaaaaaatataaaataaaataaaataaaatagttgccataaacaatgcatacaataggaacaagtttagcacaagatctgatatttattctaaaattcaaaggtaaatactgcatggtgctccacaaagagtgccatgactttcttgtgccttacaactgaatatatccttccttctaggcctaaatagctataactctgttatttaagtaggctaatggactctataaaacagaattcatattttgtttctttcatatttctagattacataacaagtttagggggtgtggttagccagatgatggataattgggccacagctttgtttgtttttgtttatttacactaataatgatattttattaaaggctgcaaattttatggtgtatccaacaggctgtgttctgatatttaagaacctgactgacagtaacatggactacagatcatttcttaaataatgctggtaaataactgaatgaagagtggtttttataaaacctaactcctgcctaaaaggttcctttttttccctttctgggccagtgagaatcttccaggccacacccatagtacaaggacttcaccagtcacggccttcctcatctgtttctctagcctcctcttgctagcgtccatgctctcatttcatcatccatgggacttcttgtatgcctttccctcttcctgaaccttcctgtttctacctttaacctggttaacttctgaccattctgtaggagtcggctcaaggcctctcagtcttgagttttgtgttccttgttgcgctcctgcagtagcaccccatgctcacctccattagtccttaccattgaggagcaatccttgctttaagtgaattctctgctactgcatctgaagctccattctgacagaagctgtggtgtattaatcttagtatccaagaacatcacccctacttttattgagttctcagcaaaagtttattgaatgaatgaatgagattacccatcctgaatcctgataggtctcatgcttaaaatgtctgctttgtgtgaaaaaaatgagaaatattactaaatattgttataatatattattcctatgaaaataagcaaagtgtttaagcatatacagtatgctaccttttatatatataggaaaatataaagatgtgtgtgtgtatgtgtgtacatatatatattttaaaccaaaaattaataaaagtggggatatccatgggaagaaaagggacaaagtaaagcaaacaagataagttacacttctccaaatgtgctttactttgaggttttgactttggaaacatgaaaatgtttcaaataattattaaacaaaattaattcaaagtaaaacagtaattcataaaaattaaaagaaaatttaaaaagggaatataactgtgtatggattggtagtttaaccaacaacaaattattttaaaaggcaaaaaccaataacttgattgtatactcctggtgggtattttctaaggacaatgaaaaatgcaaggaaatcttaaatcatttttattcatcaaattgttaataatatgagttactcttagaatactattaaattgttgcatatatagaatcatataaaactaacacttttagtttaagagaaaagagataaacatatgaattaaaattgaaaacaaaaacctataaactcaaacttaaattagaagtataaaaatatcaacataaacatgcaaaatatttctctttcaaaacttctcttcagaaaagacctagaaacagtgactaagtgagaaatgaacatttccagtacctggactgtggatacaaaaggaaccaaggtgccttattgatatggttatgtcctggtcaggtcagaaaatataagagaagaggctaatttgtcctaccagaaagtgaaaatgtgctaatgactagtggaatcatatcaaaaggactcaggagcaaaagtgaaagaattcctattggcaaatgagataaactgaacatcataaggaacaataactgcaatggattgaaaaataccaaatatcacaaaatctatgcagtcataatgacatttaaaaacaactcaatggtcatatctacggaattttagagaaccaatcacttatcattagagagagtagcttgcattatttctgccttctctgtacaaaatgtgactcaatataaatacacacataatatagtaaggttgttctttgtagaatcagggatttcagaataaaaatcctaaaattcatatggaactacaaagtatctgtaaagctaaagcaattttgagagagaagaacaaagattgaggcatcatatttcctgacttcaaaatatactacaaagctacaatagtcaaaacagtatggtgctggcaacaaacaagcaaacaaacaaaaaacagacagaccaatggaacagaatagagcatccagaaataataccacacacatatacttaacatgagtgccaaaaaatacacaatgaggaaagatagcatcttcaacaaataatgttgaggaaactggatatccacatgcaaagaacaaaactggatccttacctcacactaacttaccacacactagacacaaaaatcaactcaaaatagattacagatttacatgtaaaatctggcaatgtaaaactcctagaagaaaatataatgggaaagtttcatgacactgagcttggcaatggggcaatgatctcttggatatgataccagaagctcatgcaacaaaagcaaaattagatgactgggactacatcaggcttaaaagcttctgcactgcaaagaaaacaataaacagaatgaaaaggtaatctatggaatgagagaaaatatttacaaatcacatatctgataagagattaatatccaaaatatatgaggaacccctacaattcaacagcagaaaactaaattatccaattaaaaatgggcaaaggacttcaatagacatttcttcaaagaacacataaacatggcaaacaggttatatcaaacagtaacttcactaactataagggaaatgcaaatcaaaattatgagttatcgccacacacctgctaggatggctattatagaaaaatacaacaacaactcaaatgtcagcaaagatatggagaacctggaacctttgtccactgttaatgagaatgtaaaatgacacagcttttgtggaaaacagtatggagtttcctcaaaaaataaaaacagaattaccacatgaccaagcaatcccacttctgggaatatattcaaaagaactgaaatcaagatggtcgtttccaagatggccaaataggaacagctccggtcggaagctcctagcaagatcgacgcagacctgcatttccaactgaggtacctagttcatctcattgggactggttggacagtgggtgcagcccacggagggtgagccaaagtagggcggggcattgcctcacccaggaagtgcaagggttcggaggatttcccttttctagacaagggaagccatgacagactgtaccgggaaaaacggtacacttccccccaaatactgtgcttttcaatggtcttagcaaccggcagaccaggcgattccctcccatgtctggctcagcaggtaccacgcccatagagccttgctcactgctagcacagcagtctgagatcaacctgccaggctgcagcctggcagggggagaagcatctgccactgctgaggcttgagtaggtaaacaaagcagccaggaagctcaaactgagcggagcccaccgcagctcaacaaggcctactgcctctatagactccacctttgtgggcagggcatagctcaacaaaaggcagcagacaacttcagacttaaaggcccctgtgtgacagctctgaagagagcaggggttctcccagcacagtgtttgagctctgagaacaaacagacggccccctcaagtggatccctgactctgtgtagcctgactgggaggcacctcccagtaggggccgacagacaactcatgcaagtggctgcccctctgggacaaagcttccagaggaaggatcaggcagtaatattttctgttctgcaatacttgctgttctgcagcctccactggtgaaacccaggcaaaaggggctggagtggacctccagcaaactccaacagacctgcagctgaggggcctgactgttacaaggaaaactaacaaacagaaaggaatagcatcaacatcaacaaaaaggacatccccaataaaaccccatctgcaggtcaccaatgtcaaagaccaaaggtagataaaaccacaaagatggggagaaaccagaacagaaaagcagaaaatttcaaaaaaacagagtgcctcttctcccccagaggatcacagctcctcgccagcaatggaagaaagctggacggagaatgactttgacaagttgacagaagtaggcttcagaaagtcggtaataacaaacttctctgagctaaaagagcatgttctaacccatgggaaggattagaaaaaaaaccttgaaaaaaggttagatgaatggctaactagaataaacagtgtagagaagaccttcaatggcctgatggagctgaaaaccatggcatgagaacttcatgacacaggcacaagcttcagtagccaattcgatcaagtggaagaagggatatcagtgattgaagatcaaattaatgaaataaagcaagaagacaagattagagaaaaaagagtaaaaagaaatgaacaaagtctccaagaaatatgggactatgtgaaaagaccaaatctacatctgattggtgtacctgaaagtgacacggagaatggaaccaaattagaaaacactcttcaggatattatgcaggagaacttccccagtctagcaaagcaggccaacattcacattcaggaaatacagagaacaccacaaagatactcctcgagaagagcaactgcaagacacatacttgtcagattcaccaaggttgaaataaaagaaaaaatgttaagggcagccagagagaaaggtcgggttacccacaaaaggaagcccatcaaactaacagcggatctctcagcagaaactctacaagccagaagagagtgggggccaatattcaacatttaaagaaaagaattttcaacacagaatttcatatcaagacaaactaccattcataagtgaaggggaaataaaatcgtttacagataagcaaatgctgagagattttgtcaccaccaggtctgccttacaagagctcctgaaggaagcactaaacatggaaaggaacaactggtaccagccactgcaaaaacatgccaaattctaaagaccatagatgctatgaagaaaccacatcaattaacaggtaaaataaccagctaacatcataatgacaggatcaaattcacacataacaaaattaaccttaaatgtaaatgggttaaatgccctaattaaaagacacagactggcaaattggataaagagtcaagacccatcagtgtgctgtattcaggagacccacctcatgtgcagagacacacataggctcaaaataaagggatggaggaagatctaccaagcaaatggaaagccaaaaaaaagcaggggttgcaatcctagtctctgataaaacagactttaaaccaacaaagatcaaaagagacaaagaaggccattacataatggtaaagggatcaattcaacaagaagagctaactatgctaaatatgtatgcacccaatacaggagcacccagattcataaagcaagtctgtagagacctacaaagagacttagactcccacacaataataatgagagactttaacacaccactgtcaatattagacagatcaatgagacagaaggctaacaaggatattcatggtttgaactcagctctgtacccccaagcggacctattagacatctacagaactctccaccccaaatcaacacaatatacattcttctcagcaccacattgcacttattataaaactgaccacatgattggaagtaaaacactcctcagcaaatgtaaaagaacagaaatcacaacaaactgtctctcagaccacagtgcaatcaaattagaactcagggttaagaaactcactcaaaaccacacagctacatggaaactgagcaacctgctcctgaatgactactgggtaaataacgaaatgaaggcagaaataaagatgttctttaaaaccagtgagaacaaagacacaatgtaccagaattttgggacatatttaaagcagtatgtagatggaaatttatagcactaaatgcccacaagagaaagcaagaaagatacaaaatcgacaccctaacatcacaattaaaagaaccagagaagcaagagcaaacaaattcaaaagctagcagaaggctaaaaataactaagatcagagcagaactgaaggagatagagacacaaaaaaacacttcaaaaaatcaatgaatccaggagctggttttttgaaaagatcaacaaaattgatagaccactagcaagacaaataaagaagaaaagagagaagaatcaaatagatgcaatacaaaacgataaaatggatatcaccaccgatcccacagaaatacaaactaccagagaatactataacacctctatgcaaataaactagaaaatctagaagaaatggataaattgctggacacatacaccctcccaagactaaactaggaagaagttaaatctctgaatagaccaataagaggttctgaaattgtggcaataattaatagcataccaacgaaaaaagtccaggaccagacagattcacagatgaattctacccgaagtacaaagaggagctgataccattccttctgaaactattccaatcaatagaaaaagagggaatcctccctaacccattttatgaggccagcatcatactgataccaaagcctggcagacacacaacaaaaaaagagaattttagaccaatatccctgaagaacaccgatgcaaaaatcctcaataaaatactggcaaaccgaatccagcagcacatcaaaaagcttatccaccatgatcaagtcagcttcatccctgagattcaaggctggttcaacatacacaaatcagtaaacataatccatcacataaacagaaccaacgacaaaaaacatacaattatctgaatagatgcagaaaaggccttcgacaaaattcaatagcccttcctgctaaaaactctcaataaactaggtattgatggaatgtatctcagaataataggagctatttatgacaaacccacagccaatatcataccgaatggacaaaaactggaagcattccctttgaaaaccggcataagaaaaggatgccctctctcaccactcctattcaacatagtgttggaagttctggccaggacaattaggcaagagaacgaaataaagggtattcagttaggaaaagaggaagtcaaattgtccctgtttgcagatgacatgattatatatttagaaaacccccttgtctcagcccaaaatatccttaagctgataagcaacttcagcaaagtctcaggatacaaaatcaatgtgcaaaaatcacaagcattcccatacaccaataacagaccaacagagagccaaatcatgagtgaactctcattcacaattgctacaaagagaataaaatacctaggaatccaacttacaagggatgtgaaggacctcttcaaggagaactacaaaccactgctcaattaaataaaacaggacacaaacaaatggaagaacattccatgctcatggataggaagaatttacatcatgaaaatggccgtactgcccaaggtaatttatagattcaaagtcgtcctcaccaagctaccaatgactttcttcacagaattggaaaaaactactgtaaagttcatatagaaccaaaaaggagcctgcatagccaagataatcctaagcaaaaagaacaaggtatcacactacctgacttcaaactatactacaaggcaacagtaaccaaaacagcatggtactggtaccaaaacagatatatagaccaatggaacagaacagaggcctgagaaataacacatccacagccatctgatctttgacaaacctaacaaaaacaagaaatggggaaaggattccctatttaattaatggtgctgggaaaactggctagccatatgtagaaagctgaaactggatcccttccttacatcttatacaaaaattaattcaagatggattaaagacttaaatgtaagacctaaaaccccaaaaaccctagaagaaaacccaggcaataccattcaggacataggcatgggcaaagacttcatgactaaaacaccaaaaacaatggcaacaaaagccaaaatagacaaatgggatcaagttaaactaatgaccttctgcacagcaaaagaaaccatcatcagagcgaacagacaagctacagaatgggagaaaaattttacaatctacccatctgacaaagggcttatatccagaatctacaaagagctcaaacaaatttacaagaaaaaaacaaacaaccccatcaaaaagtgggcaaaggatatgaacagacacttctcaaaagaagacatttatgcagcagccaacacacacttgaaaagatgctcatcatcactggtcatcagataaatgcaaatcaaaaccacaatgagataccatctcatgccaattagaatggtgatcattaaaaagtcaggaaacaacagatgctggagaggatgtggagaaataggaacgcttttacaccgttgatgggagtgtaagttatttcaaccattatggacgacagtgtggcaattcctcaaggatctagaagtagaaatgccatttgacccagccatcccattactgggtatatacccaaaggattataaatcatgctactataaagacacatgcacacgtgtgtttattgtgacactattctcaatagcaaagacttggaaccaacccaaatgtccatcaataatagattggattaagaaaacgtggcacatatacaccatggaatactatgacgccataagaaagatgagtgcatgtcctttgcagggacatcgatgatgctggaaaccatcattctcagcaaactatcacaaggacagaaaaccaaacaccacatgttctcactcataggtgggaattgaacaataagaacacatggacacagggcagggaacatcacactctggggcctattgggggttggaggactggggaagggatagcattaggcgaaataccgaatgtaaatgacgagttgatgggtgcagcaagccaacatgccacatgtatgccaatgtaacaaacctacatgttgtacacatgtgccctagaacttaaagcataatttttaaaaaattgaaatcaagatcttgaagagatatctgccctcccatgttaattgcagcaatattcgtaatagtcaagatataacaagcacctaattgcccattgatcatgactagataaagaaaaacatggtatatacacataatggtggagtagtgtttggcctaaaaacagaaggaaattttgctacatgcattacgctaagtgaaataagccagtcatggaaggacaaatacataatttcacttacatgaggtatctaaaatagtcaaattcacagagagtaaatggtggttgccaggcattgggtgaggaggaaagagaaaattgctttttaatagctataaagattcatttataaaagataaataaatcctacagatctgtgtacaacattgtgcctatagttaataatactgttttgtgcacttaaaattttgttaagaagtagatctcatgttaagggttcttaccataataaaaatattttaataaaaactttagaattccagctaataaatgaaaaaggaataacagaatattactattttacaatctctgttgaacaaatagatctatgtaataatcatcagtgactactaaagcattagatgaatagttgacagggaacttgataatgggtgaatcaggccaaccacacttaaatctaaggatcaatcttaacaccataacgaagagatattagatattatgggcttcctgatagaatgcagtagaaggaactcagcatcttgaatgaagtattcttgccaaaacatcaaacctggatctgatcaaaactctatgcctagaaatagcttacaggaagcaaaggatcagaggaaaattttaagccatatcatggagatgcattcaacaacatccaaaagtgggaaattctacaggacaaataacccagtttctttaacaaatagaatacaagtggaaaatagaagagaaagtctatcttcaaaagtatcttcaaaggtccacttcagagtgtcttttggtagtctgcaccagtctttcaagtttaaaggaattgtagacttatattaatctacaattaatttttcgatacaatatgaggaactacttttgatcctgtttcaaaaattgacagtgtgtgtgtgtgtttgtgtttgtgtgtgcatattgaatttggtgttgactggtatttgattcgaagtcatcaaatttttgctaactttttaaagtagaatgatagcattatagcatttttttttagtgcgtctcttttagagttacactgagatgaattatatgatgtttgagatttgcttcaagatgatccatgagggtggggtataactgggagtataagtaaataaactctggctttatgctagtaactgctgacactgagcctgagcgacacatacagggaagtccattaattattctcttgacttttgtgtatgtttggaaatttacataacataatgctaaacaataaaaaacattaaaatatagaattagatacaaaaaaatcctactgaggttttgatcaggctgcattgaatttatacactgattaatttaagctattgattctttcaattcaaaaatgtatctctgttcattctgtccctcaataacatttctcttgtcattagcattgccactttcatttctattttctaggtataaactgtgcacatttcttaagcttactcagaggtaagttataatttgtgagatttttttcaatttcactaatttgtaagtctttttgtgttttagtaacaataagcagtttgaaaacaaatatgaagcaattgcttttgtatacttactttgtaattttcctagttgttatactctttttctggtactaataacttttcacttgagcctcttagatatttcaggtagacaatccataatctacaaataaatacttctttttctcctctctttgaaaaatatgtgctgacaactgtattgaaagggttgatatcctttcagttgcttcctgaaatccttattttgagaggatttccatcttaaagcaaagaaaaacttgtattatgttcctgccagacttctagctctcaatatcccatgttaggaactttcagatttatatacctgatgagtttgcgcaatgatttaagttttctattcactctaccatcaattatagttcagagaacatcatcaatatcaagtagttgggaatatctaccccaacagatatcaaaacatatgtgccactaccactggaagattagataagtgaaggcttccttgattcttattttcaagctgatgaaataaggtaattaaattaaaagaaacccagactgtcccttgtcataaagcaaatatggtgaaggctatcataggaactgaccaaaaaaattaaagccaatctcaaaacatccatatgaattttcttaacatgagggatgtattttgtagagaagttacattatgatttcagaagacattatcttggcttcactacacatagcacatctgggaattgtctacttgaaagtcttggctagaagttctatttgatggcctcaaattaattctgatattgaaaagtctaaaggaagttagtacatgccacatgccaggctacttggcataactgagtaagacacctaattttccagtgggaaaagaccaaaagagttggaccaggacttcacattgatcttgttatgagatgaaaactttgccctttagtatactgcttctcacagtgacatcaagtctttcacttctacctcaagcctctgggatgacaatgtgactccatgccagtttcttgtagcatacaggctgccagacacaattatttctgacaacaggctcacatttctttcagtcaagttagggtatttgtggacaaggatctcatcaaagctgtcaccattgcatttcacctgctttaccgaatgtttagaatgaaaggctggtgcagactaccaaagacactatgaagtggtttttcatcgtccaatatgttatggatgttctctaagaagtcctggtcatgctgaatactacttaggttaagtttcctaacttgtgtcaaccatctctatcgagcataaactgagaacttataaaatgaataagagtattctagctgctgctatggctagattaatcattgtttttttttaaaaaaattcatttttattatagtagttttgctttgctggcacttaattcaggtttttcccctgtaagttgagtctggatagtgccatttttatggagtcacaaagcaccctgtgcttttttcatgctagcactccctacacacattgtaacaagtgtttatgatatgccagattagattgtaaacgccacaagtgtggaaatgtatcttttctcttaattcttcagcacctagaatgggaagtagcacatggtagacatatgaggaccagattacaaacagtcatttaaatgaggcttcttcaagctggattttaaagccagccttcttgacacggtattgttggcaagtttttatttatttatttaggctacaggtatttccagtaaggtcctcattgaaagcccacttaagctaggagccacttgcgataatactagaggtaagaaacaggaagagtaaacagctccaaataaggaattgtccccaaattgcccctgtacatgttgacaaacaccccaaatcaggagtaaatacaagatcactaccagccgggcgcggtggctcattcctgtattccctgcaatttaggaggccaaggcagatggatcacctgaggctgggagttcgagaccagccaacacagagaaaccccatctctactaaaaatacaaaaattagcagggcatggtggcacatgcctgtaatcccatctactcaggaggttgatgcaggagaattgcttgaacccagaggtggaggttgtggtgagccaagattgcaccattacactccagcctgggcaacaagaccaaaactccatctcaaaataaataaataaataaataaataaataaatcactaccttcggacacaaatgaaatttccttcagaacaggaaatttcctccaaccaattactcagattggaagcaaataagagagcaataaaaatccatctgcaacacttgttagtcaaatagagaccaaatggtgaaaaatacaccagtactctggttaattggcccaaattttgagtgagtttcatgcttagtacatactttccgcttgcacttatcacatcttgggtaacagatttgtgaatcaactacaggtattcccagagaaccataattatgataatgatatagccattaggagtagctacttctgcatcatcttaatgttttcttttcaacacacatatattgagtatccattatctgttaaaagtagaattcagagatgaatgaaacaccacaatccctgaatttaaagaatattctatggggaaaagggcaaataaacaatttaatactatgcatttatatggcatatataaatggtttataaaagtgcttatgaggaagtcaccaaaatccctagaaaatgtttatgaagattataatgttttagatacatcttatagaagatttcaccagataaaaactaaaggaagactattccaataagagagagtagcataaacagtgatttaaagtcagctagaaaatggcttgttcggggaataataaataataaatacttacagtgtggctgtattgcaggtatgcatagcatcttggttagtaagtgcaagtaatgacaaaagggtagatttaagccagatggtaaataatctttgtatcaagttgaattctttgtccttcatggcctcgcttaaagcatctgccaagtcttatacaatatgactctaccaactttatcactacccttaaccatcacttctgctggaaacttagggtgatcaccttttcctagaatagccaactcataagccagatagcaacctataagatggcatggaaaaaaaatcagaattttattctctagaattttaaacagaaaactatcaaaagaatgaactgattttcagtacaactaagacagtcacaaggtagcatgtaggcattgaagataacatgtaaagccaactccatggcgagcaaaaaccatgaataagctagagctgtgaggcagaacagaggtgaacacaagacaggtgacgtggagaaaagcaaagtggcagagcactgaaatgaagctatggatgcctctccagtttggtttccgctcttcttgaaaaccaattgtttgcctttaacaaaaatataaacaaaatgacaaccttgtgcgtcatgacaatgagtcgctatttaaccagaggtcacagtgagctattcatgggatttaaagaagacagcaacgtaagcaattttagatagtatattgggaaagtagtaagaccattctgaagttgccctttgagccattccactgaggcctaaccaaatttcaaacaagaaggaagcaataattcttttgtttaccttgttacttgaaggggaataactttctacttaaaatattatgctagccatgtggaagatagattatgtgtgctagaatattagtaatttctttccttttcagagccaattatgcacgtttcagttacttaagggaaagtctgtataattcaacattaataaagaccgttctatacatttccaacagtaggaggaacttaaaagaattgttttgcccatggcaaagaatgccatgcattaaattcaagttaataaaaaatttgtatagttcccaatattagtaaggattacttttggatggcgagatcatggttcatgttttataataaatatatatcactattataatgcaaagaaaacaaacttagagaataattgaagacttgtttgtttcctttctatttaacaaaacagattttaagtcctagtggtctagttaaatctatatgaggttaggaaaaaagttatataaagtgtcaactactgtttttcacattgtacaaaaacattgatttgacttcaaagaagacagaatgattataagaaatagactaatctcaaaggatctaggctctactcaaagtcttgtatctgtgtcgtatattaattgaaccagttacttcatctctctggtctacatttttaaatctgtaaaatgtgaattggacaaaataatctcaaaatcccaattacgtgagtctcttaagcctttatgtcactactacttggtattactacaatattttccaagtttaacttgcaaagcttgtaagccacttgaaattatgtaaaacctctcaagtcgtttagaactacccacagaaaatatataaagcctaagaatcaggactaatggcctgaacatataatgacatgtttaactgttttggtttctctaggcagaagcctagagtatttcaaaaggaaaacacaatgattgaaaattgaatacactaaatcaaaaatattttcatgactttaactaaatagaaaaagtctggcctcaaatatagccaatgaagagaagaaattttacattactattaccagattttgcatacaggcccatactgcatcatcagaagattacagatttggattatacataagtggttgcctatttgaagtttaaatttacttgtaaacctctacttcctagagttgtaaacacacactcaccctcacacaccacaccaccaccagaaccatacacatatgtatcaaattcaggttttctagttttttactataaaataacaaatacaaatttgaaaatagcaaagtattccaaagcataaatgataataattaaaaacaaaatcttgatacaaaaaagtaggaaaatgaatacagataccaatagggtatagtttgtttcttttaaaagtttacataaaattctattctatttcattaaaaattaaaagttcttttttttagaagaaacattgggctcaggaaaattaaacacctgtaagatattgaaaacatttaagtttgcaaagttataataaatacaaagtataagatgccaaagcaaatttagtgtgcatgaacacaacaccaggaagagtcatcctatttccaccaaatacattccctcaatatctatagtaagatataacccccaagaacggtagtaaaaaatattttttcctagcatttttggaggctgctgggcttgctgatattagcaggttggtctaggctaaaaggaggatgtgggagaaacctcatcaaagtgatgattcaaaattcataaataaatgaacacacgggggaacattttaatcactcccacagtagagtaaatgaaataatggcagacacccttaacgaactatacagccaaggaagccacaagtaaatacaatatatccaagcttcttccaatttaaaagttgtattaagaaatgcgtacataggccgggcgcggtggctcatgcctgtaatcccagcactttgggaggccgaggcgggcggatcacgaggtcaggagatcgagaccatcttggttaacacggtgaaaccccgtctctactaaaaatacaaaaaattagccgggcgctgtggcaggcgcctgtagtcccagctactcgggaggctgaggcaggagaatggcgtgaacccgggaggcggagcttgcagtgagccgagatcgcgccactgcagtccggcctgggcgaaagagcgagactccgtctcaaaaaaaaaaaaaaaaaaaaaaaaaaagaaaaagaaaaaagaaatgagtacatagtaagagaccttaaaatgacactagtgcaaaatacattggaggatatggataacaaaggaggacagcatctcacttttacaaagatcttcagctcccattttcaaccttgggctacagtcttaattcatacggcatccttccagtatcatctgccatgcctgaaatctgtcatgagaaatccatatctgaaacacggcagattgatcgcatgcttttattgtctctttcacgtcaaaactcaagcaatgacaaatgaatacaaatgaggatagagaaaagaggaatgaatgaacaatttctacaaatttttggagaacagaatacatggtagagtcaaggcagctacagtctaagtgcttactgaagggggaccttatgtcgcgccataaaagtcatgagaagcaccagaagtaggggtcacaaaaaagatggggactgatcttcatagagcgagatcaactgccagatttcggtctttaccccaagcaatcaaaagactaccccatccctctaacagaaaagagtttattttctggcaaattcaaacctgaaaagctacactgaagtatactaggcatagcagtgagacttgggactgacaacctaagactaaaatgagaatgtacatgttgaacttggggcacccagcaccctttccctgccttgcccccagaacactggtagcaggtgtacatcttccatgtaggagcggttggcagtcttctctgggtgtgtggggagtggagtctaaatacatgtacctgaagcaagctctctgtctaatcttgctaacacaaaatccaccaccaaaaccttgcccactggcagggtgccttcttttttttttttttttttgagacagagtctcactctgtcccccaggctggagtgcagtggcacgatctcggctcactgcaaactctgcctcccaggttgacgccattctcctgcctcagcctccccagtagctgggactacaggcacctgctaccacggccggagaattttttgtatttttagtagagacagggtttcaccatgttacccaggatggtctcgatctcctgacctcatgatctgccctccggcagggtactttctatcagtttttagtgattcactcattaatatgaatgaacacagaagaatcttaaccgtagagaaacgcctccaacatgaaatgggccaacacgaactggctaaattacctcagaagaagtagtggcaccgcagcaagcagtataccaccaaaaaaaaaaaaaaaactgcaaataatatcctcacagtgagaaaaaatggcacatccatgagagtaacagtatgctatgaagaaggggcaaaaagataacttaaaaagagctcatggagctaaccaatatgatcacctaaattaggatgggagttgggggatcagcaaactgtttctgtaaaaggccacgtagtaaatattctaagttgcaggatttgccatctctcaactctgccattgtagcttgaagacaaccatagacaatgcataaaagaatgcacatgaatgtttctttatttacaaaaacttaattttatttatattgcttgacccagtggtatcattgctggatttgattgtgccataatcttctgacatctggccaaaatttgtaataaataaataaaagattggatcataaagcatagacattactctgtaggatggaaagagataaagagatggaaaataggaaagaaaaaccaaaggatcaatccaggaaatccaaaatttgtccaatagaagtttcagagaaagagaacaaagaaaaatgtggagagatcattttttgaaacatacaatacatttgtatagaactgaaggacacgtctccatatttaaaaagctcactgactgcccaaaaactaacgaaaaaaaaaaaaaagcacgaaccaaagtatatctgtaaacaatttccgaataccaggagggaagaaagtatcatacagaggaaaaaaatagatcatacacaaagaaataagaatcagaatattgtctgattctctacagtgacagtggtatgggaagacagtaattcaatgtctcaaagattctgagggaaaattatttaccacccagaattatattacagcaatctatcaatcagtaatactggactaaaaaacttagacatgaaatttttatttcacatgcaccctttcctaaaaatctattagtggaaggtgcttcaacaaaatgagtggtaaactaagaaaataaatacatggaatccaggaaatagggatcctgttctggaaaatggtgaagtactaggtacatagctagaattggatattggagccaagaaatggagtgctgcaggcaaataggattatctgaaatgcctgagtgtttggaaagcttcggcatttgacatatatatatatataatatatatatatacacacacacacatatatacatatatacattttttttttttttttagatggagcctcgctctgtagccaggctggagtgccgtggtgcaatcttagctcactgcaacctctgcctcccgagttcaagcgattctcctgcctcagcatcctgagtagctgggactacaggcgcctgccaccacgcccagataattgttgtatttttagtagagatgggatttcaccatgttggccaggatggtctcaatctcttgacctggtgatctgctcaccttggcctcccaaagtgggctgggattacaggtttgaactactgtgcccagtccttgacatatatttttaaatgttgggacaaacaacaagccctagatacagacaaaaaagcaaatgtaaaagaggtagagagagaaagaaaataggaacaatccttaaactgcaagaaaagcaaaacgctgaatgagaatggcaacacagtctagtacaccacttaattcatcagtgtctttgtttacacagtgattgtgagtcatatcgcctatttatttaatactgtaataataacatattaacatgggaagcagggagagtaaatgatactgaatcctcagttaaaatagcaagaaattaaaatatcaacaaaattcaaaaatattataagaattaaacagtagctaaaataaaatgattgcacctaaaaagagtaattggtaagaaattgagagggaagagcaaggatgaatgtttttaatacaggccttttctcctatttgctttttaagctacagtatgtgcataaaatgcagttctctgtgcttccttaatactttccatttctcagactcacctattaaatttcaagaatcctgagaaagctaatactataagccattatcagctaataccataggattcatttgttgataagtggaaaaatgtccaaaaagaactgggtcaccacaggcacctggagacaaagtggaaatgaaagaaaatcagtaaggaagaggtaaggaggtgctggggggaaattgaattgcaggacactcagttgatgtccagagagttggagaattggttggtatggaaaaactccacaccctggtgtcagaagtgtggagtatataaaaaaacaattttcttttcctttttaatggtggccaatgaaaacccaaaaggagattacatctaaggtgacaggattatgtgagttgctccctacttgctctccaacgtcaacaactcagaaagggatttttctggccacagtatcaaatggtcattgccctcatccttgttagtcttcttcacagcacttattactagttgacattgcagtgtgtagctatttttattttttaccatctcatcaacaagaatgcaagaagtcctccagtggaaggcactttgtcttattcactactgtatccccagcacgaagaacagtgtaagagtttaataaatactcattgaataaacaagttaattttatttttattaaggatctgtggcatttgctacccgggactaagtaaatttttgctcgagttacaatattggcacatgggggctctgctgttagttgcaagagtatcctaagcattccccaacattcttaagggaactgttcaactgggaatggccacagctacagctaccaagtactaacagtataaggaaggatcctctggtttgacatataggctgatatattttagagtaatataaggacccacagactcctgttctctgctacttcattgcaaactatgcagggattctcatttgtcagaagtttaatatctttcagatctgggccctaaaataaaaacgtttttaaatcagacattgtttcagaaacaaaaataaaaccaacctatggcatagctgtttctttatcaaaatcaagattgtctattatctttctcctcctggtgactggggaatttaattcctaatgctgatataattgccaggaagtcgaattttaaaacacaccagtgtatccagttgaaactattatatacagtgctttaaaaatacaatatgaaattttcttcaaaaactcttgtcacatcagaatacatgtgaagtggatatagcaaaatgttatgataccatttaaagaacactgactgactttacattcaaagcacagtcatagatgcaaagtaaaacatcaaatattaaggtataaatttggttaagaggtttttatagtccctctaaaagtcttttctccactgtgagaaaatacaggaaatttaggaatatatataaaactagacgttttacaatgtgactctggtgccacatgtttcttgatggaatttgttctgaaagaaaagctagaaaactgatttctctcagcttaagtgactacaaatgaattttgattgctatcctattaataagaattttttgtgcctcagttagatgaacacttcaatggcaatacaaaaattagcagatttatttagcaagtaccaacaacaaataattgctgttgctaagggtaaaaaggcaattgtgatgggatgtgaagaacagaaatcctggtgatatgaatgttaaccaataaagttctcaaacttgccatttagcgcattcctgaattctctgatggcataaataccacaaagtagaagtacaactttactctaagctctaagtcctgtattactcaaaagttcttcaaatcttaaactgctaccaagaatgaatagatgccccaaatatccactttggggctggatattctgctcaaattaatgaatagactcttgttaaacatatatgccatgaaaactgactatgtgcaagttaaagcctacaatgggaaaaccaccaaatgcagaacatggaaaaagctaaagtccaaatgacgtggcatccaacacatcaatggcattacaaaatgaaagagacttcaaatacatcaaaaacaaatgcaatgtgtgggctttttctaagatcttgatacgaacaaacctacttgaagaacttgttaattttattaggtataataatgctagatggttaaattaaaaggctgttaggaatgcatcctgaaatgtgcatgtgtgtagatagataaatagagagagagagagaggttataaagacatatgttggctgggtgcggtggctcatgcctgtaatcccagcactttgggaggctgaggcgggcagatcacaaggtcaggagattgagaccatcctggctaacacggtgaaaccctgtctctactaaaaatacaaaaaattagccgggcgtggtggcaggcacctgtagtcccagctacctgggaggctgaggcccaagaatcacttcaacccgggaggcagaggttgctgtgagccgggatcgtgccactgaactccagcctgggtgacagagcgagactctgtcttaaaaaaaaaaaaaaaaaaaaagacatatgttgaagatttgcttttaaaatactccagaaagaaaaaaatattgcacttatgtgggaagaggtgtgagtatcgacgaaataaaattagcaaaatagtaataatttttggagttgatatttattatactagcctctcaacttttgcgtatgctttacctttcctactgaaaggaagaaaaaaaagtatttccttgaagtcatatagtcttttcagccttcataagtctgccactgaagtttatagtgttggctagatttctgtattcccatatttaccttaggactacctttgcaggaagtgacagtgaggaatgcaataaaacctgagaatatggattgacgctgctgcataaatgtatcttcaggtgaatgggagggagacatgttggataaccttgcaatgtctcattcattaaatttgtcttttcccagaaagacactgagagaccattttaatggtcagacctggaatattctttattcatttatctaagtcagagatattcactcataaccatatgtgaccagacagggtttttaatggagcccttaaagcaagcagatggaaatcaaggatatttcagggaagtgttaatgctctgatgaagatctggatataattacaaatgtagacatgcatatgagtattctaactagaaatgaagaaaattattttcacagctgtaggaaactctatattggcattctgacaaccctgatatattgttgggtcacaaacattaaactctttacaaaagctaaatcaaatgcgtctattggtgaaagtactttataagcgaatacacagaatatcaatggtgtattctgtataataaatggttgtggtattaaaattagtagaaaagaaatactgaggaatgtttcctataatattagtaaattctggcatgtccttggtcatgttcatgacccttgataacccttaatatatgctcatggccacagaacctatacagaatcaagggaaaattaattttgtcatagatactctgattgcagaaatatctgtaacactttataaatattgtacaatgtacttactcataaatcatgaaaatggttcctaagtaaaaatccttaaaagtttataagtcaggttttataagtcccattttgcagatgagcaaactgagacccaaagaagtttgcacagaatcagttccaaattccaaatgtcaactgacatatgcaataaacagtacatgtgttgagtccaaatgtttccttacctagtctttatgcaatctcgcatttagattttcatcaaatcttttggctctactgccctccaaggccatatgcaaagatgttgcctctgtctagttcatttgaatggaaatccatttgctattgtttgggggctaattttgcaaatcatttcataactttctgttcaaaaactacctttaaaatatttaaaaatatatcatggtgctttgaggcttaagattaagaaatattttcaagaactaaagtctcataaaaatgaaggaaagcaagagccaaatccagatttaatccaaatgtgttaaactcttggtcttgctcacaaaatgtgacccacgaaaacagttatggcttcaccatccctagggttgcttagccaataaaaatgaaccatctttactttccctctttatttcatacctccacttctatttccttagaaaagttctgttgattttattgtaaatatatcccgaatctaaccaatgctcaccacttccactgctaacaccctggcccaaacaccatcatctatctcctggattgatatggtggcctcgttactgtgtcccctgctaagagtgatcatctcagtcagtctgtgcttctataaacaaaaatactatatcctgggtggtttaaacagtaagcatttatttctcacagttctaatggctgggaagtccaaaatgaaggtaacagaagacctgatgtcaaagacagcctgatttctggcttcttaatagctgccttctcttgtagcagagagagagaagaagcaagctctctcatttctgtctctttttatccttataatcccactgatctgtcatgagggctccaataccatgacctaattacctcacaaatgctctatctccaaataccatcacattgggaattggggtttcaatatatggcttttggggacggtaaatgagaacatccgatccacagcagtgatccttttaataggttatttgatcacatactaactctgcacaaaaatctccagttagctccccgttttctccataataaagccagtattcttagaatgtcatccaaagccctccatgacctccatctccaattattctatcacttggtctctccattctagactcattggcctccttgttgttcatggaacacatgatctgcttccacattaggcctttgcactggccactccccatatatacatttaagtctcacaagctcatatccttcaaggtttgctcaggccagtttcttaatggccctaaccatcctatttaaaactcagcccacctcataccttgcactcccaatcttccttatatttttcttttttttcatagtacatatgacctactaatatactgtatatgtttatttttaattgtctgtcttatccctttagaatgtaatcttcacaagggtacaggcctttattttgcacacagatgtattcccagtgtctggaacagtgtttagcacacaatggttattcaaattaaatatttgtaaaataaataaaatatctgaagtcaacaactgttaagatatcagtccattctctttcagttatgaatttctaagtttatatctggcaactcagtttcatattggactaaaatttggcagtattgccaaactgagatttgatttatttacccaatttaaacaaaatatgtttagctatttgaagtcctataagcacaataaaataaaaagtctttagatacatgacactatttttataattgtataaatcattaaggccctggatgcattggggatatttaactcgtcaggtagtttacggtttgttctgtatgcgatattaagtgcaaaagaagttgctagtttctaaatacataatgcaatataattttgcttctgctgaaaggcaaatcagaaataatcagctcgctatagtcgacaagtaaaaggagaaaaaacttttaaaaagtatacaggcaaattactaaaatcttttagaacacagtcttttctttttctcttgagggactactctatgtctttgcagtaacttctgcagcctcaagtattcagtgtggcttagaatcacattattttgttttggatttctcaactagcctcatggataatcttccctcttcaaacaatttattatcctgaaccagatcagacctggttgtgatgccgacttaaggggtcgtgccaaagtaggggccatacacagttcctggaggctgactcagtccaagagtggctactgattactgttgagaaagagattgatggtcagtatttttttccttaatattatttcattatgaacatttttccttgtcaatcaatacattgctaccaaagcaatttttgttgtagcacatcattcctgtcatatagttttgttttatttttattttattttttatttttgtgggtacatagtaagtgtgcatgtttatggggtacatgagatgttttgatataggcatgcaatgtgtaataatcacataagggtaagtgtggtatccatgcccttaagcatttacgctttgtataaaaaacaatccaattatacttttagttatttttaaatgcacaattaattcattattgactatagtcaccccattgtgctagccaatactaggtcttatttactcactctaatattttataccctcagttgttagtattaagactaaataaatattaatcataagatccaaagggtaggtgtaaagtcagaactatgcagtaagataagatcaggaaccaagataaaagaaaaatgtctgaaaactaagagcaatgtgtgtaacacagcagagaataatattcaccgtaaataattcaagaagatttatcccaggaaaagcaaagtgagagcccacattctcagtgggttcctctgttcttctgtcaatgggaagtaaagtatgatgagcaagaagcacaaagttaatgggtcctccagcctcctggagtggctctctgcagctcttgggcaaaacagatgtctcaatgactacgtgggagagtgaggggaaaactcagagcctttcaagcaacagaggtgtgagagagaagttatcaatataattctcattagtctgtttttgagagatacaagttgtcaagcccatttgggatattaaatgataagggttcagtattacccttctgtgctgtgcaaaggagaatagtcaaaagcatatttactgttctcatgaaatttgtagtttaactatgaagacaagatatctgtgaaaagtaaagatcactttctgatcaactaagttttctcactttctagtttttgtctttgtatatacctcctttaagaatactttctccaaaattgtttccagtctcactgactgaggaaattttcaggactcaatcccatgtacaaatgttgaacattacataatcagttatactatatccattgtacttgtgactgatataaaaacatatttttttcaatagctatttattgcatgtctgcaatgtgccaagtgctgttgtagatattaggaaaaatgaagtagacaaaacattgtctttgtccttgtggaacttacatctcagtattataagtgtgcaaaccctctcttcctactaggagaaaatattatttttaatcattccttcacagtgagtttcttaaacttatttcatcagagactattgaaaagcacacactcttccatccccctagaatgagaatcctgggggagggattgggcagtctatctttttaagaaactcactggatgtttcatgtgcattcacagcttaggtaactctgggggaaagcactgccctattaagaacatactgcccaaggaattggtaatatccattgtactatatctgtaggaccccttttgattgtcattactagcctttatcaaacatctcatccttggagaatgtgaaagctctccacggttttccacagacagttcacctaacaaaaaacaacaaggcaaactttttcaagaataccattatttttaaataaaatgcctctacatggcagatgttattatgttctactttggagatgaaaagaatcgaacattattagtcatgatccacagaaccagaagatttattttaaagataaagttcagatgatgaacataaaggaagttatctcatcaaagaaggcaagactgagtaaatctcagaaatccaccatgtacaatatttaaaaatgctcactaaagttgttctttgtgagttaatgaaggtcagtatagtcaatattcagtacgtaatcctagcaagtacaaataaagttaatattattcaaatatcttacacaggcttattgcatgcaacacactgttctaagtaacatacagatattaaaatgacttaattctcaaaacatgaagtgagtttttgtttttatgcccgttttgcagatgagaaaactgaggcatagggaaggtaagtaacgcgcttaaggttacatagctggtaaattgtagccaggagttggaatctaggtgccaaaatctatgctgttaatcactaaactacgctgccttagtttttatacttctttaggaacctcagaccaaaagaaatttaggcaattctaatagaacaagcaagaatttgctaatcacagcttccttgccccaatcctttaatcggcttcattttcactgacttcttttttaaatgaagataacaatgttgttgaacaggatcatctagtggttagtggttcggcataagaatgactcgcttctgaagctcagctctagcactcgcttgctgtatgaccttgagaaagttacctccccaagtctgtttcctcatctttaaaagagaggttataataggacccacatcatactattgtttaaagagaaaacaacgtagcccatttaaagcacttagaaagtgctccataaatattattagtgtaataaatagcagcaacatcaataaagtatgaaccaaatgatctcttgattcgtatcctaacactaaaaatggtttatttcccttctaattaaaagagaattacaacaaccaaaacaacaaacgaaactatagccataaaatcaattatatcgtctgtgagaaaaccggaaaggctattggacacattaattcacttgtcatcagtcatcccctctattccaaaatgtttgtgttctaacatcctgagacaccttgcataatataatcactgtgactccaagaggtcaaatgggcaggcagttaatgcttctctgtgaaaagctcaataattcattttataaatttcagtttaaagcctgcgttgaggttaagaaaaattgacgttcggtctgtgaacttaatgtcaagctccagaaaaactctgggcagcacatgtttagcaattaagtggacacagacaataaagacgttgccaaattgtaaaacaagacttggaaatcacagaaaatgttgctagttattgatcacggtgaccattcagttcctactgagccacccaaaagaatcattcattttccagcagagagcctgctcatttgcaagataaaagagagacatttctgcacatgcccataatgttcttcaccactgggggcagctttacataagactgcattcactgaaaccaaagcaacagtccgagcagctttcagaatgacagtctgcagaagtgagctgagcgtgtgcgcggtacggggctctcctgccttctgggctccaacgcagctctgtggctgaactgggtgctcatcacgggaactgctggggtatggaatacagatgtggcagctcaggtagccccaaattgcctggaagaatacatcatgtttttcgataagaagaaattgtaggatccagttttttttttaaccgccccctccccaccccccaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtatgttttgtcatttttcttctttccttcttaaaaacaaaaaacaaaaaacctctagtgtgtgtaataattctgccttaattattttagagattaccttgctctgctctaagactatgaatttatttgcttagtggcatgtttccttgtttaactatttaaaaaaacaaaacactaaagacaattctctttaattacaaagagataatatgtgatgttaagtgttatttagatttaaatttttaaaaatgaaaaatatatgcctatttttgcttgattaaggattaattcttttttggggggataacttttctaagttgtttttatttccaggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgaggtatgaaccattgtgataaaaagagctcttaaaagctgggaaataagtggtgctttattgaactctggtgactatcaagggaacgcgatgccccccctccccttccctctccctctcactttgctggcaagatccttccttgtccgttttagtgcattcataatactggtcattttcctctcatacataatcaacccattgaaatttaaataccacaatcaatgtgaagcttgaactccggtttaatataatacctattgtataagaccctttactgattccattaatgtcgcatttgttttaagataaaacttctttcataagtaatcccccacattcgctgttagcctcctggtgggaccaaatctacagttatagaaggtttgcacctcactggcaaatcaaggaaagaggtgaatgattccaggtgctcggagcttgagctgattcttggagatgactcagttatgggaacattttacagacaggcagagcctttaaaccaatgcctgacttagaaaagaaaattgcaggaaactatcaaaagatggtgctaggttaaagcagcaccctgagcagtttccagaggtgtctgaattacagtaaggcaagcacagggacaaagtgatgaagggttaaaatactgcaagcagacaactgcaaaatgtgaggagatgacaaaaatgtaaagttttcgactcagccttgtctctgaaacccatctctgtaaaatcagactagaggtttcactgccaatttcttctagcctgtatgtttcataaataaataaatgaaacagcattgagaagccagatttctccaccacacctcacattagttagggagttttcagataaggttcgcgaatgggaaagcagcttgctacaggcatgtggttgagagcttaccagaatttctctttccagttttttcgaagaccctaatgtagttagtagaatccttagctctgtcctgttctgttcagaatttgtcaggctgccctgttgtgttccattacatgtcctgcacacaccagtcccctaatgacagacacttcattcagatgtgtaaagagaacacattccaagacgtgccttccacccacagcctcattgaaaaggacgactttgataacaccttaataaatgtataaaacgaatcttagaggaaaaaagaccaacactatgacagttctctgttgcttttctattgctgacattacaatgtccctgcgttcatctgtattgtgaactcatccatcagtacagttctgtacagaccctgttggcaatctgcaagctgcatgcatgtttttatgtcattggtgaaagtttattgactgcagcacgaatatcatagcttccatatttgagtaacttgaaccacagtcaattaaggtttttagaaagatatatttagtctgtattctccttcatcctccaaaatgaacagttctattatagaagcaaatatcaggaactgcaacattgaggctgtttcatttaatttggcttgccaacccctacatctttaaccatgtccctcttctctgaaaacagaatcactgcagcaacaaagaaaaagtgaatggctatttttactaatttttttttattgtttgggggtttttcatatgctgagaggaaaaatctaggcaagtcaccataaaataaaattttaaggatgccagatcattaaaatcatacttttataagcaataaagaaaaagaaatagttaaagtggatttctcaaggtactttgatattgattaaatcttacaatagatgccacttcagaaaaacatcttagttacaatgtttacccatgaataattgttgaatatacatgtattcatgacaaaaagtcacatatttccaatggattaataatgcagatacttcctcacagcttactggatgactgagcttattgtgatttttttactgaagttgtaactttacatttttcataaagcatcagtaaatacatattccatcttaaaaagaaattttctttggctagcctcatttttatctgtactaaagatgtttgtattaatgaaatgcagtcttaaagtgaagaaccccatttctattctttttcacttaaccttctgccttacttgtgatggataccaaatatatttaggcaaggaatacttatatttttgaattattgcaaattctcaatgccatggtgctactagtatatataaaatatgcttgctgtattgaaaagcattcctaaaattcaaagctacttggaatataaaatatgatataacactaaatgaatcaccaatattttgaaagctgtcactttttaatgcctaactttactaataaacataataatagataagaacgaaaataaaatcccttaggtggtaaaactcattttgatttgggacatgaaattatgggaaaaaagttctttctttctcctcactctttgagaatgaatcttctgtaattctcagtatcttctgagcacagatatataattcttgtagatttaataactagtttaccactgtaaattttaaaacgccaactgccagtctcctgctcaaaagttgttgcctcacctccatcccatggtactttctggactacatatcataaatctatttgtataagtatttcaagttcatgcagattagagaaatgtgattgatatttatttttctagtacgtatttacataaaatattggacttccctcaaaggtgacaacagttaaaaaaaaaaaaaaaaaaagcctgacctgttgaactatacaacagaacacagaatactttgctttaccaaaacagagaagaaatgggatttagtctctaaacttcatgtgagtttttttccatttttattaaccccagtacacatagtgctaccacagcatgtagttaaatagtcccagtgccacagtcttgtaagcaatacttatgcaagatatattgcattgaaatgagtttgtattttccaaggacgttgacattacatcttttcaaagaatttaaacaattttttacttgatttggtgagtgaactacctaagtagacaggcagtaaattgtctttctatggagcagcagtgacctctagtgtctggttagactaaccacagctattcacacattttagctttttatcctgaatccttatgtaaacgtggtttacaacatgttttttgactagtaaatcagatttgaattttatttaattcatttccttgggaaatataattataatgtaatttttgaatgttatacttttcattttgacttttatagtaatgctggaacagaggccatagaattggtactgaaggctagaaataagtgtccaagatgaaaagcgagtaataacgcaataagaatagataagaaatattttagagtgcttatactcatcgatgctggctaagcattttgatatttttattaaaggggttaatatttttcatcagcaagatacatgtaatttaggtaggaaaaacaaattttaatattatatcaaaagagtcagcatcagtcatttactggtcagggatatgtcaaaggtgtcaaaggaggggggcctccccttccggctttagaactctccagtttgctgattgtgccagtgacctgtgctttgcctcagcgctttctccctccctcccccttttcagccagctgaacactggttctattaggctctctgacaatgatgttacagtctaagaggtgatgattcatggataatgaaattatgctctccttctggggaaggataatgcagagtcagattcatggatttggcaagaggttttaggatgctgtaggtgcatgaaatatctcttcttcccttgacatttaccaaaatgagaactcaaatcgtttatttaaagtgtggattagactgcatcagaaacaagcatcaggtcatgaagcctgagataaagtgagttccagacatggcaagtaagaatcgagccatgagaaataaaaaattcagaatctgtgttgcttcatctattcctttttgctctggattctcattagaatccagatctgtagctaacccacggagttttgctattgttgtattctcctagctacctacactaaaaatcagaggcagttgggggaaacaatgagcacaacagaatatataggtaaatttgaatgacacaagttttaagagaaataaaatggatggatgttaaatagtttgtatcaaatagctctaattaaaaatgaattaaagaaataataataatacataggtgaaagtcactgctttcctaatcataatagcctacagaattggacccaaattcttttagcctccaaaagttggtgatgattttggatacttaatactaccaataaaatctaaataacaataatttatgattcttttgcatttgagggaaatatcacagccaggcatggtagaatacgggccttagaaattaagacctaaattcaagttcctttgacacttgctaatcaagtcatcacaggtacatttcctggcttttctgaatttgaagtttctcatatgtaacacagatgtgtactattgactgctcatggtaattgggaggacgaaatgtgaaaagtactttgtaaactctaaaatggcaactacctcttcttttcaaaaagcccttagtgagatactgagtggggtttgttgttctatgtttggcatgagccaaaaagaaatcagtaacctccatgttacagaaccccaagcccattttacatcattagaagtctagaacatcgtctttgactttctgttttcacataggcacagcttcttccacctcatgttatctaagtctatgatttttatactgattatcacaatgtacaacagacataaagacaccgaccagcgaacactaaaacaaataattatcaaacacattgaaaattctacttgtatttcagatcaggcaactatagcaagggctttcaatcaggacgtttacctgtccactccctttctagtatcattgtgttcaatccttgttgactttacactggatcaatataatgtttatatggcaacatgacatcattattgagcaaaaagtaattgcatataacatgttactgtaggattagcacgcattccaggtatcagtcacatgatatctgctctgatgtttctcccctggccactccagtggaagactgtgcccaagatctcctcttagtatagaaattactattgactttatcaattataattattgaaaaatcactggataaaaaggggtataaatgtacagggacttccttttatatgtcattgcttatgcaaaattacatcattaattcatcaaagaatgacaaaaggcttcctccgctggatgtagctgctcttaccaatatgaagtagcaggtgtattttcaaaatgtttgtcatttaagaagacacagactgttcctctttgacagctgagttcctatggcatatctaaagatcagagagaggatgatggtttttcaggtggggaagcagttgtgagttttctgacattttaacttcatagggtcatgaatggacgctcttgagttagggatcctgaacacgtgaggaaaattccaggaacacagagagaacaggaatatctgggacatgatataagaccaagcaagtacaatgtattttacaattatactttctaacaacagaacttctataagcaataataatccattttattgaaaaaaaagaaaaacagcttctatcttatcctttccagcaaatgttgtaatgataattaataactttattaacaattctccatgttttctttttatttttaagggctctcacttctcccaatcaggattctcatttatcctttctctcactcttaaattgttctccttatttgaaagagtctgtaattcctatatcaccaaaaaatgtcttcctttataaaccaacacaattcagtcatttggctcaaaagagcagcattatctccaaaagaaaagttacacacttgcattaaatattaggacataaaacaaatttaaagctggctgacacttctctttcctctacaatctataaaacacctctacagtatattatgatttgcaattgaaaaaacaggatatatagttgaattacagtcttacaaagtattaaagcttactgttttcctccttaattagctaattcctagaaaacaaagtataggactttatgtataggggtactcaactatatttcaccaatcagaaacactctttccaacaatcagaattttgtcttctcaagggtaaaatatagtttttttggcctggcatataaaatagtaaggcaaatactacatttagcaaaggcaatttttgttgacatttcatcacatcaattacatctatgcagggtggaaaatacattttgtcagtaaggaggcaatgacttcaattaaatgtaaatccttagtcagcattcttggtgctaaagcttattaatgaagtgggagcagaatgaaaatgtcatcagacagtgaagctacagtatcatgaggctatgctaccttgagtggtgttcatagcttcaactgggtggccctcatgtagctaaaaaagtgctccttgtcattaatattgatctatgtactttctaaaagaaagaatatgcttaccaacagagccctcatattgactgtcttcctataagtttccctcattaatatttgatgcagtcaaccagaatctcacaagagctttaaaggaaacttgtagaatgcatcatgttgatattgaaaaagtagagtagcttttaaaattctgataaatgtgtgacaagattacaacagtgaaacctctctaaggtacaacagtgaaaatagttataacggtgaaaactctaggaagtttaccatagtgaaaactctccaagaagtttaaaattcagcgctttgagattagtgttggcatgtacttgtcaatttatgaaagggattttgcctaatgtattcaaaattttaatgtgaaaggtataaatacttggtttgtgtactggcaccaatagagggttaggtaacatcactgaattatgattaaaatggaatatttaaagatctttctaatatggcagaggacatattacatacgtatttgtatttccaccaaggtacgtatgttgtacatgcctaaaaaaatatatatatattttcctattaggtgaatatttttcctataatgtgaagatattttggtataattgagtccttattatgtaccaggaatttgtatatattatctaatgatttgataaaaagtgttttatgcgtttcgtaaactcagatagttttccttaaaatataagaacagagccctttatattgagtctgtcttcctgtaagtttcactcattaatcctatacattttcacttctttataggactgctctaaaataatttataccccacccacaaaaggcttctcaaagccaaatcatgcatctccagatccctttaggaaataatttccgatgatttaccattagaacatccctctgctagttaaagtctaatctgccagtatagtgttccttccagcctgtggcacccactccagcctatctcatgtcattcattaaaaagcagtaagtgtttagtcttttggacttttacagggaggactaagtaataaaatgtaaaaatctacatatatttttatgggctttactctggtcacttttatggtctaacacacacagatgtgtggagtctttattagtttacactaaaatgcaagagcattaagctagatatagacgaaaagagaaagtcaaagtagatttcaaaatagccaaaagctcacattatacgtttcttaatgttaaaaaaaaaatcccaaatgatggagatcctgtaattcactttcttgaaagctaatttaccctcctctaagtttgccatcacattcttaaatttaagctgacattccttctattttcctatttctaataggttttcctggtgtttttttgtttgtttgttttttggttgttctgttttgtttctctgttgttttctgcctgcagatcttaattctttgagtgcactgccttgcctgtttttctagaattcccaatcaaatgttgatcctgtcagaaagtcacagggtcagtttcatggttggagtcatcggacagatggactagattgaactctacagcgcaatctagtcaactctgagatgtctgccttgtgtcttctcagcatcccatttccatgtattttctctatttggaagtagtatccatattgaaattcctccatccagtggtgcccagagctttcttggtttcttatgcgttatcaaatatctgctcccagagtgagagcaggattactgtcccttccaagggcactcacctttaaatagagatgaaagtcttcagctaaaggtaagaaagttatatattaagagcaggcatagccagcagggttggggaaagttcttcttaggcaaagacctttgtaaagcactctgaaatcatcctctatagattcctcagtatttttctcaaacatgagtttgggcctttccaaaggagccaaggcagggtaaataatccatgtttcattcaataaactatatttgagaatttttttttcagtgaatcgccattatacaaagtctttctccttaaatttttttcatggagagacaactttgtataccagaaagaacttggactatggatccagtttgaattctgtttctgggattttagtaactgtgaaaccttgagtctcaacatcgtcatcctaataaaaatgtgtaaaacaatgtagttatcatgggattgttgcaagaaggcaaagaatcagcatttgttaaatatttttcctggtacatttcatatataatctaatactcataaagatcctatgaagattcaatgagatgatgtagataaaatcatttaatacaaaggttggcacataatactttctccttcccttcattagttccaactgctaaaaatctcagtaccacaatgcgctttgaaagtcatattacactacctatttttattttgaataacagactcctggtggactttccggaaatagaatctaaatttccataagctcaagggcatctgggcacgtagttaatactgaagagtgatggtagtacataaaaccaatgtcctcagcctcccaacaaagcccagctacaaccacctttattgccctaccctttcccatgctctaccactggcaggttctcaaagtagcccatgcttcccaatctctgtgcttttgatcaagcaatttcctttgtgagaaatgcccttcctccctcccaagtcctccagtcaatttctgagcttttccagaatagatcaaattctgctcactccagatgtcttattaatcttttccttccctcttttctgttttttttccccctctcccagagactgcatcacagtctaccttatgttagagttattaaggggtttgtatcacgatttgaggaaatggataatctcttcttttccttcttcttccaatggtggctgatacagtcttttatgcatgatagatgttgttgaattgattttctggtcattattatgaagttattattgcaaacaatctacagtaaacatttcaactctatggaaacttaattgtatcaaccttatatttctttgtgtagtcataaaaactttttttagttttaatttaatatacactttttcactatgtacactcttctcatttaccatttaacgggcttcaaaaattatagctgaccactaaacaatgtgagggtcaagagaacaaaccctcccatacagtcaaaaatccatataatattttactcccccagaactactaatagcatattgttgaccagaagccttactgataatataaagagtcaacccatattttatatatgtatcttattctgtattttataataaagtaagctagaaaaatgaaaatattattaagaaaatcataaggaaaagaaaatatatttattattcattaagcgaaatggataatcctaaaggtcttcattcttggcatcttcatgttgagtaggctgaggaggagatagagaagcgatcggtcttgctgtctcagggtggcagagtcggaagataatccacgtgtgagtagactcatgcagctcaaacccatattgtccaaaggttaatcgtattcttaggaaaatacagttttaaaggatcatgttctgatttaaattgcttgtgtgttgtgaataatctaccaatcattttttcctgtgatagttaccaaagctatgaacatttggagggatatgttaaagggaataagagctacaaaaaattgagacaaagaaataatatttaagtctagctgcgaatacaccttcatttttgtagaggctaggtagtcaacgtttgtttaaaagccatacatttgtgatctctccccgtccacatcctcctgagaaaggtcctttgctctttagcttggatgtctccttatctcagccccagttctgcaaggattcagctttagatgcattctgaggcctctcctctcttacccacaccaagggaacaccctacgctatgacagaaactaggtcttggcctctgattttacgcgtttccaaagtaactactctactggaggcctccaacactcagaagctgacaagtagtaatgctcatcttttttacctcctaaaagctgatcatgcagaaggcatgttagatcatacagaactgaagcatcttcccttttctgagtctctcctttcctcccttctgttcattcctttattcctttgcactacatttctttttctctttctcatctccacttaaaatttctttcaatttttctttctatccaacttttaagtcaatccatacaacttggatatatgccttcaaactgagttaaaaggaaaatactaatagttttatctctcatgaaagcaataattaaaatgacaccatctaataatttaatgtaaaaggagggaaaaattctatttgtattcaactcttttgtttgggcctataaatgaagaactataattttgtaaattatagtttaattttagaaataaaaatgacctcttccctaatatattttaagttgcattttaattacaatttgtaaggtagggcagacttacagaccatccatatcccttttcatgtgaagtatctgtcagcctctggaccacagtaaactttgtcattcacagagtggattcttttttggaacatacgtgataaacaaattgaaataaaacttcactttagttataaaaacttgtagttataaggacttttgagaaccttgcagtccattttttttaccttctatttgaaattccaaactaatttcattgtacttgtaacaatcttccaagaactgcaatcctcaagttctctctttgttatccacttcatggtttcactgtggtcactgcatcattttttacccctatacgcatcttgcttaagataaacccagtggttacttaattttttttttaattcttctttgttttcattctttttaaagaggaacagtaaaataagtagttaggttttgtgtttgtttttgctttcagtactggaatctgcttggtccaacttaggtagagaatcttgggctccagagcgcatagtttgaaaagatggaaaacgttgttctgaaatttgcattaatctactttagattcaaaaattccacataggctgggtgtggtaggtggctcatgcctataggcccagcactttgggaggccgaggcaaggaggatcacttgagctctcaagaccagtctggaaacatagcaaggcctcatctctacaaaaaatgaaaaaaaattacctgggtgtgatggcacatgcttggaagctgaagtgggaggactgcttaagcccagggaggatacagtgagcaacgattgcaccactgcactccagcctgagcaacagagcaagatcatgtctcttaaaaaatatatgtatattttgcatagagtgtctcatgatgactgaataaaagaagtccagtggttaactaatctataattaatcatagaagcaagaggtttctgacaaaatgtattcagcagctttaaatatgaaacccacaaattatatttccagaggtcaaatttgcatataactccttgaactatgactatctcctcacattcaactcagttttaagatccagcagtgtgttgtacaaagtaatcaatggctaaattattcccattttgttagctcagttcacagtagcccactgactggtttaaacaaaaaaaaaaacttatctgatcttcagtttgtatttcaactgtacccaagtgcagatgccatctctggtaatatgacaaaacagatttaggtttctaaatgtttctgtatgctccaataacagtatgcagcctgcagtaactatatcgtagctcaaagtgttgtaaaaaaatgcaactgagtttgctgaagaatcattttagagttaattaaaccttctccacctgtaatttaataaaaaaaagaaagcccaacatactcttaaagacgatgggggaaaggcagtttaagaaataaaagtcctctgtttatccagggaggtactttacaaggcagacagctacaccacagtagagagacaatatttcctcagctgagtcggttaattaaaatgcacagttacaacagactttcttagagcctgcagctgaatgactgaagtctccattttactccagtgtcacacagaacatgaagaggcaaacatactgcctgaacacaatttgactcactaaaatccagcactataaacacaaaatacatttctcgagtgcattttaaaagacttattatcaagatttatgacataaggatagaaataatttgcaactaggcactgccaggagaatatcttaggttcctctcaaggtaattttaagtaaaatttacaaataaatcttaaggttagagtccactttgaacgcaggaatcttcacctctttcctttcaactgtatggaatttgaatctgacaaacaacctgtctgttgctagaatttataagtgatctgaaaaaaaatcaaaggccataaaagctatttgtcaaataaactgcagaacacgatatcagtctgcagggctcatttgcagaactcatgatgagcatgggaggaggggatgctaacagctgcagccttgaccgcactgcccgtgccagccagaattcaagccgcgtgagctgagtgtggctgaaagagggagcacacaaatgacatcttagaagacaaaagcaaaaaatgacaaaagaggttcttatatccaagtttttattatatcagtacatcagcatatacagaggatgacctaaaaaaaccactttaagatagatgggccggcagagttttaaaggttttcaaattaagtctgttcgtggaagacttactttgatttcatggtgtaggagggagatcgtagacttcgaatccactagacctgaagttaaataaacctggggtgcagttttggttagcctggtagcacggcatggtatcagtttcctcatctgtaaaatgggaacaatacttcatgtcccagcacaattttgaggataaattgagataacatatgtttgcaggcacagcaggtgtcagtaaaagttagttttctcctgtcgtttgctagatattttcacaatgcagcaagttgattcaagtggtgaagtggaaattctcacattaaacacataaattgccaagtctgcaatatataaaaaatgattaaatgtccttgacgcttaccaatcattattaaatcaaacctgaaaaggatctaccagcaatttgcaagcccgttattaatatcctttaatggacttgctctattaagtattcttctgtaacaatgttgttcagcaacacaacagaaaaattctgttgttagtattgtgtttcttctagtaattcaacatcatttccatttcataaacattacttgaggaattagttccattatcctacaaatctctctttaaaacattgccataatgtctctctctctctctctctctctctctctgtgtgtgtgtatgtgtgtgtgtgtgtctgcgtgtgtgtgcatgtgtctctctctttcccttttttctccttcctcactttctcactctctctttcctttctctaccccaaacatggacatatcacaccttcccatactcagcactcaagagaacatgctattgttattacagtaaaccaaaatggtctgagaacttagtaactattacatttctagtgtgaaataatttaggcatttaaaggaagaaaacacaatatcaatatttatgtttttaaaaattccagtagagtctgtgaaatgatggctaaattaagcaaaagcaaattaatcaaagagttacaaaggaagaattccaatgggcacttaatgagcacctataatgtgcaggcacataggttgacttttctttcttcccagggcaaacaaaatagcttctcagggcaagggatatcagaaatttggagtcacattaataggaaaagcactgagttaattgactggctttggaaatttacttcacaaagcattggattttctcaagagacaaatttgatacatgtccttcactggagacatgaaaataattcgttctttttaaagactttgaaaagagcagagacgagaaaagctagaagagtttctaaatgacacaagatctgtgaaatgatagatatttagcataaacctcatagagctgttgtgtggattcattagttaattagttagttaatgactttgaagtgttaaatcttattagatttttttttacactttaacacatctgagagagaaattactcttaaattagaaactgactataccactcaaaaagaccatctttttatggtatatcttcaagatgctctttcctgttctgaatttttttcctgaaatcctgggaagcctatctacatcctgatcccaaatccaattcccccaccctttttttttttttcagtattagcattggcttccagttaacactaagcacagccttaagaaactctcacggcgaggtgttttgtataaaaatataaagatgttatgtggtaataatggcatcaagaattaaacatgctacttaaacatagttttgtacttttgtacagcaggggaaaacaaatacaggcatacctcagagatatttcaggtttggttccagaaccccaccataaagtgcatatcgcaataaaatgagtcacacaaattttttggtttcctagtgaatataaaagctatgtttatgctgtactgtagtctattaagtgtgcagtagcactatgtcaaagaaacaatgtgcttataatttaaaaatactttattgctaaaaagtgctcatgatcatctgatcctttagagaatcacaatctttttgctggtgtagggtctttccttgatgttgatggctgcagacagatcagggtggtggttgctaaaagttgaggtgactgtggcaatttctgaaaataagataacaaggatgtctgctgcattggttgactctttcatgaaagatttctctatagcatatggtgttgattgatagcattttattcacagtagaacttctttcaaaattgaagtcaatcctctcaaactctgccactgcttcatcaaataagtttataagtttatgaaatattctaaatcatttgttattatttcaacaatattcacaacatcttcaccaggagaagattttatctcaagagacaactttctctgttcatccataagcagcaactcctcatccattcaagtttgatcatgaggttgcagcaattccattccatcttcacactccatctctaattctagttccccgctatttccaccacatcttcagttacttcctccactgaagtcttgaacctctcaaagtcatccatgagggttggaatcaacttcttcctaactcctattaatgttgatgttttgacttcctctcatgaatcacgaatgttcttagcaacatttagaatggtgactcttaccttaaaggttttcaatttactttgcccagatccatcaaaggaattattatccaaggcagcatgagacttataaaaggtttccaatttactttgcccagatccatcaaaggaattatcatccaagacagcaagagacttataaaaggtatttcttaaataatactctttgaaagtcaaaattattccctgattcataggctgcagaatggatgctttgttagcaggcatgaaaacaacattaatctccatgtatatgtccatcagagctcttgggtgaccagatgcattatcagtgagcagtaatactttgaaaggaatctttttttagcactaggactcaacaggaggcttaaaatgtccagtaaaccatgctataaacacatgtgctatcatacaggctttgctgttccacttacacagcacaggcagagttgatttagcatcattcttaagggccccaggattttcagaatggtaaatgagcactggcttcaacttaaagtcagcagctgcactagcctctaacaagagactcagcttgtcctttggagctttgaggccaggcattgacttctcctctctagctatgggggtcctagatggcatctttttccactagaagattatttagtgtaagttaaagttctgttgtatagtgtaaccaccttcatcaattatcttagctagatcttctgaataacttgttgcagcttttacatcatcacttccacttcaagcgttgtgctgttttactttgcacttttatgttatgaagatggcttctttctgtaaacctcatgaaccaacctcttctaccttcaacctttccttctgcagcttcctcccttctttcagcctttgtagaattgaaaggatctagggctttactctggattaggctttgacttaaagggaatgttgtggatggtttgatcttctctccagaccactaaaatgttctccatatcagcaataagtctgttttggtttcttatcattcatgtgttcactggagtagcacttttcattttcttcaagaacttttcctttgcactaacaacttggctagctatttggcaaaagaggcctagctttcaacctatttcagctttcaacatgccttcctcattaagctttatcatttttatcttttgatttcaagtgagataaatgtgactctcttttacttgaacacttagagaccactgtagggttattaatgggtgaaatttcaactttgatgtgtctcagggaatagggaggcccacagtaagggagggaaatagagaatggctggtcagtgaagcggtcaggacatatttattgattaagtttgtcagattctatggttgtagtttgaaggaccccaaaacaattacagtagtaacatcaaagatcatggatcacagatcaccataatagatataataatcatgaaaatgtttaaagatgtggcaataattaacaaaatgtaacacagagacatgaaatgagcacatgctgttgaaaaacagagctcatagacttgcttgaaacagggttgccacaaaacttcagtttgtaaaaatcataatatctgcaaagtgcaataaaatgcagtacaataaaatgaggtgtgcctgcactctgttggataattaattctgtgagaaaatagagagggagagaattggaatccaatgataattatcttattctttggaaatagtgatcacattttgacctgcatgctggaaagttgagaaaggatagcagcagcataattaagttagcaatattttaatatgtgagagacatttgtatagtttaaacaaaaactttttttgttggcatataatatacatagagaaaagtgcacatatggtcaatgtacagcttgatgaataactgagcacacacaagttctctgcacacagatcaagaaacagaacacatcagcagtgtttcaaagccccctctagttcttccaatcactattcccatacccaaggtaaccactactgttacctgtaacagcatagggtagctttatctgttttggtactttacataaacgcaatcataaagcatgtacttttgagtctcacttatttctcatttgacatcatgttttacaagattcatctatattcttgagtgtagttgtagaactacatatttctcatctctgtccctccccattttctctccccaccacacccaggcacacacatagaattaatccccctcttattcaaatgatggatctacgtatgtacttggaagttcttgataaacttcttttttcatgtattccacagcatgaatgactcaggaattgctaatgaaaattttcctacagtctcttttcttggcgctggtaaatcttaatcttagaatattttgcatttttaaaatctattcatgtacacaaccagctccaagaaggacactgaggtaatcatctttttaagttgcccttgttttcagccccaaatccctgacttttacttaatctctccagggcagccttctttctgtctctggccttcaacttagaaagccagccctactctaatgattgtattagaaaaaacttgcataaactactttacaccaaggtgttcatgcctaaatctttatctttccaaggtatggccccaggacagtgttgtaacttagaggaccaattactctctgattactctctaatggggtatcttgtacagatgcatttcttgagttgttctgaggtcccactatattaaaggacactaagaaacagagctatcacactcaatgctggttttactattagaacattattgaaattaccatttcactatatcacaaggtattttctttatgagggtccatggggaaaggggaatggttctgcttcttctacataactttattttaaaatgtgttgttatttaagcaactgagcctgccctctttgtttcccccaccctctctcactctgtctccctctcccctgctgaaaatataaaaaagcatcagagacaaacactaataaatttccagagactaataagtttctaggacttcataatttgtattttttccctacctttctcacccttggtttcacatactttttctttcattctgttttcaaatatttttttctttttttaatcttgataaatttagggaaaatacagattaactcaataaaatatactatttcttaaagaaaaaattttaatcactgacactaagttaggctggccaagagaggaaaatgcagtcatgtggcgcttagcgacaggaataggttctgagaaatgcatcattaggcaattttgtcattgtgcgaacatcacagagtgtacttacataaacctagatgacagtctactacacacctaggctatatggtataggctattgctgttaggctaggaacttacttgtatagcaagttactgtatagaatgctgtaggcatttgtaacacaatggtatttgtgtagctacgcatatctaaacatagaaaaggtaggataaaaacacaatatcataacttgtgggatcaccatcatatatgtagtccctcattggccacaacattgttattgtagtgcatcactgtatattttagggagagggctcttctcgaaattctcaaattatgcccacttggtgaactgtgatcagacagactgaaaaacctggtagttgaggcatcgtataacatagtaccatgtacaaagaaagttttaataaagcttttctgaatgcattgaccaaagatattttccaacaagcaaaatggacagaatggggagaatgtctaggaaatatctagatcaaggataggataaaagacaaatgcacttgcgtaacaacatggagatgcgtttttaagagagcagacctgttactacatgtgttatgtgacactttgtgacaactgaccgattcttattttcaatgctctcaattaaagatctacttgggaagattttattaatgtgttatttatctaagagtcattgatttatggagcttaaccataagatatagcatggctcattttcattataaaatttatatctacaggaagaataccacaaggacatggggtgttctatcctggactggtaaaccacatatgcaatcacaccaactgatgaaattgaacatattaaatgataacaatctgttatttgctcccttcattcctatgatcctattaaaatgaagtaaaaaaaatcccagaaactcaatgtgaatccataaatcataacataaagcagtccaatataatacttcagtgaaatgttcttttcagtaaaagagagggaggagaaggtgtcaagtgtgggtctcttaattaggctttgtattaattttgagaacaaagacataattccagatcagataaattataattgtgttatttttttctttgctgttaaagctatttgattaggagactctggaaaaagcatgtaatcttgcaaacaaatataacaaatttattgtcaaacattagcaaaaatttataatctgcattgataacattcctaaagtattcaatggagccattcagcaatatgaaagaatgcaggcaaatttctatgattagtatttattcaaatatatattttgccaaatcaataataaatttactgagaaactatcagttgtggaaatattatgataaacatcccctttaaaaatcactatggccagaccaggtgctgtgggctcatgcctgtaatcccagcactttgggaggccgaggcaggtggatcacctgaggtcgggagttggagaccagcctgaccaacatggagaaaccccgtctctactaaaaaaatacaaaattagcctggcgtgttggcatatgcctgtaatcccagctacttgggaggctgaggcaggagaattgcttgaacccaggaggcggaggttgcagtgagccaagatcgcgccattggactccatcctgggcaacaagagcaaaactccatctcaaaataaaaaaaaaaaaaagtcactatggccaatatgaaaattaggacctgttaggttgaaaacatccagtctgcagtgagtataggattaaacatgattggagtaccactacgtatgtttcaaatgcttatagtatgtgaaaattaaagtccattttcttatgcttggcaaataccagcagacttgctagacacaggcagcagcctccaatttcacagggcttgtgttcccaatgcacacctaaaaggatagctttctcacatgttttgtgattctaacaatgtgtgcagagaggaatggatactgtaactatgaaatggaaaagctctagatttctgagtggttcagaatcacgggcctaaagccagacattaaatagaaaacttgtcacttcacagctcagaaagttctaacatctccccatgacttaacacaatctgggctcaacctagtctttctgtttctctatgcaattactcttaataccaatatgctccaacaaaaccatgatttaccactctttgaacgtctccttcagggtctatctctaatttgctcaaattatttcttctgcctggaacattgctttttgacaaattatattttataaccaaatttaactcttacataaactattttctgatacaaccaaaagcatttttcttccccattcaactctaattgtatattattattattttacttctatagccattaaaattttctaacttgaagtatatttacttatatctataattatcttcctttcagggaaattttacagggaggaaaaaatcttacattttttttgtatcctaaacatgcttaaggcaggttttgagatatactatatgtttaataaatgtctgtttaaagaatcatatgtgaatacatgaatgtcacacttgtgagagtctcactgagactctagtatattaaacaaaagatccttatttccctatctttgtcaaaatatgtatgatatttgagatttagttcatatcataaaacattgcatttaatatattttatatatttttaataaatgtttaccattttcagttatgtgaatggctccatacagcaaaagaaccattagaaatataaaagcatcatcctatgaagtataaaattactcctgaattataagcaacctttgtagctacatgcaaaacatttattcagctgcaactatttaatccttacaaaaacaaaaaagcatgagttcatataagggccacactgtgtgaggggcatagagagagattttagaggcttcgcacagtgcagggagtttggtcttaacccattttataggtaaagaaattgaggtgtaatcacatgagacagaatttgaattctgatctgtcggattcagcacctctcttgtcactgtgcagaaactccctttgaatgctagatttcctctgaatagatggtatgcttatttaaatacaagacaagtcattttgccttgctgcactgtatttatcacaaggctattgccagctttttctttaacattaaatacacacacacacacacacacacacacacactgtctttttttttttttaagacagagtcttgctctgtcacctggagtgctggagtggcgtgatcttggttcactgcaacctctgcctcctgggttcaagcgattctcctgcctcagcctcctgagtagctgggattataggcatgcaccaccacccctggccaatttttgtatttttagtagagatggggtttcaccatgttggccaggctggtctcaaactcctgacctcagatgatccatccgcctctgcctcccagagtgctgggattacaggcataagccaccatgcccagcccaacaccatatcttttaaatggcttactatgtttgaggcattgcaataatgtgtcccctaacgtatttaattcttacgacaaatctatgagataggtactgtttactcatattccggatagggaaactgggcatagaaattttaagtaatatattgaagatcacagagatagggcatgaaatggaatttgaacccaagtctttcttgctcctgaatccaaattcttaaccacactattggcttttgttcctctccattaatcctgaatgtgatttatttttttcccaaaaaggaaactggattacttgacctgctgtttgttcagaatatttattttagcatgtgaaacatttaatactacactgggaagggatctagaggacagaaagtggaggtaggggatgcatacagagataggctcatctcacctggcctgattaagttgtttacatttttcagaaagcccatctccaagtccagccctaaaataacagtgaaccttcatctttaatggacataagaccctgtctcagaactctttagataaacagagcacttttcagagagggagctagtgaccttgacaaattggctggctttcctctcattccagatccgtgacattcagcagctaagcctaatatgggaaacaagtcaatattttccagcatgctgggtccattttctccccccaatatttttaagcataagacaggtgcagaaatcacgtcaaccaccactggaggggtgtacagcagctgtcacacagccacacagtggcaaaagtctttgctaagatccaaaatgaaaagaatactcattgtaattgaaactatgcaggggacagagcttcccagatgcatacaaaagttctgaggctttgaaaagagacagatgtcacttttatactcaatctaagagctactacctttcaacagctcatcaggaggtaaaatcaaatcttcagagacaaaagacataagcaacgcatctgtagcagccagaaagtaaattttttaagctacgaagggccttggagacgattcagggtatgccgtcttgtttttcatttgatgacattaggatatcatacctaatggaaaaattaattgtgtgtgtatttatgtgtgtgtgtgtggaggcacgcacacatgcatgtgcatcatgatgatgtactacttaagcaataatgggccattatagaaggtaaatcaattaattctaagttgacattgtcatagtcaggtaaattgaggatctctctgaaaatccattttcctttataatctgacttgcaattattatcaatgtacccattatttacagccagggactcttctgcttggttagtgcttatgtcctactagttgttaaatattttgaaaattagccctgcttgtaatttattatataatttcaacaattttaagataagcctgatacaaaaacaggttcttccctggttagctaacctaagagtcaaaagccagcacagtagtgttacagccgttcagaatgcaaggtatcctttgaaatacttccacagaagacctccaagtagttttcaaaaacctggagctattaatatgattcccactatgttctttaccttccactgaagaaaacagagcctactgagaaacaactctagtgtacagagaaaccaaccagcaaaaccaagtggaagtttctattcaggtctgacctcggttatcttaatcataaacctgacccagttgagcctcgctgatgggctcataacttagttccctcaagatctttctgacttttgtgtaagcaacacacaaatcaatccagcatatcacttctgatatcacagaaaagtaattcttatgaagaaggaaatcattaattgtctttgaatgtgcacccaccaataattcaagttattaaagacaaaaatcttccctagtaaatgctcactgccggttgtctgaaatgagagagttgaaaatgaatacatgaatcaaggaggtttattttaagattttccatattttgatcaaatggtgatgattacattacattttttttctgtactttcccaacaaagaataagtcataccatcatgttcttccagaaagactctttgcttgaaacagtcttactggcacaccatagttagttatgactcatgggttttgtttttttctaagatagctataaacttcaaagatacattaccttataaaaataataaatattgcttagagaatttcatctattttctacataataattttatctttgaaacttaaaatagatatcatccagattgtgcttctgatatgttttatgacatgctgacactgtcctcctaagataatattagatgatataagttttatttttttaaaaattagcccaaggctttgtaggccaggttctagagacactggtcagttcaaatctcaaccagaagagctatgtgaccttggaaaaataacccacccattctgaaccttcatttcctctgctataaaatcaggataataataaaatctatctcaaaaggttgttaagactatcacagaagttttgaaatacaaaataattagaacaaagctggtgcatagtaagtgctcgcaaatactagctgttacttccattctggatatgtacatcataattcctaacttaaaatgctggtcaaaaataaaatttatgcctctactagtcagtaaatccagcctcttctaaacataaaatatttatttaaaataaagtttctagtatgaaatttgaaatatatagatttttcttaatacatttcagtatctgcttttataaattgaatgtaaccatatagtatttgacagacaaatgtgaatcatgttgtaaaccatatatttgaaacttatcttaaatttgttctgtgtctagttaaactaatttaaaaatcaaggttgctgcttcttgagctccttttgcagggctcctcagtgactgcagaggagaaataaaaacgcttaaaatagcgaaaataatgtgacaacattcaggcaaaggcaaggctactatgtacaggagagcatgttgtgcactacacggtcccgcaatggattacaatattaatgctgacctcttagggcaaactgtaggcactggtcatgccccatggatgaatatgaatacataaacttagcttcagttaaaattatgtcaaattgttaacagaaggaaaatgaggtttaaagtccattgaaaattatttttagataaatttggattaaaatccaatgtgctagcaggcctcaaaatgttaagtgatttcctgagaaactgtcacagcccaggtatacccttccttggcggaatcgactgctactttttcttttttaattgctgaattgttcaagtctttcccacaaaaggctgattattataggccttgggctacaagtagagaaattactggactagacctggagctgtggattctggcctaaacactgtcattggcttgtaatgtaattttgtgcagttttctcatatataaaacggaagtaataagctcagatctcaattaggaaaagtaccaagatactagacgtaaacatgctttggaaaacattggagcacattaacatatatagcattatcaaagtctttccaaatttcttatcatataatacatggtaaacaacaaaatagaaggaagacttcctctaacctctgaaaagtcagaaacttttcctaggtgcctttggtattttctaatcttactctgagtattgtttccctgaaaagatccattttattctgactcaggtacaatataagacaggaaaatggatgttatatacatagatcatcaatagagaataggaagaaaaagataacgattattttgtggtatcattgtatcatgactctgaataatatctatcaattactgattactcactatgtaccaagcccagtaggcactatagaaatgtataatatcttattctcacaatcaccctatgatgtaggtgataaaatacattccaaatgacaatgccaattcagtaaaattaatcatcttgcatgacagtatgcatctaagaagtcgagggagacagaattcaggcacttatctgtttggctccaaagcctacattaattccagttttcctcattgcctctcataacagctggcacagagtagacactcaataaatgttggatgaatggatatatggatagacacacgactgcatgacttctgggaattagaatttataagagcaagactgaggccacctatctagactgtcacaaactggagatcagcctccattgttcttcctcttctgtaatttgaaaaccctaggttacaagagtttcttcattgatggtataaacattacccattctcctagtatttctgccttcacagatgagggatttcaaattcttggagcccattgtgtctcaccttcatcaccaagatctgactggggggtatctttctctagtgacgctacaacatggcatttggaaatttgcttaggcaaaatttagtcattctggtcatggagtagtgctctgccagaaaggggtgctcaaatctaacttgcagagcctttaagggaattctgcagaagctgacaaaaatattaagaccctagagctatggcatttggttttgttcttgtgcattttgcaaaggtacctgaccacccaaggaagaagaacctttttgcttgttagccttcatatttcctacatgtgggggctgcatctgcccaaagagttcctctttttctaattaacacaaaggtgatggataggccagtggctgtcttgtgcaaatctaggatgcgtttcaataagccagacccagcaaatgattctcaagcttagtaaggtttgaaaaccactggtaagagttttgggagcagaggggattcttcccaagggaagtgggagtaaattgagccttaatgagtaggcattgcttgctatcttgttaatgtattgaccctgtaaaaccaactgatatccagagttaactggcttgcagagcttgggctgagaatctttgcaagttattgtcatccaggcaataaacaataattacattatttctactccttagcaaggaggaggcaagctttgcaggcagctagtaagagttgtcagttccctccagtgaaatgttctctgcaaaaagtcaatagtcaaaaggcataatgctgtcatttcagagtgaaattaattcctcttattatttttacctgttgctctgttttcctgcagagtaaatctcagtattctgactgtgtttaaaagcatctgtatttttccaaagtggttgcttaactgatttcaactgaatttggcaaatcacactctaagaggagccagaaaactgatgcagtgacaggctcaacagtaaccaatattccgtttaatcctaacccttaggagatctggcaagggcctcatcctcctacgggacaaaaagagtttagaagctttttggggaaattatgtagtaagtgcacagcaaaaagaatgcctaatggctttgctttggggaaagaaaactagtggtaataaaaccatggaatgtagaagataattcaaaagggaaaagtggacaaacagccataatgctacctagctctgtctaaattgaattcatgacatgtatctatcacacatttcctgacaaaccatctcctgatgggaaatagagaataaacaggttatgtgaagtctttagtataatgttttctttcttggtcaataggaccaactttatcaaagatatctcccacagtctggcttcaccaagtaaatcaaaagaagtgagatgtaatcttttattatcattttttcctaaatttactatttgctcatttattaaattgaaagaatacatttattccacagtagaaatgagagacaagtaaaaaatactttagaagaaatatatccagaatatgtgtgtgtatatatatacatatatatatatatatatatgcatatatatatatgcatatatatatatgcatatatatatatgcatatatatatatgtttgatcctgaaggaagattacaaagttttcttgtactcttgggcatagtgggaaggacattagaatagggtaaagagtcctgggtcccagtcccagcactggtgcttaccagagctgtgccagtctggattctgtcaggaaacagatgatacactcaaaaggagtgactcaagaaagttaatccagcaaacctttgcaaaaatgtaggccgacttagggggagctggcaaggatggtgaaacatggggacagcatcagcaggatggcatcaccatcctaaggcagaagacaaggggaaaatttgctagaactgctgaaaagtgtgcttacaggagatggtcaccagcattgcagccactactaagctaggcctgaagggagccagagaaattagagttctcctttctctctccttctgccacctggacttacgcatatgaaccctacatatggccaaatgcaaccagaagcagtgagagggccctctgaagcatttcataaaggtgagcctctgtggcctggagcagggtacagaggaagggtacatagaactagaggggccaaaagcagttattgaacacacaaactatgcaattttgatcattcatccttgctggccttcagtaccagcttccagaacattaagaatctgagccagataatctcaggagtttattccatctctagtatcatttgtgaatattgaataaaagagaaaggaagaaaataaatattctaattggcccaactgatttatttgaaacaggaagatttagcaacttagcatttattggttaacaaaccacaggtctttttttcctccacctgctttcttgcaaaaaaaaaaaaaaaaaaaaaaaaaatgcctgtgcctgaaggttatttagaaaaactcttgaaagctattaatagaaagcagatttaaactcagtctctaaaaggcttaactttgtgtactatagttctgcctttgtagaaaaataaaaagcttttttttttaaaaaaaatagcatatagctcagattattagctatctctttgtcacaaatgtgcagctgggttcagaatttgcatgtttcccaggcaaaagaattcaataagtaagtaagcgaatcctgccattttattaaatacttacagaaaacaaaagcaaagcaagctttaactcagccggaaccagaacataatccccagagccaataacacatgttaaaattccagcaccagagccaaatttgacaaaggaacactcactatcctactactcctggggcaaactatcctaattttgattctcacactcttgcattttgagatcctccaaatatgactgctcaaagaagaaggaaaggaattaaaatggggagagctaaggtttgagatttaaaatgcactttcaagatacgtgataaatgggaggttcatgaaagttccctttataggtcagatatcatttaacttgtccaagtagttacgcttctattcagacatagggagagagagtgtaaatgaattatctcctccccacagcctttctacagacccttctctcttaattatacacatccccattgcacaggtcctgccaagcgctggtatccacagggtagatgttgaaaaaagttataattactatcttcagtctgctgctattttacaccctcagactcacggcaaaagcttacagcagaagttggcttagtgtcctaatgcagcagattcaactttttgacaatcttttattctcttcaaaacctcttcctctctatagaatttcatgttcccaaatcttcagtgataatggtagcattctcagggaatgcctggattgatgatcagggaactctttgagctagaaaccaagacaggatttctatttttattcctgtttcaatcctcatgcccagtaaaaataatgagatgtttctttaaatcatttattttatgaagaggagtcaggattatcattctttccacttctgcggcaattgggccaagagaacaaaaatatgcaagggttcagaattcagtcccctgagttctaagggctctgcccctggttatttccatgagcttgggaaagagaattaacctctctgggaaatctggaaaatgaactggtgaaagtagatgatttctacaactactttcaggtctaacattccacaaccttatttgtgccaatgcccccattctactctcagtgcaactgaacttacttgtccctcattgcaatctctaatttcttaagctcgtcctaatttcttagcacacctttctttcttttcctagctttaattttctctctatccgaccagaaactcaggagtaagaaactttgctgacacaaactgctatctttcttttctctttcttagccccatcttcttctaccaaagccatttggcaaggtctccaatctcaagactccctccacatctatactcctatgtctaagtttctaagcatgagttggcaacacctcaaacaacagatcctgctacaaggctagtctgtactgagtttataattgtttcctttcagaagtctcttcaagccaggtatgtaagtttcccatgttgaccctcatagctatttgaaatttttttttctttgctagcagactccctaaaaatatttctttctctcctctttcctcaagctctctgccttctctctctgcagataactttatttttcataaagtgattataataaaaccattttcacaatgaaaatgtgtagaatttaaaatacagaagttcatttttagtttaattacattaacataaaaaatgatcacaaatctcctacaaaaatcatggagcatttttgcatttctatatcacttccaactcagcttcattttgatttataagcttgactacacatctagctgtcaaaccagatgttgtatggaaaataccagctaagtctgattgaatttttcaatttgcctcatttgaaaccctacagcaaaacagaagtagttaagaacttcaaaaagttttagagtagagaactaattactaattacaatgatcttttctcagataatatgtagcatgaaaatacaagttaattattcacaaatgactacaagagaaaagagagaaaaacagaagacatttgttaattgaatcaaatattgtgaacatattccatctttgacattctgaaagatattggaaggttcatttaaatttgcaagcatctcttcatagcataatattccaaattaaaattttaagggggaaatacagaacagaacagaatggcataggatctatggtggatagcaactttagttttaattccactttgtgactgcccttagaaaaggggggatggtagggttaggaatagtgacagtgttgataaagcataggagaaggaaaggatctgtagaaatcttgagagtgaccctaaaatgggaatggttcttaagtttttttgctaaggactactagttaatcacaagggatcctttctgagaacaatgtttttaaatgcataaataaaaatataggactataaataacttcaattaacttgacatagttatcacaatattaaaaacacaaattagtgatacagtaatagatatgctaattcataaaatgttcaatagcaaggtcttctagcaagtctagaaactgccatcatttcaaaaaaagttacgaacataaacattatctttaaagctagctataatacctgtagtctattatgacaatattggtgatttctattgttttgtatagtctctgatctccagttcatctcattctctctcttactcactccaaaattttgctccacaattctaccaaaactgctccccttaaggccatcaataaactccacattgctcagtctaaagtcagttctccatcctcctcttacttgaactgtcagcactatttgacacagttgatcacattctccttcttaacctaccatcttcattacattcaagcatgccactcactggtgattttcttccaacctcactgggactctcttgtgaagttctcttttccatttcatcttaccaacctcttaatgttggggtgtcccaggttagcccttggaccttctcttttgtgtgtaaatttactcctttagtgatttcatcaatactactgatatagacaaatcaagatgactccagatttatatccatagccttgatctctcccctgaattctagatttgtatatcctattatctatacaatatttgcatatattaagtttgaaatgtctattactccttgaggacatttcaaaggcttaatagacatttcaaacttaatacatgcaaagtgactatcctgatcttcacctccactccctccccactaaacctattcctcctctaatattctccagtccagttaatggcatatggaggccaaatgtttgaagtcattcttgatgtttttccttctctctcaaagccacttccaactcatcactaaattctatgattagaagactccacgctgtaaatgtaacttaagtctctcattttactaaccatattgccactactctggtttaagccaccgttattcctgtcttggtttattgaagtaaggcttccaccttcacctcatctcaaaatgtgggctagagtgatcatttaaaacataactcatagcagtcactttcctgttcaaaaccctctagtgacatcccccatttcctcatcatgaaaggcaaagtaattacaatgcctcaaggcctaacagaatttcatacaatatacattttctcactgaccttatcacccactagcctctctttggcttattacaggaagagaacttcctcatggtctccgtacttacacctccttctgcctataatactcttgccccaaatgtctgcctcctcaactcctctaagtttttttttgttttgttttttgtttttgtttttgttttttttttgagacagagtctcactctgtcgctaggctggagtgcagtggtgtgatctctgctcactgcaatctccatctcccgggttcaagcgattctcctgcctcagcctactgagtagctgggattacaggcacgtgccaccacacccagataattttttttctatttttagtagagatgggatttcaccatgttggccaggatgttctcgatctcctgatctcgtgatctgcctgccccagcctcccaaagtgctgggattacaggcgtgagccaccgtgcctggcccacctcctctaagtctttattcaaatgtcccttcaataaggccttcatgataccccctacttaaaatggcttttagaattgtttctccttattttactgttctccaaagcaattatcaccatataatatagtacttattttattcatttgtttatctgtcttgcccaacaatgcaccccataaaggctgagatttttgcctggtatgttcacagatctctccccagtgcctggcataaggcaagaattcaataagtagttgttgactgaatgaatgaatgaaggggttctttggaatcttatcttccaggaagtctagcacatttatccattgcagtaagactcacacatacttctacttgccaaaactatatcatactctgtaaattaaccaaaattattttaaatgtgatgcttgaaataaaacaaagctagtacttacagtatttgctatagaaatactgtaaaaactaactagtggctcacaaccacatgggacagtgcatccacaaggagatgcttcattatgccatggaagagcaagcactttgacacaaacagacttttagctttgaactccacctctgcaacttgtgagctgtgtagcactgggaaattatttacctctataagcctcagttatttgcttgtagtatggaaaatgtgattatatgattaatgcatcttaaatgaaattatatgcacaaagttcctgggcacttgaaaaagatgatcctttcatcattcctcttgacaacgattactttccaagtagatgtgagcaaataatagtgtacttaaaaatggtcaaatataagaacaggattggaaagactgtgatcagatgaactgatcacctgcagtggtagtttgggtagagaggtttactgggttcaccctaaccctgacagttcccacaaaaatgatatttagatcccttttcagggtaaggtatagagggcatgtcgaaaacaggttccaaaatagaaggagaccaagactctattcatgagaaagagcagggtgagacattatcatctgaaatggaaggtgacaaagccaagcagaatttgggctagaaagtggtgttgccccattctcaaggatttgttgttttatcagtgcatagacatcaattttttttttttttttaagatggagtcttgctctgttgccaggctggagtgcagtggcgcaatctcggttcactgaaacctccaactccctggttcaagcaagcaattctcctgtctcagcctcccgagtggctgggtttacaggcatgcaccaccatgcccagctaattttcgtatttttttttcagtagtgatgggttttcaccatgttggccaggatggtctcgatcttctgacctcgtgatctgcctgcctcagcctcccaaagtgctgggattacaggtgtgagccaccgcacccagccagacatcaatttctgtccacagtaacatcgtaggaaaaactttgtcacactgctttgggattcagcacaacattcttctctttccttagacatttaaagtatgaggattctacattgaagagcaggtcttttttttttttttccgcatttcaatctagatgtttacattggtgggggagatacacttagaagcagtgtgctttttcataaatcactctaccttgtttctctcatactttaaaattacatacatttttaaactggcacaaaagtactgtcttgggagaaggcaagaaaatagataaaatgttcatcagatgataacaattgtaaatattcataaatcagggaccaggattcctatttcctaaggaatgtgctcagcctgggagaaacctcactttagaccagtggggctcttgggcactttcatcatgacatttaaacaataaatgtatctgtcaggtgatggtggattcacttcggaggaactgacacctttgatgaccatcacaggactgagtcaccaattatacctacagcctgcacttggttttcttctcttacagaatttcatgatccctccctaaaactgataaggcagcatggaagtaggagggaaaagggaggagataaagcagatgagaggcagactgcaaacccatccagctttgcaaggactgagcttcatcgctcacagaaaagtcaagttcaagtcacaactcaaaattaaaccctgactaatgtaaaaaacctgtgtttagaaacattttacacaaaagttacattttggaataatagaaaatttaaagctattaaaaagcaataaaataagatgaattctgcaataagattgccacgttccactcttgaattaaagcaaacaagcaaatatttccttcctaaaacttcctgcctttattctgctggcttccactctgtgagggccaactgtgggtcaagccctgttctttgtcccatgccaaaaagacagctgggagccacggtggaaggcagacaatgccctggatttaggtactagtctcctccaggttgtgtttaaaaagctgggtttttttggggtttttttgtttgtttgttttttggctcggcatggtggctcatgcctgtaatctcaacactttgggaggctaaggcaggtggatcatgaggtcaagagatccagacgatcttggccaacatggtgaaaccctgtctctactaaaaatacaaaaattagccgggtgtggtggcaggtgcctatagtcccagctactcaggaggctgaggcaggggaatcgcttgaactggggaggcagaggttgcagtgagccgagatcgcaccactgcactccagcctggcgacagagcaagactccgtctcaaaaaagaaagaaaagaaaaaaaaaaaagctgttttttttttttttgtaattaaaccaaactaaatatttcccaggagggcaagacagttcccaaaatgtctaacgaacttccacgtagagaaaacggttactgattgtcccaaagcaaaactgtagcaaagcctttccctgaatttttctctcttccttccatcttcttttatttctttgctcagtcaaaggccgcatatgtttcaaaggatacttgatataggagggtagaacagtactttcagcatgcagattttttttctatgttaagtgaaaataatgatttcatgaaatgtgccttcccatcattataaaacaattttgagagaaatccatcctccttggcaattccaaagcctgttgtttgctttgcaagcactatataagtctggagaggggcctgaaattaatatagctcagtaccataaaggcagtgtatagaactgtagtcaggacttaagatttgagtcttttgcttccttcactttgacatattacttgagaggcctgtacctcagtttcctaatttgtaaaattgggataacaatagttattattttatagtgccattttgaaaaatagtgaagcttctgacagaagacctcaataaatgttacatattttaaccatcagcattaataaacgaaaacaattttccctatttttggtcagaatttaggaaaaataagttccttttaaattatgtgtagacaattaaattaatcttttaagtaaaaaagtcttattctcatttttgatgtacagaattttagcatcatctaactaatcctaaaagactttgtataatgaaatgaaaaattaatttatttgatgtcattactttttaaaataaccaaatgtcatatatttatcattttaaagaattaatatgcagctgggttaactcggctatgtaatatattttttttttcaggatatacctttcagattattcaaagaaatagctaaaaatgagctatcagattcaaagaagctttttaacatagccaactgtaggtcagttttagtgttaaaaatttaatagatcatacacctaatttacggcgagggggaagcagtggctacatttaaccaaaataagatgttcttctacaaacattaacataagaataaaaaccacaagttttggggtgatcactgataggcaaaccatatttagaacttagcagggttctaaatctgtaagaagaaaataaatatggaaaaaaacaacatgaatcagtgtgctctcacatctccatatctctgtgttacccaacatagaactatagcttatttaagacatgtttagtagcttttcccatactttcctgaattcattccctgtttcaaattcaactaaatgggagaattagaagagaaattttttgtatttggatatcatggcctatcttacatttgatatatgctattgcaattttcttaaaatataagttcatagcgcaaaaagaaatattaagtataacatagaacctggtaccactataagcaggtgattattaacactccattaggaacgttgatggttctgctaatgaaacaatggttatagcaaaaaatagactatttttctggaaacgtgagatttttcttatgtgtacaagcacatacacgcatacattagccttgacataaaccatgaccttctatttgttaacaattaaaacattgtcttatataagcccaggtcatctgctagtggatagatatagatataggtatagatagatatagatatggatatagacatatatatatatagatagatagatagatatatgtagatatacatatatctacatatgtgtatatacatatatacacacatgcatatatatatacacatagcatgcatatgaattacaattaattaatcaataatggtcccatctggttaactgcattggaaaatgacatctttccctcagcaatacaagatttcaaccactacttgcatctgcaccctctatacctttaagcagtatgcaaatgatacaaccatatgaggcgggactatgtaaaacagtccattaaaataattttcccagatcaaataaaaactgacacattttctaacatttattaagaatttttaaaaatgaacgttctaaaaatgaagtcttaagaaaattctgaggtgtgaaacataaagataagagtgccagtgagaaaaataatctgtttagtagatttaaattatcattatatttcaccaaatcctgttaagaaagaatatatcccctcgaaaggttcaattctacaacaatgagtagttaataggttcttagaagggaggaagtcattgtactactgaatagtaataaaatctatgattcagtgtgtttcaaacatttaggaatgctttttgatgaatgggttttttaacagctactgaattggatttgtcctctttatataaaagtctaagtctatactaaaagaaaagaaatttatactctgagcatgaagttaccacttggaagtagttctttgccccatgactgctgagcctgaaaaacccaatctgtttctagaaaaaacttgccaacaaaatccacagaatttattagatagaattactcaagagcaaaataccatctctaccatcatcaaataagagtatgttgctggctgtggattttggtatagttttaatttttaaaaacagtttccaaaacaataccaagaggcagtttgattctacagtatggcaagtaaggaatatcagacactattttagagtatatatctaaataaatattatatatatatataaaacacatcgaaaaaagatatacatacatattagtttgacattaagggaaagaaattaaaaaaaagagacaagatgaatttaaactagagaaaatacaattttagaaccacatttaggaaagacaaaatgaagaaactggatatgaagaaagttcatatctaaaaaaacgtggttagaagcgattggattcaggagtttctgcaaacaaaaaggttgtctcctcagtgcctaaaacagcacctaacagagaaaagacactcaatacatattcattaaaagaagaataaataagtggctatgaaactgggtatacagcaccatattgagtcttaaagttacatttttaataggttaaatttaaatacatatttttggccgggcatggtggctcacacctgtaatcccagcactttgggaggccaaggtgggcagattacttgaggtcaggagtttaagacgagcctggccaacatggtgaaaccctgtctctaccaaaactacaaaaattagctgggtgtggtggcatgtgcctgtaatcctagctgctgggggcgctgaggcaggagaattgcttgaacccaggaagcggaggttccagtgagctgagaacacaccactgcactccagcctgggcaacagaatgagactccatctcaaaataaataaataaataaacaaatattatatgtaaatatatatatttactttatgagctatttcttttaaaataacatccattgctttattttctgactgcaaaagcaaatatactcattgcagaatatttttaaaaatcaaatattaataagaaaatgtaacataatattaatagacagataaaaccaccagcaaacattcatacatctatgcacaggcatttatatttacaaatgtgaaatgatactgtatatcaattttatgtcttatttttataacttatcattacattgtgaacatttccatgtcattaaaacttcttcaaaatcatgagttttaatggcctcatatcgttccataaaatgaatgtgcaataattgaattattatgctattgatgcacatttgaataatgtataatatcaaaaagttggggagaaaattttaagcagctttatccataaaactttaattgtatcttggattatttcctcgggatacatttttatatgccaaattgctgcatcaaaaggacagatttagcatttttgatccataacaccacactgttttcatgataatttgtattataactgctcccagtagttatgaaaatttttattccatgatacttcaaactagaaattttaagatctcttttacaatttgataggtcaaagctgatatacttcaaacttgattgctggtgagattgaattttttgtttgtttattaactatttgtacttcttttgtgtgagctgcctcacatttgaggagaaaagctgcctctcacaacattcataaggcttcctgaccctagagaccctctatatttccacaacatggagagtatctgtaactcctatcagaaacatcttagtgaaacagcatgaaagtttatgaacctcaggattactacatgaacatgagagtaacagtactgacctacctcagagatttctcccacatcattattacaaagtactataaggctagaattgacttggagtcaaggcgagttccataggtttaatgcgtggcacctatctcaacaactgcaaaatcactgtaacttgtaaaaaatcccagggccactcatggacagccacatctttaaacccacacaaaaatacagacactttgattacatgaaagttagaagctctaaactagagcaaggtcagttgtggtaagaaggtattagattcaagcatccacaaaagtttatagtctgtcagtcataaggatggctattgggatttctttacagttactctgttgtattttcactttggttttacagcactatctcttaggaagtcatccatatattacctgcatacacagtcagcttcttctcgatatacagcagatatgtaacaattattctttccttcccagacagtcatggtaatattacatttgagttcagtgaggtaactggtagccagaaatactccacaaaaggtctatattcttgggtgggggggggatacaattcttctattagggaaatttttatcacctacttatttttacataaattctaataatgccaagaaaatacatttcaaagaggaaggtatagaaatttagagatgactgtgacctcaaatatccatgaaatataaccagaaaatctgcatctacataatgacactattttcacatagccccaaaatgatatcttagaaagccaaaaatctttccttatctccaggcagaactatttcaaaagataacaaatgattgcccaagtgatatttgaattataccaaaaaagagacagtatatacatggtaacaccatcctctgtgtattatttcctcttggtagtccttctgtttttcaagataatacagatctcaagaattctcaatgttcaagcaagaaaattccctcaaccaagtgaaatagaaagaagttatctattaattgtgccaggatttcagttgttttctttcctttcttcttttcatgcaagtttatttgcctttctatgagtatttgcattatttgctctttttcccctttgaatcatcttaaaggaaaaaaaatgaaaatgtatctatttggactttaattacactgggcagcaatgaggcaggatagtgaagttaaaaaaaggctgggtgtggtggctcacgcctgtaatcccagcactttgggagaccgaggcaggcagatcacaaggtcaggagttcaagaccagcctgaccaacatagtgaaaccccgtctctactaaaaatacaaaaattagctgggcatggttgtgtgagcctgtaattccagctactcaggaggctgaggcagaagaatcgcttgaacccgggaggcggaggttgcagtgagccgagatcgtgccactgcactctaagcctgggcaacagagagagactccgtctcaaaaaaaaaaatacatacatacatacataaacagtgttagaataagcataagactgtgcttaaatcccaattgtactctttataatttgtatggctttgtgccagttttcatcttctttaagcctataaaaccaggagtgtaattcactcctttactatgaggattactttatgtaatgcacctagtagagtgcccacttagagtaaacactcaataaatgacaaatgtcatcattataactgtgttggtaagaacaggtaagggtataaaccactcccacctcactgaatttgcaggcaattcctggcaatagtgcccaacaaagagaaaatataccataaacataatttattttaattacaagagaccctgtcatctctactattattataaattaacaataggttcttctctttaatatttctcatttctgagccaaaatcattttttttcaacaaggtcagagcatattcttttttttttaaacatgctaatgtacttcagtatattccattctgtaatatttgtttcaggaaatgaaaattaaattttctttaattaacccccatgactcttgaaaattttcctcattgtccttgaatctatggtctttaacagtctttataatatcttgaactctacactccactgagcttttaagctttgtttagtgttgccatagcacacctactccttatgatagaatatcgccttctcaaattaacaacatatagtcaatttattgtggttttccagtttcactggaatgaacaaagatttctttctctcacaggctaaagttttctccctccttcattattcggcttcagagttcaactcctttacccacatgacataatcagctcaaaatttattatactatatatagcatcaaagaatacatttttttagagatgaaatgaggtctatgttgcccaggcttgcctcaaactactgggctcaagcagtcctcctgcctcagcctcctgagtagctggacctaaggcacgcaccactgtgccttgcagaatacattttattaacgtaaaaatcattattttcctcttacttctgcataaatggtatttttggtccatttgctctcggagaatagttaactttgtcattaacaggcccatccagattgttttattacttcagttgataaaaatttatttcataaagtgctttttctaagtaagacatgaacataagcaaacccataatattaaaagctttatatagatacaatttaaaggttctgtcaaatagattttttttttttttttttttttttttatgaaatggagtctggctctgtcacccaggctggagtgcaatggtgcaatctcggctcactgcaacctccacctcctgggttcaagtgattcttgtgcctcagccttctgagtagctggaattacaggcgcctgccaccacgcctggctaattgtctgtatttttagtagagatggggtttcaccatgttgacaagtttcatagattaaaaagtaggataaataaatacagtagagagaaataacatttcagaaatgtcagtattaaaaactaagtcaaccacaagcagttttacatcatgtttacaaaatatgctataatagtaatacacttgaggagggttaaaaatggttctttttttattgcttctcagccttttggctaagatcaaatgaacagttctttttctaattgttcaaattgatttcatagtcttgtaatctacatatttatgaaaaataattttaaatctcttataaatatcaaaaatgtcagtttccaattgaaataaaacagtattgagtaaagactataatgtatgagttttgaaaaagaaaattgacaattagaagaaaatttcataatattcattgtactaggactttccacatttttgatatgacgctaacatcaatattacaatgaattctcaataatttgtattaacaaatgacaagaacaatctgaactaaattgaacaataaagtatctgtaagcttagaagcattaatttcatagtaactaaacttttggtaaccaagcaattctatatagaagacttttaagtatgcccttctaagtttgttttagtaacattctcatttataattagcaatatataatttattttttaaagtgctaaattaaatacactctcaaataattttgttagactattaaattacttattttgtttcaagacggagtctcactgtcaccccagctggagtacagtggtgcgatctcggctcactgcaacctccatctcccaggttcaagtgattctcctgcttcagccttcccagtagctgggattacaggcacccaccaccatgcccagctaattttttgtatttttactgagatggggtttcaccatgttggccaggctggtcttgaactcctgacctcaagatttatccccctcggcctcccaaagtgctgggattacaggcgtgaaccaccgcgtccagccttatttatttttaatcaactttattgaaatataattttcataaaacaaaatgcataaagtatacggtttaataggttttaccaactgtatacaccagtgtaaccaccacacaaatcaagatataagaaaatttctatcaccaaaaaagttgccctgagtctctctgtagtcagtcttcttatgccctaccagatagccactgatctgtctctatcaccacagattaattttgcctaatttcgagcttgatacgaatgaaatcattcaatgtaggtttttgtttcttgctttcttttgctcattacaagtttaggcctacttctgattcacagcttctggtgacataggctggagaataagttattccttaagaagaaaggagtaatctaaaaaagtgcttcttagcagttcattcattttaattgctgagtaatactcccctgtgtattcctatacagcacactttacgcattcacctgttggtgttgatggacatttaggttgcctccagtttttgactattgtgaattaagctgctgtaaacatttatatacaagtcattcgccagcatatgtttttatttctcctgggtaaatatttagaattgtaattactggttcgtagtgtaagtgaatgcttacctttttaaagaatcttctaaactgttcttcaaagtggttattccatttcacattcccatcagtaatgtataagagtttcattggttcatatcatctactaatacaacacttaatatgtgactttttgtttttgttttgtcattttaatgagcaggaagttatattctcattgtggttttatttttaatttccctaatgactaatgacattgcacatcttttcatgtgcttaccaaccatttgtttttttttttctgaagtgtctgttgaagactttcatctatatttagttgagttgttttttcttcatattgaattctaagcattcttaataatacattttttttaaggagaaaaaagtattccagtccaggtcagcacaagctctgagtcaagaataggtctaaaatccacagatgcaattctgaaacaataggcctggaatcaaaggtagctcttgatgaagaggagatgagtaatctggtattttagactccattaagactcgccattttgtagctgaccaaaagggtcattctttagtcccatttaaaatcggcatttcatcatttcaaaaatcctgcttcaatctaagcaaattatcatgtgattctgcaattgatagctagctcaataactgatttatttgataagagggaacacttagaaaatatacagctctcatattttctaataaaggtattcacatataattaatagtaataagtactatctgtgagtagtatgcacaacatgcatgctgctgtcttttgcaaagtattaaagcagatgcctaagcattgtaggtaaggatgtacttgacttagttatgatttgattaaatgttccctgttcagattggcttctgaatcatcagctactggtgtaagtaaaaataagttggaaaggtttccctttcctgaggatttcaggaaaagcttcgcaactatttggctggatattgcaaatcagatcaagaattgggaagcggtctgtctttgacttatcttgcactatccaattctatgagtctatgattgtcatgtacagagcacttggcttagtggtttgtgtataacttttcaggattagtggtggcattgagctggttcatccacaagtttatctggttctccatcaagctaagttcgtcctatctgcagagcagacacagtatttctgctctttattcttggctgtttcctctatttagcactcctttctgtctgtttttctaagttaacacatgatattttggtattttaaactccattaagacttgtcattttctatctgaccaaaaatcttggtcttcttcaatcagtatatcaatacctccttataggaaaatatataaaagtcatttattctaaagcataaattatagaccaataactgcttaacatgctactgcagttaaaaaccagagttgattcttttctaccaactgccctctttaatttccctgtataaaaggcccaataataggtcagttagtccacaaaattttgttgaatacttactgttaggtgctagtagctttgtattaatgaaacaaacattgttcctgcctttgtaaaacatatgttcttgtgagaaggactttaaaaataatttaaagtaactcatgaaataattataagtatttctaatagtgcaggtgagaaacagtgttggagaacatagaaatggaatggcggcactaatatagggaatcagggacgatacccctgtaaaagggatatttcagctgagacctgaaattaaggaactggtaaggcagaaaaagtagagaagaacatttcagacaaagaaaaacatgtcaaacatcctctcgactctggaacccacatgacctttccatttttctcaccaccacttctattcttgccttcatctctttttctatagattactccaatagcctcattactagcctaccctacaaagtgttgaaagatgtcttcatataatataactgtaatgacatcatctcttcctaaaaatctacagtgacttccctaaagaaaaatggtcatattcccaagtttggcatttttggcccttttcaatactaatcaaacttacttttccaatcttattttcatgacttttctgccacactgatctatttactttcttcgtcaatacaattttattctctgaacttagtgctgttttctcattattcatttcatctagagtaagtctttaaatttcatgtaaatgattattttattggtaaaatgtataacaagtcacaggcctcttaggagatacccacgtttttgtttttgctcttgtttttgtctaaagacagtgattgctttccaaataactactttgatgtgcttatcatttggttactgaaatgaaccaaaatttaaatttctagtatgggcgagtttattgggcctttcaggtgaaaatcaatgtaattttatatctacaaatgcttccaggagaattagccaatggttgatagttccattgtctaaaataatgacctaatataaatcaatgggaaaatagattaaggcttgaaatggcaagatttgtttaaaggacctataatgggtagaatatataaaggttggccgggcacggtggcttacacctgtaatcctagcactttgggaggccgaggcaggtggatcacgaagtcaagagattgagaccatactggccaacatggtgaaaccccgtctctactaaaaacaaaaaattagctgggtgtggtggctggtacctgtagtcccagctactcaggaggctgaggcaggaggattgcttgaacctgggaagcagaggttgcagtgagccaagatcacgccactgcactccagcctggcgatagagtgaaactctgtctcaaaaaaaaaaaaaatgtataaagatcatatgatatgaccctcagcctaagcttagcaataaaactttagaaactacaagagtggcctctgttaagagctcacagaaggaacaattttctatgcttcactgtcacgtgtaaaatagaaagccagaggtacttcagcattcctatctaaagagcttccaaatgtgctctaaatttgtagatgtaagctgggccttgtatgttttaaaggttaaataaatcttcagatagctatctactattgttagataaaggagtcaactttttgccatagcaaagtaaaggaaacaggattctcttttctgagttgggtggatagtttttgtccataattctgtacttccaattgtcactaaagatatgtcatgctttatagcctcctatatgtctggatcacttgtgctttcatttggaaacaatacaaaatagtttataaatgtaagtatccttgtttaatacttatggaaccaaaacatattttaggaaaaatgacacttagtcaaacttttattcctaagtgtggaataatcaaggttgtatatagaaatccatactttagtataacatcatgagtgaaataaatttgcacacacatatatatatatatacacacacacacacacacacacacatgcgatgacgttcctgaaaatatgatcctagataattaagagaatggggagttgctattcaataggtataaaatttcagttatgcaagatgaataagttctagagatctgctgcacaacatagtgcctagagttaacaatattgtattgtgggccaagtgcactggctcacacctgtaatcccagcattttgggaggccaaggcaggtggattacttgaggtcaggagttcgagaccagcctggccaacatggcaaaaccctgtctctactaaaaatacaaaaaactagctgggcgtggtggtgggcgcctgtaatcccagctattcaggaggctgaggcaggagaatcactttaacctgggaggcggaggttgcagtgagtctagatcacaccactgcactccagcctggatgatagagtgagactccatctcaaaaaaaaaaaaaaaaaaaaaaaaaaatatatatatatatatatagtatggtgtacttaatatttttaagggagtagatcttatgttaagtgttcttaccacagtttttaaaaagagagaaaaaaacagagctgaaagaaactataaatagcaaataaaaattagcaattcataaagttccagtgaataaatacatttactaaacctgtcacattattttataaaggatttttatttaattaaataaaaagtagcatgaaagcaaggcctgacatatgcaacaaatgtggtcctaaattattgcttagcctgaattattattaactgtattttatgtaaatttcacaaagcctattatttgaaggaagccattactaaatcttgactagcgacaagtcccttgttaaatagccactcctcacatacttatttccttttttttttttttttttttttttgagacagtcttgctctgccacccaggctggagtgcaatggtgcaatcttggcttgctgcaacctctacctcctgggctcaagagattctcctgcctcagcctcctgagtagctgggattacaggcacccaccaccacacctggctaatttaatttttgtttttagtagagacagtgtttcaccatgttggccaggctggtctcagactcctgacctctagcgatctgcctgcctcggcctcccaaagtgctgggattacaggcatgagccaccatgcctggtcataactatttcttaagtaggacttttagaattggttcatcctaaagtgagataagcatacatgtatttgtgaaaatagtattcaattgagttttaatttgctcacagtattagaacacacctatggaagttttcctcatttttatgtatatttatattaaaagaaagaatgaaaaatttagtaatgtaagagtttctggcataaaattctgtatcacagaagctggaaaatttcggcccagggtgcagactcaggcactaacttgggggctttgataatgactctgccatacttctggccatgcgacctggaagaatttgttaaccattctatccctcaattgccacatcagtaaaatggggagtataaacagaacttagaacatagatgtttgtggggatgaataggattatataggtgagatacagagtactgttgtgcacacattgagtgcccaataaatgttagctataatctactttatcactatcataatagaactacagctttttcaaaatttcccaaaattttattctatggagaaaaggtcctttgaaagaactgacatttcctggatttgaaacactagactgaaaaacaaagtaaaacaaaatagaaaaagcctgtttttgtattttgttgtgttctgctttgctttactttcctcaagtactgttggaacaccagggggttccatcaagtttttattcttttgtgttcaaaagaagaggaaggaaaacaaggttatgcattggcactggagacacttttttccctaaaatgtttagaggcctagaatgtacctaataacttgtaaagcaccaactgtatttcctggttactaatcaaatttgtttctatttcatttctgagccaggaaggcagacacaagttataggtaaatgtcaggtgctttaactgacctacggcagtcaataaccagtctttcctcccctgatgaagtcaattactaatttagagaccactgtgttccttgtctcttctcctaagccaagtataccacaagtcaacaaagataattctttcagcagccaaacactagggcgaggaaatgcttactgtctgcttgctctgttagcagcaaactatatagggaagccatcttctggctcacacagagaaaagagaaccctggcactgccacagctgtcactggccttttctgtttcccaagcaaaaatcagaattgaacaggaaccaaaactattgagaccttccttctgtttcccaagcaaaaatcagaattgaacaggaaccaaaactattgagaccttcctacccacctgtgattaaatgagccaaatgagtagcaacgtggcagatggccctacagttaatgagattcttgcaagcccgcaattctgttgaaataaaattttgtcacttcagttttcagtacaaaattgtgccaactgaaccctccaacacttttctccaaaatgggaatcgtcaatctcacaagggtccattgtcagaggacaaccttcatgtacaagagtgttcaagataatcttgaattttgtaatggtctggaattgctatgactccctgtacaccagaactttcttctcacacattgatcacttcaagcatccacagtttttctttttctttcttttttatttatttatttttgagacagagtttcactcttgttgcccaggctggagtgcgatggtgtgatttcggctcaccccaacctccacctcccgggttcaagtgattctcttgcctcagcctccctagtagctggattacaggcatgctccaccatgcctggctaattttgtatttttactagagagggatttctccatgttggtcaggctggtctcgaactcctaacctcatgtgatccacctaccttggcctcccaaagtgctgggattacaggcgtgagccaccgcgcccagccacatccagtttttctagtagtttattcctaaatcaatatcctgactacagttaagcatcctaaaaatgaatgattacatttatagctgttttctttacaccttcatctatatctctaaatattgttctgattagacctcctgctttaaaacttcatcagctcactcaggcataagtcaccctgcattctgcactcttctggattttgagtccctttgaattgccactgaccatatgacttacccatccccatttccatttccatttattttttttggcacttcaacctcagtatctttctcctcctcctcatttacagcatatctccattgcacttctggccaacttccatagcacattttcttccttctgtagctaaatctaaatctgcagctgttttaatatggcatctgtggttaatttttagtacaatattgcacatattgaatggcagtaatgcccaatgctactgcaatattatgcaagacatcaaatggatggaacctattaactcattgcaaactcatgcattatgaacatggcatagcacttacctgaaacatacagtacctgtatggagaaactacaggttccttcaacgacttaagaagtgaggacatcgagcacattgcatcatcttcctgctgctgcagtgttctataattttcccacttacttgctcccaaagttgcatcaaaagaacaaagagaaaatgaaatccacaggaagctcccaaaggctgcctatttggctcagctgtctgtcgatttttctaggttatgagattgctcttggtgacttttgacaatatgagaacacttccctcacctttaatgatgaggcaaggggctccatacacataacattagatagatgagaattccacgaaaaaggataagccatccaatatgctagcatagaccaagatcttaaaataaatacatttgcattctggcagtttgaacagcagagttatttggaagaatggcactaaagagaatgagcccctttaagggcagccaagagctagattttgctagttaagcatttaatgtaaaacagaggccaattggaataatcattttgtactggaaaaaagaaacacaggctttggagtcaaacagaattagtttcaaataccagccttgcccctcagtagtggggtgactcaggcaagttactaacttctctaaatctcagttttttcacctctaaccaaggataatgcattccttacacacttcttgagaagataatttgatgtaaagcacccaggacaatgtttggtgtatagcagttacttcaatttttgaaaggtggcatacaaacataattatagcaggctttggcaggaagaggtataaaatattatcttaagaataaaacagtaggtactgaaattagacaaagacaattgaaatagaaaaaaattgttaaccttgtgaggttatataaaatagaataaaagagatcaatgaatagataaggtcagatggcaaaagataagctaagtaataagacaaggaagaataaaaggtgagagaaaagaaaagtagcaaatagattaaaatgtcaaaatacaggtatgaatggagtcttgcctttccagtaagatattatgagaacattagggaccctaagagagaagctgaagtccttcagctgacctggtaggaagaaggggagaagcataagaccccagggacacaatgcaagctacatcttaagcagactgtctgcagagggcttgagccttccagctctgaaggcgccctcggctcaggcagcactaaaggaaatgcactaatgagcagaagggcaggttgctgagagcagcgactgccgaacttcctggtcaagcaggggttttttgatttcataaatcaattacaatgtgctatattgatttcacaaagtcagcaggacttaaaaactaatgagcaaatttttttattattatttttgaaaacactgcagtgtctacagctcagcacactcggcagaaagacaaatggaggctttggctgccacagatttcattccatcctagccccctcccagccatgttcctcatctcagcatcagcaaagaatcaggagctggcataagaccctggtgcattatgccaacaaatctctccctggtatctgaagcaggggcagccccaactaatgtgtctgtgtttaggcactagtgagttttgtacgggtgcccaggcatccccagatggagcaaacaaggaaaagaacaagaaacccacctaaccaaggatataaaatacagaaggactgcatttgtgattgtggttcttaataggtagccactgccattttcttcccaaccatggtaacatctaaactggagtttttattgagctatttattttgtacaacatcaaacataacaaaattgataaggagattattctgccactcaacccctggcccaatgccaacagcttcagaaatgacctcaggtggagggaggcatagatagtttagtctttctccacagcaaaataaattatcccatgatacagtttttaggaaaaaatgcaaagtgggggataaatacattctgctaaaattttgctgttaaaatgtactacctgttaaaaatgtaccattctagggttgaaaaataattaatgttaaaaataatagctaatgttttagcacttgctaggtgataggctctatgctaagtcctttgcatgcactatgtcatttaattcttagaacaacggtaaatggtagatactattattatctcaattttatagttgatgataatcgaggcttaggtaggctaaatatctcctgagtgccatgtggtaagtgacattatgaagtctcatctgtttacactagagcctgtgttcattccatcagtaaatagttattgagcacctaacacatgccaggtactattctaggagtcatccgctaccaaaaaaaacactttttaagtcaagacaatgtatttaccagaaatgaaaatatttcaacgaatgatgacgttctttcagaatatgatttcatttattgtcaggattgagaaccagaaatccagaagatagttgataaactggctaaagggaaactaagagaataccaaacattattcttagtatgtgaatacaacaaattagagtgatgggggaacaagaaggaaggttaaaagtctaagaagttaattttttcttgcatagaggaagcagataaaattgaccaaatgtaaatatgagagaaagagtaattactagaagtaacactaaggaaataaaatctgtgtttcttaggaagtcattttgtctcacaaacacaacaaagccatgaggatagattaaaaaataaactgctacataaacttgatcttcaaaatacttctcaatgcgttcatgattccttttaatattattagagtaaatagtaaatatagcctgcagaagttttaccctcttaattttcattcctttatgctttttttcttgtatgtacttgatgactaaagtcacacttaaatgacttaagaaaatgtgctacaaagaaaggaaaacgaaaatttaaataatttatttttggtaattttcctttcactttcacaaaactcacaaataaacagaattaggtaaagacatgccccacaaaatactgccttttactgacacacattttttgctctgttttggtgctttttttttgtttaagtacaataagaacattaattcaaggtaggcacctgcctagatcccaccctcatttcctacaatcctctctcttcttcactactgttgagccaaaatatttcagttctacaaacatacagagctcatccctgcctttgtttctttgtctcagatttttccgttgtctagaatgttccttcctagatattttccttatggctgccttctgcaagactaacattatctaatacttcaccacaaaggtatttcctaccacctttatcagtcatgggtgagtaaaaaacaaatcaggtactcatatagtttatttagtaaaggggtgatttatagtaatatagtgattatttattgttataaagtttaacaatatgatagcacatataatgcagaattctgtactacaagagccagggaggagtggttaccaagggtgagagaataaaggaagaaacagttcctacagctcagaacatgaaaatataggggaagggtgcccaacaggaacctggccttaggtaaagaaaaacactgccaatcagtggggagctggcagggaggatccaggggaaagtatacccagccctcctcctcccctagttctcaaatcttctgcagatggttcccattggtcaaacacaaccagaggccagaagtaaggcagaccaacgacagagtccataaagtttggtcttctggagtggaaagcagaatggagaagggcaaagagaccaggaagggcaggtggaaatgatcatcaagaacccaatcccattgcccctagtcacttcctaccacattctttctgtttgtttatttgtttgtttgtttgttttttgagacagagtctcactctatcaccatgctggagtgcagtaccatgatctcaggtcactgcaatcttcacctcctgggttcaagcgattctcatgcctcagcctcccaagtaactgggattacaggtgctcgccaccacacccagctaatttttgtatttttagtagagacagggtttcaccatgttggccaggatggtctcgatctcctgacctcatgatcctctggccttggcctccaaaagtgctgggattacaggcgtgagccaccatgcctggcctcacattccttcttttaattatttgcattgtacttacaattttgatattttctttttagtttgtgcatctgtttaactaactataaattccagatttgcctgtctggttaatcagtatgtcccagagattaaaccagtgcctgtatactttagatataattacttgccagattaattaaaatagcaagactgctgggcatggtggctcgtacctgtaatcccaaggctttgagaggccgaggcaggcagttcacttgaggccacgagttccagacagcctgggcaacatggtgaaaccccatctctactaaaaatacaaaaattagccaggcatggtggcacatgcctatagtcccagctactctggaggctgagacaggagaatcgcttgaacccagtaggcagaggttgcaataagccaagatttcaccactgcactccagcctcagcgacagagcaagactccatcttgctaaactaaactaaaataaaataaagtagcaagacctctgtgattaaaaacaatacattgaaaaaactaatcattcatgaggaaatactctgtagtttataggagaatgatacaaaatgatacctcattttacctgacaagaattttagaatgaatcaactatagtcaactataccttgtaagtcaacttttacaactccatggctatcaggctaatcaggttgatttatcatatctagcaaaacagagatcatactacctatctgcagttaacatggcagttaaataacacatatgatagtcaatcatttctccatcaattaatctattaatttaacagatgtttattgaacacctactatgggattacactagacactgtgaatacagaagtgcaccaaatagccaaaaatcactgtcttcatgaagtttatatttgaataaggagtcaaggtcacatcgtcagaatgggcctcactaataagctgatacatgagccaagatctgaaagaagcaagaagaagaaaccaagcagatatacaagattttctggagagaaagaatagcaagtgcaaaagtcccgacgtgaagtccttttagcattttagaggacagcaagcaggcaaagttgtctagagccacgtgcgtaggttttgaaacacggacacagggcaggactaagggagagggaagcagaatatgttgtaaggacttaactttttctctgaatgaaacgggtggccacaaagtggcacatgacatgacctgattgacattgtaacaggggagcaaggcagaattagagagacagttataagagtatcacattgattcagatgagagatggaagaagtgatcatagtctgtggacttatatttgaaggtagaggtgaaatgatttcttgatgatagaatgtagggctgaagaatcagaaaggagtcaaaaaatgctgaggcttggggtcttagcaatccgagatgcccagaaagactttgttatttgtttgtttaatttattttccagttaactctgaaaaagagaggctcatccagttgttatttacctcattgccatgaaaattcatccagttactactgtctcattcccaagaatcattgaggaaatgtcttgtccttaagctttgtatagttaactttggaacaccatttttccattcaaagacttaccattacactttaaacatagaatataaacataaggtaagatgctggcaaaataaaaattatgaactacttcatttctgtgaatttagctcatgataactaaatttggataaattttgcaaagatggattttgatccagatttaagatttaatcagtggctttacaatttaagttagtttacaatgaattaaaggaactcctttttatgcagagggttttaaaaaatcaggttttcaatttttcaaatgatcttttaaaaacatttctatcataacaaatgtgggttaccaaattataaggaattagaatataatcatatgctttagtatcaaaactttatttaatataatttagtctttttgtcaataatttattattctttaggatggcagagactgtatagtatcatgaaggaacacaggctttgaagacagaaactaagctcaaatttccaattcctttgtaacttgctggcatcataaacttggatcaggtttcctaatcttcaaactcaagtatcttcattgatttaaaaatgatccccaaaataatactacctcacaggatcattgaggtaggattatattcacaggattatattcaagttttctgtttgtttgaatttagctcatttggaatttactaatttaacagagattatgattttggtagaaattcatcaaagcaacatttaagccaatacaatgattttctagctattacacaaatactcatctaaagttaaagtatacatcttttactgacattccacaaactcagtcattcttactgagtggaaaagctccaacttctgtgtattgtgtgtttttatttggcagtcactttgacaattttattctgaatttaaatctatttttagacctgcatgcattattttatatagtattgtgaagaagctgatatttttgtttgatacactatgttatgtcagtgcttctgattgccaaaaccaacagttcatgtttaaaacctttcagaacattctgcagtctgattaggtcacctctgaatactaggaactaaaatgagaccacagctaagaagaaaggagacaggtgcaatttttttcctacttattctcatttcctaataataatataatcaatagatcattataaacctctttcctgaaactctgccctcctccctgtttctctccaccctacacacacacacttaaatacaccgggttcccctatttgctccactactcactgaaggatcatcttcctcttcatttccttacacatccgggtgcttcctgggctttggtcctcgatgtttcctctcacttaaaaaaaaaaaatcccttttctacctctcttttatcagtctcgttacctctcatagcaagaaaaagtgtttttttatttcctgtatttcctggaaattgtatctgttttactttgatggctcttgtctagcagcaagaaatgaagaatccgacttggagtaaaatctttttgaaggtaatgccaagcccttattcctcttctttctccaattgactgtagcagagggccctcctaggggtcaatatttaactctttaattaatcaactgttattttagaatacagcataaagttctcacatatttaatatatgtcaacttattccctaaaagtccacagaaacaagcattgtggcagaggaaaatttattgaaaaatattgttccaaaatcttgcttcttgattatatttgtaggtataacagaattagactactttaatagctgaattcatttttatttcattgtggaataaaatgagtgctgcagatgccacactatggtttgattgttatatatgtttggtcatgtgggattagcctgatacatgtatgaactcaaatatccatgttagctaacaaacaaaaggagtgggtaaagagatgtgtatatatatacatactgaaagaactttttctatatatgagtgaatagcttacctaacgtaacagtctttacataataagactacttatttaaattttaaaagaatttacctctagatgggtttttgagtgaatttcctcagaaaattcattttcatggcacagaggattatcatacttggctgctggtctgagctcatccaggaaacagacttgagtgcttttattatccactagagtagatctcaaagaacagaagttactctatgattatttagcggcaataggacttaccacagttcctggcatttagtgttcaagaaatatttgttgaacttcattaaaaaattaagatagccacctcaatatcttagtttatacacacattttcaggcacatatatattatacgaagagaaatgcaataataatccttgcataaaacagatgagaagctcatctcactatgagatgggttggagaagtcttcattttctttaagagtttatactcaagcttgtcagtagacatcattaagctgttatgagattccttctcttgctcagttgaatctgcttcatgaaccaagtcaggttctcttccatggcaaaagtaatgaggtggggccaatgtgtcccattgtctcccaatatccacagcagccactcaacactgtagtgctgtggccaggtgaagggactctgaaactgtagtactatcctttgaagctaccacagttcttctcctctatgctgaattaaccacatccttgtttccatttaaataagaaagatgcacagaggttcaacccacccattattgaacatattttgcatatggaatttctaatcaccatattattccagggatgtttgcagacggaacctatttagatttttttgtacatggatgcctagagaattatggaaaaaactagaaatcatctagttctagtctaatacccacatttagcattcaaggtaactgagaaataaagaggtcaaatgttgctcaagatgactcagcaagttaggagccagtgtggaccagataagtgtccttttctctacaccatgtggataatggatgtttatagcaaagttaacattgaacctgttgagattcatgtagataatctggaattttatgtctcactacttgataatgttcataaattgaattatgtaaccaaaatctgtcctttaccaatacagatatcctattcaaggaagtaaaatttcactagtatcatgggcatctttagcatgtcaatttcagtagaccaagtagaactctagttaatttgttttgaatggtgaggcaaacaaagcatcattattcctatgaacatttaacagtttttgagtaatcatgatggcatgtattgaacattttggtgaaacaaatatctgctaatgatggaaatgtatttgctagtggtacaagtcttacaagacacgctgcagaagaaccttcagaaaataacctctgaccttgaagaacagatgttctaaaagcacacaacataggggttttgtaaatgagcagcactttggagtttttccaacttttcaaacattcagggaagtaaaaatgtcactatgccaggttttctaaattttcatatttcaaattagtataatttgagggaagttatttaaatgatctgcacattacttatcaagacatatatttctaagtgccaatgtccaggaattagtttgcttttctgaaataatatttaagataatcctttttaaaattaaaggatattttatcaacataaatagcctactcagaaaattatatcaacactaaatcacaggtaacaccatcatgttttatctctatttattttgatttttgaagtaatttaaaagggtatatttaaacattataaagtacactaacaaataaaacattttgtagactcagtgaaaacaaatttatttatttatttagtttttgagatggagtttcgctcttgttgcccaggctggagtgcaatggcgtgatcttggctcactgcaaccttcgcctcctgggttcaagtgattctcccgcctcagcctcctgagtagctgggattagaggcatgcaccagaaaacaaaatattttattcatcattagtaacatttgccagaactctgtgctgtttaaacttcataaagtatatcacatgtaggatattttctagttttctagtctcttctgtatatatgccagaataatatcaaatactttcatttaatcagttatgattattttataccaaagaaatctcattctagaaaagaaggccatctattcaccactcctgttggccattaaccttcatacctcccctttcagtgttctgtcttgggtcttctttcaccgtataaatcccagggttgatttgatccagtcactctgcagcaaacatccttgtatgtctctttgtgaacgtcaacaattaggatatggacttcctcagccttatcagatgttgccaaattgctctccaaagaactaatatcaatttacattccagccagcagtgaatgaaagttccagtttctctacctcccagacatatgtattgtcatgctttaatttttatcatctaatggctgtgagatgcaattttattattgatttaatttttatttccctaatcactggtgaagctaaacatctttttacatgtttatttgtcctttggttttgcacttctgtaaatcaactgtttatatcctttgcctatttgttgtttctttgagcttctccctccttctccttttcctattattcttcctcctcctcctcctccactcctctttctccttcttcttgttcctaggagttcttagtattatctgaataaaaaattctttgtcagttctagttttatgcattacaaatatgttcttccagtttgtggcttgtcctttactttttttttaatggcaacagaaatttaaattctaatgaataaatgtatcagtcttttcatttaacacttaatgccttggatgaaaatgttttatcccagggttatagaactattttcttaaatgttcttatcacagttttaacattttgttgatcacatttaagtctttaatcaatctgttgtttgtattttttcataatgtgaagcaagaatctaattttaatttttccttatggatacttctcatttattaattaatccactagttcttccttcttctcaattttaatgcctttttagtgatacaacaaggcttttatgagtgaggactgctttgaggctttgtatcctcttcaatttgaccatttttgtatcccggtactattattatactgttttaattgttatagctttataagttttttggattggtgtttcagttatttattgctgcaaaacaaaacagtggaggttttctaaaaaatcattattttccatgattttgtgggcagccacaaaattccgtttcccatggtatcagcccaggcactggacgatcatgaggtccaaaatagcctcattcgcatggttgactaccacagtgctagctgacaaatgggagctcagctggggttttcaactaaagcctttgtttttctccatgtgggtatctctatgtggctatttgagctttggaaagcatgataggtgggatccaagaagaaatattacaaaaagcaaaggcagaaattgcagatgtcttaaagtctagcctcagacatcactcaaagccacctctgccttattctattcctacaagttgattaaaagaaggtaaagtagactgcacctcttgatgggggagtggcaatgtcactttgctaaaaagtacctgggaaggaaaatagtgttgtgatcatctttggaaataacaatctattgcattctggcaggacaagccttatcatttcattaggcttcttcaacaccattttggacccttttccttccaactatgaatctataaattttagaattaacttgtctggttccatccaaattttataatgtgatttttgagtgaactttcagataacattcttcaacaaatgtttattgagtacctactatgctcttgcactaatgatacataaatgaaaaaaaaaaaaaaacagataaaacctccatctttcattgagcctgtatttcggattatgtggagaaaattaaaatatttatgacctttgttattctaataaatatattttgttttgcaaatttggttaggtcttcttttatgtccttcgtctaagctttataatttcttcttatccgatttattcttagacaaatttttgtcttgtttctcccaacatttagactaagctctttgggcaaatgttttaactttttgtcttctgatagcaccaagtacactgccagatatagcaggacaatgtaacttggtgaacagactgaataaaaactgaagtaaaagatttaattttccatttgtaaatattaatcatgccaggtcaaactatcttaaccaagttaagctcctagaaataagtagcattcatgtagtaagtgagttgccatcactatattcttatagaaggtccctcgtataaaaaccagtaagtaatgtaaaggagcaactacccaggtactccagtggttaaaaggaaaagatgaaaagaaagaaggaagaaaggaaaatgctctccaagctttatacggacatttaacgtagttaaaaatgggtttgcctggcctttgctaatcacacctttagctaataacttcgaaatttgcttctacattaggtacagtgtggaacaaattagctcacttaataaatggaatgaagctcagtgtgagtctctttaaaagcacaagaacattcctatttcatccctcaattaccaaatatctgcaattcctagttttgcatcatgctgaacttctaaagtaggaaaaaagcagttgaagtaatattacaatagcaaatgatacaaaaatagcattaagtaccaaggatacctaaagttcattatttcaattctttactctcaacaagggcagatctgacactgtgaaaattgctgacaaaatcatgacttaccaccaaacagaattttcaacatttcaagttatgattaagataaggaatagcttgatgactatttcactacattcaatactatttatagaatacagctgcagggctttgtatatctaataattattgtgaagaagttttacaaaacatcagtcctttgagaatttctatacattgtacaagttatttaaaatctgccaaatgttacaatatgaaatgtaaaactaggaaacccaaatgcaacaagtggaaaacatgggctcagctaataccacaacacactgccaagatggaactctccacaaggtctatcttcctgctacttctgtcctggtatttcccagagttcatgccttctcattccaagtatatgctaaatactcctaaatctagatctctagcccaagatgtgtcagttgagcaacagacccatgtttccaattcctctgaggtgtcattgcttgaatgtcacagaaataatgcacattccataatctcaaacataacccatgatttccatactctcctccttttgtatttctctctccgtgaatagaaccaccatccacccaggcctctatgacagaaccttgggtgtcactgaagacactttttcctctctgttacttctcatatcaaattggttaccaagtcctgggaattacacaggatctcatctttttccttttcttcatacccactgccatagccttggttcaagtcctcatcatctcttacatggcccatggtagcagtcagctagcaggaccccctgcttctagatgtacctcttttaatccattctccaaacattcaccaagtgatctttttaaaacacgaagcagataaagttacccatacctacctgtttaatacctttcaaaggttaccaatattcttgcaggataaattacaaatccttaacattattccctggctcttgtctacatctctatatttttttattaagttcaggttctttcctcatctgctacctatccatgccagacaactaagactcagactcagtctcactaatttgtagctttgcttacactgctccttctgcttaaaagatcttcaaatcttctcccctacttgcctttaacctgatgaatttctactcattcttaaggtctaatacaagcattactgcctctacaaaccttcctgaaatccacagaggaaattatacacttccatctttgtttcataaatctaataagaactaatatttatggagtactgatattgcattagacattgtattcagtggtttattacattattgtatcctataaacataaattattttcacattaccttactattatatcctacacaatcacttgtaaattattttagtacgctttattttacctacttatttacatattttgtaatattatcctactaaactgaaaactacttaggactgaactgtggttcatcttactctctattgcctaagctacttcattgcacaagtaggtctcaaagctctgttgataaatgaagtttaatggtttcaaggagactgatattatataattagagatgttaacaaatgcattaaaaattttaacgcatcttgaatcaaagcaattatctatctaacttagtagctgtgcaacaaagtaaaaagagcaagagtgccattaatatatctcaaagataagcttgtttaataatgcatgtttgggctgggtgcaatggctcacgcctgtaatcctagcactttgggaggccgagacgggcagattgcctgggctcaggagtttgagaccaggctgggcaatatggtgaaaccctgtttctactaaaatacacaagaaactagccgggcgtggtggcgcgtgcctgtagtcccagctactcaggaggctgaggcaggagaattgcttgaacccagcaggtagaggttgcagtgggtcaagatcgcaccactgcattcagcctgggtgagagagtgagactccgtctctacaaaaaaaaaaaaaaaaaaaaaagcatgtttgtgtcaatcacttatgtgtttatttgagttaattagcgcctatgcagttttctgcttgctcaacttattggaaaaaaaatttctaagggtatgtgcaaaaatattatctaaagtagcatttgaaattttgctctacaattacactgttaaacacagtaattctaaacaattccatgtgaactaacatctgtaaatgttcagcaattatccacctgttgacagtctgtaattcagctttgtgagtactactggtttgtgacattaaatcaagaggtttaatattttatcttggattaaatgcaaaagataatcaagaataagacagacatttagctgcctggatagcagttatagatctgtttatattaatactaacagagagtcaaacagttcccaaaacttttagatgtgatggcaagaataagagcagaagatgatctgcacatcaaacagctttttcgtctttgcttagtgtcaagcatttggcaaaacaaccctttgtattatttcagcatttcagaggcctaattttccatagttgtgactcacatatcctattcataggcagaggtcttataaaaatgaatgtgactgatacaatctcttataaaaatgaatgtgactgatacaatctgagcaggaaatacttattaccaaatgaccacaaattctttcttgtttgtaaaaattaatttacctgtgttaaattgttttaatcagatttcattttaaaactagcactttaagcatgatttaatctaacaactgataaaacaataacatttcaaaggcatatctagaacagtttaaaccaaattcttgtctgttcataagctctggtaaaacttttagatccctgctatttagtaaatctcttaatatgtattcatgtaactaaatactcctatacactgttttcctaaattcagggttctggatgttcttcccctcattattaggacaccatctctctgttctatcacatttcttcccaagcaagtttgtcatctaaatacctcattaaataatcttataccttattccgtcataacaatctataagagaattgttccccaggcagaggaagtcctcaaatttgttgctatttcctattctcttcttaattagtggctcaactatccacaaaatcacccaagccagaagcctacagtcatccattccactccatccccacactcctaattggtgattaagacctattgactcttcctcctgaatatattgcaaatctatttgttcctcttcaagttcactaccactgcttcatcattcatcacttggattattgcagtgatttttctaactggcctccctgcccaccaggctcagtttcatcccctcatttctcccccattccagctcattcttctacaacaattgtaattatatttctaaaatgagatggctgatgccattcccctacataaataagatgcaaaccaaattcctaacacggcattttagcacagcctttgcatatctcaccagatttatgtctcatctaccttcccatatactccagtgctacaattctttttctataagcagaaataagtgcctccttactctatgtttacttagcatacactgttgttttagtactagttgcaggaataaaattcaaaatagaagatagaacaatattttttaaagcacaagaagcatagttaatgtaaaagcatagcacaaaataaaatgtagacataaatcaaaatatatcaataacccaataaatacaaagggactaaatttgcaagtaaaggacagatattgcaaattatatttttatgctttttgcaagacacacaaataaaatacaatgacacagaaaagttgaaaataaaaagatgaagaatgacaatgaacagaagaaagtgagacacttgtagagaggcaaaaaaggcacattggaaataaagaagtttctatggaacaataaagaaggaatcagcaaaaaatatagtaattccaaactcatatgtgagaaataacattgtccagaatatacaaagtaaaattgagattagaaagagcaattgtcacagatcaacaataatgggagatttcaatgcacttttcttataactgatacatcaggcagcagaaggcattagtggattgtgggagatacaaataatgcaactaagaagtttgttccaatggctatatgtaaaaccatggaccctacaattagagaacacacattcacttaaatacataataagctttaaaactgaacatatacataaagcaaatctcaatcaacaccaaaaattcagtatcactcagaacttctgtgcatataagacaattaaattagaaatgtatttattactattttagttataaagaaaacggaagacagggcaaaagttaataaaattggaacactatagaaacacagaaaaccctcatatttcaaaattaaagatatttgtactacttttatttatcattttcaattgatggtttgcactcaaatatttcattaagacttcagttatttcaagaatttaaacatgattttatgcattaaaaggtatcagttaaaagacctgtgactgaataaaaatgtaaatcaattaattaaaaataggcattgctaaatcgacactggaatctgaaattatcatgggccttctgcctaacattttcaagaaaaaacttgggattcctgaaaaaaatatataatcaaggataggtaagcatctaataattaaattaagatcatcaatttgtattacacagaaaactgggctgttgtcatcttgtatggatcagaacatgattatgccataaaatccattcttctagcttcaatcactattgtctctcttttctaactatagaggtgatcagacagcatgcatcccttttaggtcacaaaagaaatcctattaaatgccaacctataaatggtgcttccggaaacataaactagatcagggttagtttgggatgaaataggccttaacttagatagaaagtagaaatgaataatgtacatttcataagtctttaagcaaaaaacaattggcaattttactgtattttatcaatttatcttagttgaattttatatcactgacagattacttgaccatcaatttttctgatttgtatactaattctagtcttattttcctaaaatgttttcctaataacagcaatgtattcagaaattgtaattaaaagtcattgaaggtcatctgatttgttgtgttggctttagatcagtgactagattttcccagtcactgctctgtcagctttaatacaatgcatccatttgtcttactaacacttcaatttatgggatagctgtttttcacaattaaaactactgaagctttagtatacatggaaatgatcatgatagcattttctccatatttctaacaactctggaaggctctattgtaaaaatatagggccttccagatgactagatctggtttcctgaagacagcttttaagattgctatatgagctcaagagaaacatttacaagaatctttagataaattactaagtgctgcagaagtaaaaccatttggaatagatttctaaactcctcttacataaataattggtgagtgattgaggtaagaaaaggctgcccttactcttgctgacccaatagacaagacagctgatgacgaaagttgatggcgaattggcacaagaaggttaaatgcaggagaaatgaaaccgatctacttattgtgatgatgttgactgctacctagttagttctatgagagacaacacctacttacacaaggtcttccacttaattgggcttaaggccagttcagtaatcacaaaattacaacaagctaaaaattacaccaatcacctcctccaacctctgtatctataaagaaaccatgaacttatataatttacccaggaaacaggagtcagatctgctgcctcctattacaggagtctttacattcaattaaactgaattagatatatgaattcaatagaagaaatcttgatgtaaagtcaattagtataaatacaagtcctccctcaccccacacctgacaattacaataaaattctatggggagcgcattatgaagagtagagaagaatgccagtgcaattctgtaaaagctaaggcaatctgagaatttaattttggtatgtctagccaaagtcaattactcatgaacaacaggctggaaagtgaccaagggctgactcagcagctttcaaactcttctgttgagtttaaaaaataaaatgcgaaagtagagagagaaaataggaaggaatagtccaagaaaggacgataaaaattaaataggccaggtgcagtggctcatgcctgtaatcccagcactttgggaggccgaggtgggtggatcatgaggtcaggagatcgagaccatcctggccaacatgatgaaaccctgtctctactaaaaatacaaaaattagctaggggtggtggtgtgtgcctgtaatcccagctactcgggagggtgaggcaggagaatcgcttgaaccagggactcggaggttgcagtgagccgagatggagccactgcactccagcctgacgacagagtgagactctgtctaaaaaaaaaaaaaagaaaaaaaaagagaaaaaaattaaataaactaataataaaatcataaaatctgggctgtgagttcacttctagaatgctaggtactcatggaaatttacctaaaaccaaaaaggtgaagtaggagctgaagacaggggtgggggacagaaggatggggaaatgggaatggggggcacagacaggtggaaaatttagaggaatatagaatttttcaccagcttgaagtaaaactttctaattattttaaaaaaccttataatatatcattactatgtagaattaccaacagataaatttagtctttaatactcaaaaagaataattttataaagaaagttaccacaagacaactttagtggatcctaattgtattcataatgcaatttacaaaactgtgatttacatacatcttgtcaggcacacatcaaggacacaaaaggcacactcacactatctcaaagcatgtaataaaaaagggtgctataggaaaagaaacccaccagtttctactgactgtatctcttccttttctttctgtttagccttgtcatcattaccaaggagcttgctcattcctaaaacacatttgctacaaccaggcatttctctttcagtcagggcttcaccatggctgggaaatagacattgaggaagcagagagtgcagaaatgggtatgagtcttagagtccgaagacctaggttccgaggaggtcaccgtctggttgactgaccatactcaagctttattaacttttaggagctcagtttcttcacctaaaaaaatgagatcgttggattcaatgatctctaagctctctgacttgaaatggattcaattcactaatttcccctttttgaattttcctcatattctcttaaacagagtcgaatgggaagctttttcaaaacaataagtaattatttcttatctataatattctacttatatatcaaactgccctcgcctttgccaaagccctcagtggacaaataacttcaaataactactaattctcagagcagtgcaagtcatctaggatcattgtttacattctatacatattgaaaggctttctgtaaaagtgagaaatgttttaatttttaatgataggaaaagtaatgctttctacaaggttgaatctaaatccaagccatagataagagctactttaatttaactggtatttatggttgaggagcagaaaacaaaaagaaaaaaaattcctttgaaaatgtttatttatgacagtctaaattactcctttgacacaatgaacacaggtaaattatctcagagctgtgtttaatggctctaatggctagctgggtactgggccatgtatttcaggatgcctacttgtttataaaacttgtttccaaaaatcaggctaatatagtactaagttaccaagcagaattttttttttaattccagagtcactggccatatttcatatataattgctgggttaaataaacacaattaggttttatttagcatgtatttgattatgaatgtcttcatataaataaaaaacaattttttaataaactagactaggaaaggataaaaacttagtatcattattattctaaacataccaaggctcaagttttcattacctaaaatatactcttcgtaagacttgtggctgccgaataaaatacattcatcagatgcagtattgctttcacggtaattatgatactatttataatgccatggttatgttcataggccactaacaaacatatgcagtcttttagctacaacactcaaacataattacaatgcccctttccattgaaataatctatgcatcccgccacagtgacttcattccttaccaggatgcctgctgaatcagactgccccaattattcaggcacagtgcctatgcttatgactaataatattggggaataaacgaaattaatgtccatgacttcctgaccattttggccaatctcctttctttggtgtcttctgctttaaccctaatactgagtaatcttgaactattcctggcataaaaagagcttcacatactgtacaaagtcttcaagccctacaccaatatttcccatagtatgttccaagtatttcagtcttaggggatattgctcaaaaaaatcagagtgcggagaggttccaagatcgaatacttttgggaaactttgcatactatattcccaatccttaggattctcctaatctattcatatactgaaggctcttataagtcctgaagtaaagaaatattttatctacatttaactcacgcaattgcaaaacttacttaaccatgaaacctatttcatattactttttcaagtgagtcttattaacataaaactagtggcaaatatttgggtgtccctgtcttcatgcagaatttgactgcccaggtcctattcctctagagactagttagattctggccagttaactggagaaatcaatacaaattgagaggttaattttgttaatagattcatgtgttgtctctagcagagggtggttgattttaacatacatttgcaatgcatcagccaaagtgcagcataaaacggaagagaataaactgtgagactataccttgcacatgttttttattgcatgagtaagttctatatcaggtctggaatttctgtactcaaaggacttatattctgaagcaacaattacaaatattgagtggaggtaatatttgtggacattgaatcaaaccagttttctcacctaacataaataacttacctgcattttgatgttaaaaaaaaaaagccacctgccaagatctggctgtggagccatggctgtgtatcagccatgtatttgagtagtgacaaatacttaattaacagggtcattgaattgagaagaaggcctgaattttgatttctacaaaaaagtttcagagaaagatttttgctttaaaagtctgactctttataaaatttcttcctgtctttaaagaaagtcaaaacatggacaaaagccacaagccacctatcaatattcatgtgaatcaaaaaattaaatggtaatgatgaggatgagaaaaggagagaaatgtatcttgcttccctgttaaaatgatgacacatgtaaggacagccccatggcatggtgtctgatacttcatctctgttagctttttcttcccataatgcttcttccctcaaaaaatgctgatcacagaaattttgaaacacaagatatttgtggctttttttttcagtggaaaccatcattattgcctgtaaccttgatccgttctaatagaggactacagaactaatcctacaataagtcaagataactgatggcattggcaagtagttgaaatccttagtctaacaaatactgctttcaaaagactagtatactcactgataaatgcctttttaacttatatcatgtcaattatttgctattcattatctttataaaatatttcctggtttggggaactctgcaagtttcttgtttctgatgctttgtttaaacatatacaactatgtatgttcagtctgacaaagccaccacttcctccagccaaaagggaaataactctagtagaacgcagtattttaagaacagattttgttgttaggctgtattacccccaaagaaaaggacaaaattagtaagactgaatttgttactatttactcgccaaaccctcaaggtagtttcatagagataatcacaaaaacaggaaatagtacacaatgtgggattggtgtttttcctacaagctccttttcctatggattattttttttccaatggagagaaatgcttttttacctggataataaattaaaaagtggtttcttgacattttactgcttttatttattccatttaaagaaaatgatttccaaagccagacaatggtgctgttcaatagaaaatgatgacctttaattaaaactctgccccttactaattttcacatctttaccaacctcctcatcaatgtggaagaggcataattgaagggagaaaacacctgatctaaatacactttatctaaatcacttcccccaagcagacattctctatctcagttcctagttcatttccttcattgtatttcctaattcaaaattatttctttcttcacctgttcattgtgcctgtgatcacataggccataggttttatatgggagggagctttgtagactagtgacttcccagtgttattgctgaagaaaggaatagataagggaagaggaggcaaaggtgaatatatctgatgaatcggaaaaaaaggtatgtggtctcaaatcgcaattaatctctaaatgtaacaagcaaaagcaaaagtaatgcttttgtttattttactccatctttttttttttttttttttttgagacggagtcttgagctgttgcccaagctggagtgcaatggtatgatcttgactcactgcaacctccgcctcccaggttcaagtgattctcctgcctcagcctcccgagtaactgggattacaggtgcatgccactatgcctggctaatttttctatttttagtagaggcagggtatcaccatgttggctaggctggtctcaaactcctgttctcaggtgacctgcctgccttggcctcccaaaatgctgggattacaagcgtgagccatcgcacccaacctactccatgatttttttgattatttattttgaaattattcagcatcttatctcattattccattattacagtaattatctaccacctgttgaacagtacagtgccaggtactttacaaacaactttgcaactatcttgcaaggtaagaactcctgtgcctgtttcttgcagggaagctgagttgcataaagtgaagccacaaagtcacagagacaggaagtggcagagtcaggatttaagtttacttctgcctgattccaaagctgtactctcttctctacatcacaccacttaactattaagtggtgtgataaagaggtatgcttaagcctcttaaagtatctgtcttaccaaattgctaataaactttgcaaaagtcgaagctagaatctatccccctccaccccttctctttctccctctttctgtgctatgtatatactactctacatcttgaaaagagtaattttatcttcatttgctttgtagtttattcaacttctatttccaaaaacttagctttttcctgggacaaatcccccagatgttttctattctcttataacttcaacctctacctgctaaagtagaagtctcaattatttaagagattcagaattatgtattataaagtttacaaattatgtaataaaaatttaaattcatttaaaacttgagtaattatgatgccatcagcacactataagatgtaaacattttaatggtgaaatatttaaaataaatatctttgaatgttcaaattctgtttgatacatttgttctctttatttcctcaaaattacagtcttaaatttttttttcttttgagatggagtctcactctgttgcccaggctggagtgcagtggcaaaatctcagctcactgacacctctacttcccgggttcaaggcatcctcctacctctgcctcccaagtagctgggattacagtcatgtgccaccacgtccagctaatttttttgtgtttttagtacagatggggtttcaccatgttggccaggctgttcttgaactcctgacctcaaatgatccaccctgctcagcctcccaaagtgctgggattacaggcgtgagccaccacacccagcttacagtcttaaaaattatgtattgcttattggttcttcactgtaggttcaagagcattgtcaattatgcctctgtgactcctaaaccagattttaccttcaaattcttgggtgtcagttcctgtttagcatcaacacattgaactgaaattagactgtgactcaccatgtatttccaaggaattaacaaattggctctttttcctctcccactatttggatattgaaattaaagtagctaactttaaaataatttcttgatttttaaattacccttgaccaactttttattggcttcaatctgactttttttttttaacataaaatagcccttaaatgtatacttatcatgatttttttcatttctaaaataagagataaaatatttgacaagcaggactttcacactgtaggcagttcaactgccactgaaactttaattaggtcaaacttggaatctaaaatcttaaaatgatatccagtaaaagggaaaacctgaaaacataaggtaaaggcttttttctgaaacccttgccagtgtttccctgtaaatgttacagccttcaaagaccactcaacatttcccaccattttaaaatccataatttattacaaataagtatagtagaaaggttctattccatactgaatatattaataaaaatagtatttttaaaaaaaaagttcaaaaaattgtcaagtaactcaaaagttacacataacataaaaaccattcacctcaaaatagccattatttcagatattttgataaaaatatatacaaaggaagctacagaggaagaaaggccaacaggtaatgtggataggaactgaagatcagttttgttaaaatggactcaagctacccacactatattaaatatatgtaccatattaaatatagctatacttgaattaatcacagtataagaactttaaatgaaattaatgaatttactaaaaaatgagatgtttcttttttcttgtttttttttaatgcccatctttatcctgcagtagagataaatgtttcttaacactccaaaatgtattgtgtaataaaatattgatgagttcaggaaaaacttatgctttaaaaagttgggaccattacttgctataaaagctgaagaaatgaacatattaatgttttatcctaacttccatcaatttgatattatatttttcattgttcattcatagtttctattttattcaataaccatagtgctcatggtttttaattttcgttctgaatttacattgattaaagatttatattcagttttttagttggaatccctccatacctgaattgtttgtcttgattcacctcttagtaggctgaaattcactacagcttttttgtttgttttgttttgtttttacagggtggctattcaatttttttttacttataagaacaataatgtatttgttcataattgtgtgagttagcaaggcaattctcatcggggctggcctggctcatctctgaagtcatctgccagttttgaaggggattgatggtctaggatagccccattcatttgtctggctcttacaagcttgttggatttagaagccccagctaggatagcacatctctgctccatgtagtctttcatcctccagtaggctagctcaggcatattcacaagtggtagcctcaggattcaaaacagcaaaataagacagaaggccccagtgcataagaatctttttaagtctttgtttaccttattgtttttcagtgttttcttgttttaattttccttaatgagggtttatactatcttgtgtaacttcttatgggcttgaaaatgtttgtgcatttgaatttatatttaaaagataacttgggtgggtataaaaccttggtatatactttcttgtactcagaatttttacacataattctataggattttggtatttaataaacctgtgggaaaactaacctcatttttctctcttccatgtgacttgatattcatgctgaataaacacatacatgtattcattatttttaatatttattaaccttaccgtgatacagaatgccattaaaatcatatgtaagtctttatttcaggaatttatcttctactattttaatattcaagaatacaaattatatttatattggatcccttttttttcttttccacatctttcatcttcccataataaatgttgtgtttttgtgcatttgaactaaattttatgggatttttttcaaagcttttctccatatttctaacttggttttcagtcacatttattccacttgttgttattgcttctaatatttttgtctatgaaagctttcgtgtttctctcccatttctctcctgatatacataacctctttcatctgtttttcattgaacctctactttgattctcatagatattttttcaggctttttgtttgtttgtttgtttgcttgtccgtatcatatctagtataatttccctgagcgaatgggtaatttttatcctaatcttccaatgttttttgggaaatttctcttgtgatttttttatacagctctttgttgtgttattatctctttagtctcctttctatttgatggttgtagattgagagaaaaaacaggagcagtttgcagtctcttgtttctcttgctagacttttttactccattcctctgtcaccaaatctcttatttccttttcccaggtcacacctctccatctggagtgagtggctaaaaacatatccttttgcatcagagactttctatgttatggtttgtacgtactgtctcttcttccttcttcactcctcttcatctctggcattctctggttctgaaacttggatctaagcaagaaccctgtcattctagtatagattcttcttcagctacctgtcctggaggctttagggattcaaacttgtccttccattactatatatctcttccttctgagtcagggctctttagaaccttcaagattgtgactcttgcttttggagaattatttatcatactctaactagtactatggcattacaagaaaaataaacacacacgcatatgcactaaagcagaagattacacatatcatttataaatacatattgttctttagaaaagttattattatagttatagcaactaacatgtctcataattgtatgtaggcaaatatacctccttcccacattagttagaataatctttggatacagtaacagaaaatccaacaatgttttaaaattgttttaaaatatgttttaaaatataaaagggtttatcatttacctttgaaaataaaaagtcaggaagtagtgtcacctaatgttggattgctgacttaatgatgcctaatatctctccaattatttttggcttatcacctcatagtccccagatggctgctatcctgtaggtattagatctgtgctcaaggcaagaagaagagtggggggagcactagctacaatcatcctcttttaataagaaaacagaagcatctttaccaccgccaccaccactatcacttccagcaagtttctgctcacatatcagtagctgctaggaattttccaatgcttttgtatagccatgcaagaaagaagagtgttagcaagagctttcgactcagccaaccaacaatgtttgccataccccaaatgctgaactcctccacagaaaggatttgagcatatccatatttgtatgcccagttctcagcagagtttgacatatttgtagatactaattaaatatttgtcaaattatactcctttatggttaacattatttcttctaaacctaacaattgaattgacattttcaaaaacacatttaccatgaatcttagacaactataatataatagagaatctacaatataaatctataaaatctcatattattaaactgaaattaagattatttgtcaactatgtcaatataggccaggcgcggtggctcacgcctgtaatcccagcactttgggaggccaaggcagacggatcacgaagtcaaggggtcaagaccatcctggctaacacggtgaaaccccgtctctactaaaaatacaaaaaataaataaataaattagccgggtgtggtggtatgtgactgtagtcccagctactcgggaggctgaggcaggagaattgcttgaacccagcagacggaggttgcagtgagccaagatcatgccactgcactccagcctggggcagagcaaaagtctgtctcaaaaaaaaaaaaaaaaaagctagcctgttctgtttttaataataaactattcagaaggttacaaattcagtagaatacacaattgctagtgaaaaaacagaaatttacccatagagtgcaattaggaagccagaaagtgctttacagtgctgcattgtctttctggagttaaacttaaaactttactgtcaatatttatggaaactttcattctattccataacatgtacatgttggtgataatataaatgagtattttttccctaaaatttttagtagaatttcaccctaggctatgtgtaactttaataatgatgatgataatgatgacgatagcaaatatatagagtgcttacatgtaccaggtacttttctaagcactttatatgtatgaactaatttaatcctcataataaccctaggaggtaggtattatcatcaaccatacatacagaagagaaaatggaagcagaacttgaggaagtaatttgcccaaggacctacaggttgcatgtggcagaggtggaattcagtcccagatcatcaggccccagaacctggcttcataaacacctgcccttgaaacccactatggagccccaggagtacccatccatggttttgaccaacattacctcctctgtcatttcaagaactctataggcattatctttaggtttaatatatgaggaaacagaaacttaaagaaattatggtaacttgccaaaaatcacaagctccgtagatacaagtcaaacacaactctctctggctctggagtctacattcttatccactgtgcagtgcactgtactgacagaaggggaaaaccctacagtgtgtgatgcacttcctatgtcacagagtatgaagaatgtcacaaggtcacggaatttcagagctgaaagggatcatctagtccaacccattcatttcatgggtagagaactgaaacccagagaaaatagaaatgccaccacctcggtgccagatctcctagatgcccacctacaggtcagtcctctctatagtatcttctccccttttccctttaggttgatttttcatttaaaaattatttgatataatataaattgttatagctcacaattgtgaggaaattataaatatttgcctttatgattttagaatgatgaaaacctttgttattctgcagactttctccaaagctttatttcaaaaagcatcattgttctttttcatcttagaaaacataaaacctacttgcttgtcttcaggaaccctacgaagataaaaattatcacaatttatacccaacatacctaaagaaccctgtccattgtgccctcattggttgtcctcttaacttggacaaatgtaatcacgtctttgatgtatttccagcttcacggtggttttggatatacacttctgtaaaatgatcaagatttttgttggaattcacgagtgtttgttaaagttttattaaaagcgatcctagaaaatataactagagcttactataatatgttctgcaggtgggaaaaatgttacagctccatgaacataaagcaatcattaattagcagcaaagacacgccattttcaatcttatcttttcatgattttaaaaaaaccaacacttttcccttatattttccaggtaaggcatcttaccagttcttatgcactgcaatggccactaggtaatattctttaagcaatactgttatacatattattatattacagcaatcctaaacgagataggaaagacatcatctttcattttctacatggagaaattaaggctcagagaagttaggtgaaaagactaaagtcaaaaatgctaatgggtgtaagaacctgactcaaattcagatctgtcaaatgcatctggtgtctgtccttaatactctattaagttgcctctcttcatttaataaaattctctaccattcaaaattaaagttgtatatctataatgtttgctgtttatttcagtgagtagttatttcagtttttaatagatatgttttcctttattaggatttgttaaaactaaaaaaattaataataacttcaaacaatcattgttatcatttccaataagcaaagcagacaatttaaagagacagaattctcagacatgcaatgctatttcaaagtccattcacgtgctgtgcaaaaagtcacattaaaacactttatactgaactataccatgacctcggcaaacacagtactcctaaaagcacagttatacttgttgatggctatgagtacagattacttccttttcttgatacaaaagtattaaaagtattaataccatacagttaaatctgaggaataattaatttgaaggaaggtaataggcaggtaaagcagctcagtataatcaaaattttcctttaaagaggttgacagttactctgatgtaatatcctggaagtttttttccaaatgtgcacttctgatttgcatgaattttaaagtcattactggtgaatacagaaaagatacaggcccactctcacaaggatgtagattgatctctgatatctagccttcccagtgtgccatttggggtgtgaaaaggtaccccagagccccaaggtctaaaaacccactaaatcagggtttcccaggactgctgttttataaacactccagagaatttgtctctaaaaacaagtgatgaaggacagagacaaaagggggagtgtaaaaaataaccttttttccccttaaagcaaagaatcaacattagtttgtattttggttcattgtagaagtcgatcactattgtgcactaatcatttcactagaaaaagtatttcttttcctaccattcttcaccatgcatgctttagtgcttcacaggtgtacaagtgattttcttaaatttataaccacagtagacttacatagatcccttataaaattgatgcagcagtggtaataggtttacacaaaaattgtaatttatgtcattctgttttgttgaagggaatcttggcttctatttacagctttaattaactactgtatacttcctaattgtataacctgtgagattatggactatataacttaagaaatatctttatctgggaatcccaggtggtgcctgtttgtaacatatgcattcttgaaatatattcttctagacaaaattagtttttagattaaaatattggagaagatactgttcctatgatctcttttattttgtacttcaattccaaaatttataatgtatttgccaaagactttctttagtagctaatggaaaaaaattctaaagaagagatggtggtaaggctgtaattttttaaaagaatgactattctttcattgagatgatatatgtcctatataaaaacttcaagtaataaagagaagtttcagaaagtttcactttaagtcatccaaattccatttatcagaaaaaaaacagccatctctaccaccaagtaaacatcattccaaacatagctaaatgtttaccaaggtagaaaaatggtcagagagatgtatacatacataagccttaattttgaaaaaaatgaaatcaaattatatatgcattttaatatttaaatgttatattttcttttcctttaatttgactaaagaaaatttgaactaaaaactgaaattcaggtaaacgtttcttaaacccaaaacatgttttcttttctacaagggcactccaaagttgaggtaaaaaatggaaaaactttaggaggttagaatcatctgtctatttcaacattaggtagtagctattaaccccatgctatgtagttagggaaattaactgatacctcttccaatattaccttgtcacatattaatcattttcattaacatgctttcattatcatagtttataccatttatatgctattctctaatttctaaagctgttattttttatccatagatagatttgatgctaaccatcttaaatcagagttcctccattcttgagctactgatgttgactcatcatgtatgtgcatgcacatgagtttaaagaagagctccagggttctatattgtctaagttttgtttcagaatgtctttctcttgatactatatttgactgaaaataaaacttgagtcatacttcccctccttcagaattgtgtagtaattgcttctctgggttctcatattacgtggaaattgaaagccaacctttattctccttacatgtagctggtatcttttccataaatgttcatctggttgaatatttatccttggagttcaggaaacagtttaaagtatctctcagtattcattgttctatctaaaattgtcctagaacagagtatgaacttcaatttgaagattcaaatctttgtaacaattttcttctttttattttttatttttattgattcatttttttctgttccctattcttaggatcaccaattacgtacatgttgtctctcttttccctgtcttccgtatctttcttcattataaaaacttcacactgttcatacacatttcattttgtcagatttttttccaacctagtatctatgcttgtgactttgttttcaatcaagtttattctatttgtgttgcttccagtgtctattttatttctgtcatttttttcatttccattttcattttttactgaactcttgttctgttttcactgcttttattgctgtatactctcttctttgaattcatctgtctcctttctgaaccctatttttagaatacgtatttgttgtgatatacacttgtgtcatttatttgcttgttttcctctccatgtgtgaaacagaaaatggtagttttatgcatgagtttatccactgttccctttctgatcgctactcctctttgaatgagatagcaactgaccaagtagtacaatggggaggggaagaggaaggggatagctggaaatgtactgaggaagttggcagccactatttcagcttacgaactcaaacatcttctttccaaatattttattttcttaacattgaaagtagttcttccctcgtttctttttgtttgtttgttttatttaaggagtttgcatggatcacagcaagtttccctacagcagtgtaccacctacttcttccaccttctttgacagactgcctgggctgaaagacaaagtggtagagaatagaacgaggttgttggcagaaagtccctctgaggcttcccttccctaccattctagagtctcaggcgggatttctacgtggttattctctacttttcttatgtatcacgcagaaactaagctctctttaatcaaaaactaccaaatatttttgggggaaaggcacctattgataatgtctgagtcaacatctcttagtgggtttgattatctatttcaatatttaatatatggacttcgtaatttgtatcattgcagttgtgaggcttccttgctttcttggagatgacaatattttccctcttttttgacttctttgataattttagtagactttgagaaagtaagaaaaacacctctataacaatatctaaaactggaatgatacgaatattttatatcctatcaaaataagttttaccatcaaaatgtctggttcaaaataggggatttctaattagttcacataaattgtatctactgaataccttctatatatgagaagaacctagacacttggctaggtgcaggtgtctgtacaaaaattaatgagccaagatctggaatctcatggagctcacagatttatagctaatcattgtataataaaatagatgtaacaataactgagcaaacaatatattcatagtatgaaaatatgggatttaatattttgtgatttccaaagtgttttcaggtccatttaactaatattcattgagggctatgttagatctaaaaacattactgaaattgccaacttcaaataaactaggccaaggttaggttagttcccaagaacacagtgaggttaggttagttaccaagaacacactgacatagagaaaggctgtttctgattagaatctaggattctttctaccacatcctgttgctctggaaagaagaacagagttgattatgtggaataaaaagaaatctactctgtgagccacgattagtcctccacataccatgctggcatccacaatctatcttttgtgtaccacactgggaaccacaatccatcctctatggttcggcctttaagaaatatactgtgattcaccctcttgcagtaacagaaactcatatggctctacctacaacaccagccatagttctaatgtttggaagtggaggtatttgaaaatatttctttcttacaggacagttagtaggttaatcaaaaaagttgacaaaatgtgatgtcacaaaaatcatctgtgtgtgtgtgtgtgtgtgtgtgtgtgcgcgcgtacaattttatgtgtacaattttattttgagatggagtctcactctgtcacccaggctggaatatagtggcccaatctcggctcactgcaacctccgcctccagggttcaagcgattctcctgcctcagcctcccaagtagccgggactacaggggtgtgccaccacgcccagctaatttttgtattttttaagttgagatggggtttcaccatgttggcaaggctggtctcaaactcctgacctcaagtgatctgcccaccttggcctcccaatgtgctgggattacaggtgtgagccaccatgcctggcctgtggatatatattaaacatatattttaacttaaaatatataaatgttaattcacttttcaagtgtttacagtagggccaagactttgtattttggtagtgattcactcactataaatatgtacttttctgtattttccactttcatttatttttacttaaaatgagagcataaaggcatatgaggccaactacagcaaatgtctatgttttatgaggtagtttactcttcgctttcacccatttctgatttgattcctgattcctgattttcttcacccaactttttaaaggcaacaccccttaagtcttatcagcatattcaaattggttataaatgtccaaaaccacatttgtattttgcatttctagtatgttacatgatatttgattaaattacataaaaaatctagtacaactgttataaacatgtttgggaacaaatacagatgacctttaaataaggtttcaattcaactggtgagagcagtaatagacagacctgctagtgttgttacctagtgattaagtctgtgggctctggagccagaatgcctgggtgtgaatcctgatccattacctactagcctttttaaccgtggacaagccacttaacctctctgtgcctcagtttcctcatatgcaaaatgagaatgacattaattaaggttttgttgtgaagattaaaggagttaatttgagcaacgcacttaaaacagttcatggaaggtgttaagtgttgtgtataaatattagatattattactacccaggcattcagtgtataagagacgccagtcaatgtgttttgcagatgaaatggaaaacactagctaatctggcaagtgggttaaagggaaactattaagacaaactctgattttcagtatcagtttgttaactagtgacccttattagatcataagtatcttgagagcaggaattagatcttctgttccattcactattacatatctaatgaatacagtgcctgcacttactaaatattttctgagttaattaatgaatcaagttcaaatatggtaggatgataaggtttttacaacaggatatcaatactacctcataaatatgggttacttcacatttgaaaccattcttgccacttttctttttttaattttattttattattattttgttttgagacgtagtctcgctctgttgcccaggctggagtgtaatggcgttatcttggctcaccacaacctctgccttccgggtccaagcgcttctcctgcctcaccctcccaagtagctgggattacaggcatgtgccaccacgccaggctaattttgtgtttttagtagagacagggtttctccacattggtcaagctggtcacaaactcccgacctcaggtgatccccctgcctcggcctcccaaagtgctaggattacaggcatgagccaccgtacctggtttcttgcctcttttctaattgattcttgcaagaactttatcgtatataaaattatgtacactttataaataagaaatatggagtacaaagaggttgagtaatttgttccaggttacacagtgtgagtcattgatatagctggggctcaaagtcaggactcctggaggtctccctatgtaatgtcatcccttccatataaatagtcttaaaataacctcagttaatcctttgtctccatgaataccatctaccctgtttgtcctatttgacttttgatgctccttactcactttaagttcaaattctaagcgtccgtttatgaacaaatctgttcctcttccgttcttgcctaattttctccattgctgtaattctaccataaaaacagccaagcatgagattaaatgcatttatgaaataagaacgtcacttgtttaatttgctttaaatacctcacctgtgatgcatttaacaacataattgtgttaataccaatatcaactgctttccctcactgtgtcaagaagtacagtagtttagattctaccaaggtcaccttctcttgcagcacagtcccaaatcgccttacaataaaaaacatgttgtcaaaatcaatgaatggacagaattatagtattttttataatcatagcttaatgaaattaaatgggtgagccacctcaatctaagccaatctttaaaatatcatcctaacaaatgaagcaaataagtaaagaactattatgtgggaggggaagcaaggggttgacaagcgctcaaatatacagcctcatgttaaattatattattaagagcacaagggcttctttatattcataaccattcttaataatatgtcccttctgagcttttattatcttctcttatgaatggatggcagcagggatattgtaacttatctcaattgtaagttaagctatgtaggattcatctctgttcacttacagagtctaacaatttatcccctctataagtttcacaatagtcttaagtttattgaactcaaaccattcaacaaatatttactaaattttgttatgtcttatccactgtattgggcactgtagagaatcaaagattgcttaaggacagccccttacttcaacgaacttaaaatggaatggaaaattcagatttggacatcaaaagttatttaaggggagaataagcactaaaacctgggttttaaaaaggcataatgaaaatacaaactagattaattctaatggaatgaccatgtaagtttcagaaaggtgtagtatttgatggtttcctaattagtagggttggaacagaggggcttcagatgaagagatgagagtgactaatgcatggaagaggaaaataaggggcctcaggaataagagtatgacattgtggctaacacttacactacccggaagatagtgtgagaaaaggctagaaggctagttaaaccttgactatggaaagtctgagataccaactgaagagtttgcccttacttgacagttaacaggtattaaaacttctctttgtttcatttttgcagtgggttgattatatacattttgtaactattactctgacaggaggagataaaatgtgacggaagaggaaggccagtcaggctattgaaagtaatttaggcaaaagtatcaagatcagaaaagaagttcaattatccaacacaatactgggaaaaaaaagctcaactttgtcaattattaagcaaagatatatacagaatatagtaccatttcacacctttaaaattagccaaaaatttaaacaataattgtgaggttaaaatgtaagaagcacttgtatacaatcagtgaataaatcagtaaataatacttttggaaagaaatttgatattttaaaagtcatatgaaacatatatattttactgaaaatataaaattttaaataccgttcatacaaagagtcactgtcatgttatttgtgacagtaaaaacattaaaaaatcctagatgtctaacaaaaattacaataaaaaatttgatgggttgctatgtagctatcaaaattataatcatgaaagttatgtagtgatatgagaaacatgtaaaaatggaataaaattgtatctatactattattgcaactaaaatgtaaatatatattccgaaaaaaatggcaaaagtacatataaaattaaaagttgagatactaaaaaatttcctcttaagatttctggacttcttaaaatgtgcacaataagtaatttaaagcattaatgtgatgctgaattaggacaatggcaatccaaatgaaaggaagtactataaagggaaacatggtagaaataaacaggagtgaagtactaggagtttgaagggatgaatgaaaagaaggatgcagacttagaggctgagagcctggtagaatagtcagagaattaaaagtaaactaaaaaggtttattcatgccagttaaagcaaacaagttctgctctaattgttaagtcgcaatagacctttcctacgcatttggaagtacgaagtgtatttctgaagaaatatcagtgctaagacaggaacttggaccttccctgaagtagcttgtatttgaagccaaaggagtgggaaaaaaatatatatcaaatttaaggatgtagaacaagaagagaagacaactttggaaagaacatggagcaacacttccaatataaaagataggaaattcaaaaaagctacagaagcactctggaaatgaatagtcagtgttagagatccatgttagcatactgccatggcaactgagaaaaagctttttgtacacacatgcctctgtgtgtgtgtgtgtctgtgtgtgtgtgttctatgaaggaacaagttatccacatattatagagaagtagaaaaggaaaattgggaaaacagatcatagaagttggctactccaagatgaccctagaaaagtagttttcacagactaataaaaataaaattttcagagatgacaaaggaaatggcaggaaggtcatgaattttaactatgccttcaaaaaagtgaatttagtaaggttgcagtgtacaaagtcaatatacaaaggtaagtatactattttttaccaaccacaaatgatgaaaaattttaaatatacactgaaggccgggcacggtggttcatgcctttaatcccagcattttgggaggccgaggcgggcagatcatgaggtcaggagatcgagaccatcctgactaacacagtgaaaccctgtctctgctaaaaatacaaaaaaattagccgggcgtggtggtgcacgcctataatcccagctactcaggaggctgaggcaggagaatagcttgaacccgggtggcggaggttgcagtgagccgagatcatgccattgcactccagcctgggcaagagagtaagactgtgtctcaaaaaataaataaataaataaataaactgaaaacaaaattttctgagtgaaatttaaaaagactgaaataaatggagaggtataatatggtcagtgattggcatactcaatattttctaatgtcacttttccccagttgagctatgtatctaattcaatgccaatcaaaatccaggtagactttttgtagaaattgacaagtagattctaatatttatgtggaaatacaaagaaccagaacagtcaaataaaggaaaagatggtatggtaaacttaagatagtatcaagatcaattctctaggtaatctacagtgaataggccacagaagatagagacccagggaatgtgaaactgctgaaaaggttctatgtagagtagaataagacattcctccatgaaaagtttcctcatggcttttcatgcttcctgaagtcaagaacttcaggaaagaagcatcaaacttcagcaataattccaacccctgacaatccaccaggcttatccatggatcttctatagagaacgatgactaaaatctacccctagagctgattatttaatagaatagctctaacttaagggatctatgataatacatgattcttccacttctcatacccaagcaaagtctaatgctgtcagacaaggtgatgatcctcagcttggaaagacctaaagtgggaatgctaattcctgtctctatactgtcattagaatctatggagaaaaattgagtcaatatgtatcgatctatttcagaactactaatcttcttacaaagacatcaaggaaaaattacatagaatataaattgctgaaacatgaattggattttacttaacataatatacaagaaagcatgtaagactgcaaggttaggatacaggagttttacaattttgctacagattatgtaacttcaggtagaatgacactcaatacttggatggtgttactatgaaattcatgggtaagaagttgggctagataatttctaggattattttgggttattactcaatttctaatcctcagagtctatattaatttcctcttgctgctataacatattaccacaaatttagtggtttaaaacaacacaagtttattatcttccggaggacagaagtccaaaatcagcctcactgagctaaagtcaagtcagcaggactgtgttccctccagaggtctaggggaaaatatgtttccttgcctctctagcttctaaagactactacactccttggctcctggatccttcctccatcttcaaagccagcaatgtggcatcttcaaatttttctcctctctagctgcttcagtcatctcattgtgttctcgtagagtctgactttactgcttctgtctttatattttttctctcttaccatgaccttcctgcctccctcttacaaagacctttgcaggtacatcagtgagcccacctggataatccagtatcatttccctatctcaaaatccttaattgttctgcaaaatctcttttgctgtgaaaggtaacatagttgcaggttctggtgattaggaagtaaacatctttggtgggtggagggcattatttggcctaccataagaccacgttaatatatgcttcaaagtcattatgttttggagttatgctataaaatcattttcctaactttgaaagaaacaacaaaatgagccatatatgcaaatgggtgtaaccagcaaaagttaccttagaaaaatagataattggttcattgatcttgttaatgctcagatattggtaaattatttatttggaaggaccttcagagcctactaaacattctttggcatgtcattgatgttgctttaaatattttaacttgctcaaaagttatttataaccaatattaatgaattttaaaagaaaccacaagaggccgggtggggtgactcacgcctgtaaatcctagcactttagggggccaaggcgggcggatcacctgaggtccggagtttgagaccagcctgaccaacaagaagacaccctgtctctactaaaaatacaaaattagccaggtgtggtggcgcatgcctgtaatctcagctactcgggaggctgaggcaggagaatcacttgaacccaggagcggaggttgcggtgagccgagatcatgccattgcacactccagcctgagcaacaagagcaaaactctgtcaaaaacaaaaaaaaaaaagaaagaaaggaaggaaggaaggaaggaaagaaagaaaagaaaccacaagaaatatttttcagtatcacccaccaattggcactgaaagtaattaccaaagactcattcagttaactaaattctggtatatttgcatttttaagttgtttgattagctcataagcctattttgtaagcccatgcaaaaaaaaaaactcctctccccaaactaaaaacatggttttgtaaaggccacatatccaactttttacctcccctatataattttttgatatacttgttctctcctaagtacaatgcttgggaaaataagatcatagattaccaatcactcagaaattccagacttcctatataataataaaagcaagtttattaaaagggtgaaaatgtattttgcatcttgttatttgcaatgttactgagaatagctcggtttctgacttttttctttaacccctggaggaagaatatttttaaaatctatatagcaagttgaaatcctctctaaagtactatataagtactatatcattacacaacaacaacaagtattgttcttagttacattttgaaaatccagacaagttataatgcccattaacatatgttcttaatttttactcaaatactgatgatcgctataaagacacatgcacacgtatgattattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcattcatagatgggaattgaacaatgagaacacatggacacaggaaggggaacatcacactctggggactgttgtggggtgaggggaggggggagggatagcattaggagatatacctaatgctaaatgacgagttaatgggtgcagcacaccagcatggcacatgtatacatatgtaactaacttgcacattgtgcacatgtaccctaaaacttaaagtataataataattaagaaaaaaaagagagaaaaaaatacttatgaccatctggcaatccagattcaagtagagttttaagaagatgaattaatatttttggaacattttgtaaatatacattttgtaaatatttttatatttgtaaatataaaaatagaactaatgaattgtattaaatactatttaaaataaaaacaaaataatataacaaaacaaaagaaataaagcagtgttatataagtaatatggaaaagttttaaatcttcataaagctaagagggaagacattcaagaggaacatgccttcaaatagctccttatatattagtcaaaattatctctcaagaaagaacagtcttctgaacattcatattgaaggaaaaggagcttaaaccctgggaggaaaccaatttcttcataaagcatctctttcagtttgagcaaccagtgacgaaaaagtatattaacgttcatttaaaacctcttctgtctggttcttagttgttcaaagagttgattgacataaggagagatttatgaaaaatgaaacaaactcttctcatgtgttaattaaaagagttcagaaacctaaaatctacaaagcttattttcctcatatatctccttaactctgagaggttgtaatttaagatcacattaaaatagaaaccatttagaagagggatcatgccttctttattctgtataagacacagttaattctgggttctcagaaaataaatgatgataaaacatctccttttaccaattcacaaataatttcaaaggactcagccaaatctgaaaactctctgagagcgtagatttttgccttctacttcttttatatcccttatagcatctctagaattctgctgatagagtgagtgcccaataaggtgagaagacagaagagggaaaggagcgtaggaagtaaaggaagaaaacaaaaggaggagagatgaggaaaggaaggatgagaggaggaaaaggaagatagagctgaatgagtcacctagatctttttaattcccctcgtggaactcactgaaagttttacatctgacattcaactgacattcttctaaaattggtattcctggattactttaatgactcagaaaatattaaatacctatatttctgtcaatgataatgacttgccttttttttctttcatgacttttttttttttttttgatacacagtctcgctctgtcacccaggctggagtgcagtggtgtgatctcggctcactgcaacctctgcttcctgggttcaagtgattctcctgcctcagccttccgagtagctgagactaaacatgtgcgccaccatgcccagctaacttttttgtatttttagtagagacagggtttcaccatgttggccaggatggtctcaatctcttgaccttgtcatccactggcctcccaaagtgctgggattacaggcatgagccaccgtgcccggctgacattttcatataattgtccataggtatttctgagattgcctaggacatataatatgtccaccagagtacctacaaagagtatattcgttttttccttttaaaactttaaaatttacactgatagatatttgctgtttgcttctgaatgataagctcttaatgtcataatgatgatgatatcactttatatttgtatagtacttttttgtttataaaatctccatctgttttctcacttgaccctcataacaaccctgtgaagcaagtaaggtagctggtattaactgtatttcatatgtgaaaaagaccagctgaagttcagagggaactatccaaggtcacactgctatattcgtttattcttctgatcctgagacattttgcttttctctactgatgagtgtatgctgcactgcattggacaactttatatggagcccaaccttttcttttcactggagtttcccatccactcttatttcttcagttttgtggtttgtcattgtttgtttgttgttgttgttattttgttttgttatttaatgtaatggcacaggcagataaattaaattttgtctttatggcaacaattttatggattgactcagaagctacagaatagatttggagagtacctatcatccacagcttgcatgacttccagtatttaacatttctcaaccaaaaaatttagggtttgacaatcagtctttattaaaaaaaaaaatctagaaggtagtacttgagagtggatggcatctggcaaactaggaagtaaagactttaggcaaatagtcaatgaaatcgagcagacattttgaaaatagaatgtagttatgtcaaacagcatgtgcaatgagaattttccaggccaagaaggaagtcagagataactgatacaacaagctagttctacttaaaaaaaaaaaaaaaaagttcttggagtttattttcccttaatatttagcaaactatttagaacatttaaaatctaaaacgattaaggtcttctaggaaaaatggaagcaggctagtgaagtcattttagcatttttgaggtttcctcccaagcattctacaagtaattacattaggaagataggaaatccctgagtagactattagtagtttagtattaaaatatcaaaattaatgagtcattttaacattttggtgcaagcataaggcaaaactcaactttttattgtaccacatacttagaaattagagtgcctcaaaaatcaacagcaatcatatcgcaactccccactaagtgttttctctgtgctttccattaataacatcagactagcccaggagtatatgtggatgtaagagcacactacggtgagttcaaaaggtgtgctttgctgatctttctttatgtctctctactgttcagcataatcacctcttttattagctgatgacttctatccaggccattactccataagctaaatattagcagctatttgaaaaggttcactaatgtaccaaatattcttaaataaaacatgaatttacagttgaaataagaagtttcaactaaacaattaaaacaaatcccaaatccatttggaggatattaagcaaatttgtaagcaaatagggtcatggatattttggagctggttcagagcaggttgattgataaatggggaagacctataaagagaggttaaagcagttggcatttgggcatggttgagggttggtttagttactgtcttaggaaaagcatgataaccggtgggtactcatctacttgagtcaagtatacacaaacacaaacattatttaagctatagcacttaagattttgaatgtcacaagtgagttttaacattgtattatttaaaacttacgtaggttacaaaagagaggtttgggatggctttttctcattgcctttaaaaataaattttaattttcccaaaagacttaagtgtggctctactaaagcgtaaaacaaaagatatttttacaaattaacttttaactctgtgattctatatcaaaaaccaatcaatacctgtgatgtccaatagggtagccactaacctcatgtacctatttaactttaattaaaattaaaagcacggttcctcaatgacactaaaaaccattctaaatagacacgtgtggctactggacactgcactggacaatccagatatagaacagccccatggctggccaaagttctgtcagacaacactgacctatccaaacatattccaaatccttcataaatgcattaagatatttgtgccctgtatttcaaacactttgataggtaaataaaattaatttttttctaaaaaacaatcttgtaataatcatatagaaggtgtattttaatcatcaaaataatctgttttcaaagtttagctaaattaataacaaataagcttgtgctaaagcaccagttggatggtttacaagggaagtcagacattcatttattgcatttttacacttagcagcttcactttaaagcattctgctctacataatggtgctctgttaaacaatgtttaaagttaagaaacatttgaagtcgagttctaaagcaatctgcatatgctatcatttaatttataaacttttgaagcacttttaaaaaccctcttaattataaaattaatgaaatatttaaatagctcaccagttaaaaatttaggccctgttgtgaattaaggaattaatcttgaactatatttatacattatgtgtatataatatattcacacccacacaaaaaatatataaatacataaattaatactgaagtgccccaaaggagtgattttacatattgtatataataattttatatatttttatgaagataaatatctgattttgcatattttcatgaagatattatgtagatcaatatatttgtttatcaccattattatttctccatagagataatgaagctgaggtagaagagataatttaatccagaatatcagaaaagtaccggtcagatgcggtggctcacgcctgtgatcccagcactttgggaggccgaggtgggcagatcacgaggtcaggagtttgagatcatccttaccaacatggtgaaaccccgtctctactaaaaatacaaaaattagccaggtgtggtggcgggagtctgtaatcccagctactcaggtggttgaggaaggagaattgcttgaacccgagaggtggaggttgcagtgagccgagattgcatcgctgcactccagcctgggcaacaagagcgaaactccgtctcaaaaaaataaataaataaataaataacttagctgtgtcacacacagcctctgaacacacattttaccccgtcatacttgacttctgttttcacatgtttgtaaagagtttaaactagatgacttcaaaagtaacctttacttaataaagttgtattattccaggtataaataaaaccctctgatttatataaattgatatatatgtctatatataacaatacatttgtctaggtcctttcctagtaaaactgttcaacatcaaatgaggtagaaattcacaggttttaaatttttcagtaacagagaagggaaaaaatgcaagaagtcaagtggtttgcagatgatagaaaaaatcagtgtcagatctaagaatatcattcttcgtcttcacttctggctacattatccctttctactatacattgtgcttatcactaatgtattgaattaacatgagctcacttcaaagattttcaagaaaatttatcattttcctgataattaaaaaggaatactgccaagtaatgtcactaaaagactgacagggactacttaggacctttaagaggacataatgtaacagcacttttgcagaagtcaggttattagaacttaagtgttggaggtttgaaatacgcccatcaacctggtaacaaaactgtcagaattaacaaattgaaatacgcactttgagtagactaggaccttagtttccgctcaaagataatgtaattcttgtgttaaagatctaagaaatgagtgagaattactctgttcttagagttctgcaatgtcacaagatcataaaatcctgaatcaagaaggacagatcagaggtcattttgagcagcctcttttattgggccacaaaacatgcttatccccatgcaataatggcattctaattccagtctttatcaatagtaacaataactttagcaattactttttaatctcagaattctagaaatctgagttctaacaaaaacacggtgtatataaaatggtttatggccatgcataatttgtctgccttcttttccagtaaaatgaggtaggtcatgtacatttcatattttagctcatgaaatcttcaccattttcccacaaggtttgtttccactttatatgtgagaacctgaggcctagaaaaaatatacaacttgcccatggacacacaactagcaactggttatcagccaagatttaagtcctctactttgactccagaactgacattttttatattgtgcttcattgctttttttttgtttgtttccagaacaagggttacctatgcagaggtaactgacatatgaaaactatccttagaaagaaatcaagtaaagtaaatttgcctactttcctcaatagcccatttcgcctccaataaaatcatatttaacgggttgatttccaaagtatgagtttgttttacaaaatttaagaggaggaaaaaaagaatatgggtgggatttgtggaggtcctgctatagttaatgagaagatatcacaaatcaggtaaaaatactctctacagatttcttttatgtttgcctcacatactgccaggtattaagcatcagacagatgttattgatgtaatttctacagttacaatttttcacttgaaattcaaaggtagttaacagaacattattcaaattgaatctgtatcatgtttaaggcttctagcttcattatataatatcctgtgtaaaagaagccaaataataaaatgtctttgatgtcaacaaaagcaattttcctttttttatgtgttctcagttcaattagctcccctatcagaccacactgaatccttggctctcagttactaacatacaagcttttcagctgtatattaaaacaactaaggttttggtactgcataatgacattttctatttaattttcagcacaccatggaatctgaagtgattcagaatggctggcttttgaaattcctttgaactaaataaagcaccttcatttttacttgaattattttacagtacttttaccaatgcctaaaggaacaaagataacagctatttttttccaggaggattttggaaactcgaaattcttaaaagaactattttaacaaaaataaattgaaggaaaccgactgattttaattttagagatcattgctttcaaatatatgatcttcaagtcctcttgaattttgagctattttgaaatcaagttctatttgtataaggctttctctctgaggcaaagtgttatgtgagggtgctttccagcattcaaaagcattatatctcaggtcttaaccatatttccacatgtgcacatcttccatcaaactgtggctcatagcacagttatgcaacacaaatctcgatgcttctctcccatcaatttttgaggaaatttttgaagagttccccaaatcagattattatctatgtatcaatacttggtcagaaaaaattcacctgaaaaccattactgtatactgtaccaatacacgatgtaaataaaagttgagtgcagtagacatagttcacttctactacttataacacacatagtgcctaatatgtgccgagcactgttctaactacatattgtaactcatttaatcctcacaacaaccctatgaagttagtactattattttccccattttaaagagaagaatactgaggtacagacagatcctaaatggtggaactcagattcaaacccaagtagcccacttctagaatctgcataagtaacttttactgtatagtgtttctttttgttttttttggacgaagtctcactctgtcgcccaggctggagtgcagtggtgcgatctcagctcaccgcaacctctgcctcccgggttcaagcaattctgcctcactcagcctccctaatagctgggattacaggcttgcgctaccacacctagctaatttttgtatttttaatagagaccaggtttccccatgttggccaggctggtctcaaatgccttacctcaagagatccgcctgcctcggccttccaacgtgctgagactacaggcgtgagccaccgcgcccggcctatactgcttcttaaaaggaaaaataagctgacacattgttagaactgcagccaaaccagtgcttttaattacctaactagtgccaatggactagtttcctatcctttaccatcctgtactatcctttgcctggttgccagggcaaccgggatcactttctttaaccacactggagcttattctgtgtaatcatttgccaagcaatcatttgccaagcaatcatttattcagtcattcaacaagcacaaatcaagtgccttttatgtgcctcacacttgtaagtgatgaggatacaatgcccaataaaatgttctggttgccctcaagaagctgatattccttcttgcaatacttctatgttggtttatgatctatcacatcttctagtgtccagtgcctatactctctagtgtcttaggctctccctttctggttcctgggtattgtcatcatttcaatctcctaccctccattaacacatttatattatcctttccactccttcaatgccatcatccaaattcaggtctttactaataacctacaaataaattacaagaatggccgtgtgttctgttctccttacacctaatctttctcaaacgaacttatttaaccacatcaccaccctcctactcagatgcaaaaactgactctctagtggctgtataataagtaaatctctttcatgtaatattaaatactgtttacaatttgacccccaacctaccatatcagtcttgcctcctaccatttgcttcagatgcactccagtctaataaaatatatctatttgcagttccctgcttaccatttgatcatgttgacatatctcttggcaatgctatttcttctggccttcttactgcctgaaatatgcccacctatgtctatactaggaactcttggaaggccccgttcagaaatcacttatttcaagaagcccttattgaggtcaccagttagaagtgctcactgtattttatgaatactgatagctccgcatagcccaatctaatattcacctgtattgaattatctgtgcatattacctctgctagactgtcctattccttgctgataccaagtacaagttccttacccatatgaatatatagatatgtatagcatagtgctctgcatatagagtatctatatatatagtcaaattaagtaaaactatgatttaaaaatatgctgcaagtcactagatttcttaagaattgcatataacatcatcatatttactgttgtcaaaatataatgttgagaatgattcagaagggaccaaaactgaagctaaggagtttggaatgactttatatttatatgcgttatttaaagttaagttcctttgaagttgttgctcttgtagatgttggtatttttttttaattttgaagttggggatcagggagaaagtaaagaatataggagaaagtttacttgttttttaatgtgaatcagtaaattctaactcggagaactttttgacacacaattccaaaaaccctatcagaagctttgacaagagaagcagaaatataaggaaaatttaaaaagcccaagaaatgctatcagttcacctccctcagtactcaaaattcaatctttcaatcaaattaggcaatagacctgaaccacatcagctgagtacatcacagaaatgctttcactgtattgagctttaatgttattcttatagcttttatcaacatttgctttaaaaaaaaatccatagctgaagcatgcgtctgcattttacaaagaaactgtccagtacattattctatattccctatttagtagccaacattagaattttaattcaagttatgctttcactttctcctttctgaaaactagaactagacaacttttcttgcttttcttttttgacaaaaacaatgctttaataaaacatggatacagaattagagcaattatgttaacagtatggctactgaatttgcatcttctaacctctttaggcatgaccttatttctattagagatattagaccttagtagagatagtctcaattataattgttttacataatttggggatttattttattttattttatcttattttgagacagagtatctctctattactcaggctggagtacagtggcatgaccatggctcactgcaacctcaacctcctgggctcaagagatcctccaccacacccagctttttttttttgagacagagttttgctcttgttgcccaggctggagtgcagtggcgcgatctcggctcactgcaatctctcccttcagtttcaagcaattctcctgcctcagactcccaagtagcgacacctgtaaccccagcactttggaaggctgaggcgggcaaatcatgaggtcaggagtttgagatcagcctggccaacatggtgaaaccccgtctctactaaaaatacaaaacttagccgggcgtggtggcagctttttaaaaaaatttttggtagagacaaggtctccatgttgcccaggctagtatcaaaatcttaagctcaagtgatcatttcaccctggactcccaaagtactgggagccactgcacctggccaggggttttatttttaagagtatactttttaaaggataaatatcgaggctgtgcccattcatttgtttatttatgcaataaatattatcttttttcaattctagagatacaacagtgagcagagacaaaagtttcttccctcaaaacacatataattctaactctgggaaatgaatattaaagtaggataaaagcaaaatatataaaacattggataaaaattgtgaaaaaaaataataatgcataaaagaggaaggaaagggtagttgttttaaataggaggaaatgatacttggttgacaacccaaagggagtgactcattcatctatttgagatgcaggcgatctagtcattaagtacagagaccttgggtgttccggggctacctggagaccaaatggttggagtgaagtgagcaaggaagagaggcatttgactgggtgaggatcttggagtttattataaggactttacatttgactcattaaacaagtagagagatgttcacacatctcaactaatagtaataggtaatttttaaatgatgtttacttgtaagtaatgtgtcagtaagcatcagcaaaaaatgttactttagagatatttaatcatttagtttaatgccatcctttctcttctttcatgtactcagcaaaatcatattcagcagttactatgtggcaacactatgtggcaacaatggaaatctaaaaaaaaaaaagaaaaaagaaaaaaaaaacataattccaaacctcaaagaaatgtctctcaagtggcagagataagtattaattattaaaatttcttttctttagcttttaggtaagggaaactatataagatgtttaggtagaggagtgatcatcatatctgcatttcaggtagattcacatgtagaagagatttgaatgaagtatgactggatgcaaggagatgaattagaaagctgtgaaaaatgatgaaaacctgaactaagacactaacagagggtgaggaactaagtagaaagttacaatccatttttagaatggagtattgacaggactttatgactaaataggtgtaggtggtgtgagaggaggaggaatcaagaataactcccaatttttaacttgaacaaatacatggatggtagttacagtcagtgagttcagcttaggacaatttgagatgtattggtaaattatgattagctgacagttgatattatggaaacccagagaggttgatagatttaaaagaaggtccaggacagaaacccaggaataccaacattcaaacaggaggcagagaaataattgttcattaaggggattaacatgaataaacagaaaaaaattcatgtaagccataggagacgagagattttacatctaataatattgttgactgtgtccacctgtagtggcaaacttgatgtgattatttatttcgatttaatagtactgtttatatgagtattgtagagcaagcatttcagagcaagttattatatttataaagattatctgaaattcagttggataatcctcctgaatataaaatatattgtattattttattgttgttgttgattagccattctaaaaaaatctatcctcctaaaataaaaatgcattgtaaaattatttccttcagtccttcaaatgtagtcacttcaatgtgcttttaatattttagtttacttaagtcactatatgtcaattaatatcatttatgaggaaagaaatagcagtgctacaaagaaacaaaaatacgtactataagaagatgaaaatatatgtccattaattagaaaatcctaggctactgtgtgagctcaggaaaaggacaactcatttatgaaaatgaggttgatatatattctgatatcatggaaatttcaatggattataaaatcagtggaagctcaatgctttgaagaatacattaaatgtgcataatagcagctagtatatttttgttatctggtctttcaaccaagtacttgtcaaccaagaattgcttacaaaattttcctatcaattcctaaggtgaaacaattaacagggttaacagtccaaaatcattagtcaggtcattggcagaaccaggagttcaatatgagatattttttaaatgtctctctttatattgtctgatacttaaaatctttaaaagtaaatgcataaaatgaaaacatcaatatgtctttatatattatgttataataatacatacaaatttagtagaaaggaacaaattaactataaaatccagataacttgtagcatatgtaaaaaatagtcttttgagaagattcatgatagatattaatttttcaggcataatcaagaattggaatccaaacagtagaaaattcgtgttagaaaggacttgaggttgctatatcagcagatatgttctcctttatttttacagtttctacctgtcatttgctctataataatacatgaacaaatgcctcacactgagattactatgaaaccataagctatactgttaccatacttaacattataaccaaaattacaacttcacaaactgtaactcgaggaaaattacaggttataccaagtgtagcagatgtatagaactgtagcagctgttagaaatcctgaatattataccttatgaaattatatttccagttaacataaatgctaaaataagttatttattctaagaagttttttctggagacaaacatttccctgtgcagcagaaaaagcctagtattagaaaagcctgctcttacaagtacattcgaatgttcagaaattcaaatgaagcatatgttgtcaattaatccaagtatataataatttttaaattatgcctctatttacctatgggtgatgcataataatttattaggagagttgttgatactttttttgtttaaaaaataattattagataactagctcagcatcatagagaactaatatctagaggttagaggtgaaaattagtaaagggaccagaaaaattaaaaatcatgacagaacaccagcattatgtaaacagttaagtaaatcaggattaagaaccatcccaaaaatgcacctgcaaaatcgaaacaagcaagtagattgtttagatctacttgcttagtccactgcttcagaaatcagcactgctttgtttaaaagataattattgattgctatgttatataataatcttccaagaccgttacagattaatctgaatacctatgacctcaatctgaatttctatgtcttagaagttttggagatagccaacccaccaatctgtcataaagcatattagctgtctgggggttaccagttcctcaggaatgtcaccctgtcctgtcctctccatgtgctgatcatgaggagggttagtgacactccacacccattcatctctctcttttttttggtagtgtaatgagtacagcaatcattctagcagtatttgctatgacaacatcattcagccccaacttatgccaaaaatgtgcatgttaagtgaagggaaacaagctctaatggtgccctttaatgttctgaagacacaggtgttctctgtgaacttgacatttgctcggtctacatgtgatcctaagggttccagataagatgaattactgtgtgaaagtcctcaggcattttctcacagataaatagcatgaaattttgtgatggagagagaacaacctcagtagtaactaggtaaagattgtactggttccccagttgataatgggagccactgcacaaaggtcaaacaatttggatgcaaagtatccaatttgtcatcacaaattggatttgagagtgccatgaaaatgatgagccagcacactgcttctaccccatggtgacatttactctctcttacccactctcccttagttcttatggattcttctgaaaatataagatggaatttttttctagatggattagagaaaatatgtgtctatattttttaaacagtatacaatggtgacattattaagatgatgacactgatggtgatgcaaattaaaacccctgagaatcttcactagatgcagtaataaaaaggttaaccaagatgtcaggaaaaaatgcatcctgaaatatcagcgtaaaagcagaatccattctctgtggtatttttaaaattataccacatgatgttaaattataagcacacatcagttcaacctagcaaactttcattgaacaactatgacatacaccaaagagacaaagataaaaaagaccttgactgacccttcaaggagcttgcaatcctttttaagtggcaaacatttatgccactaataaggtgatataagcattttatacttttttttagatttagaaatattacagtaggagaaaaagcagatctttttacacacacaaagaaaacacttagaattgtactgataataagattagtgttatttggtccatagagatgccaaggtatgtcagttgtctcactgagaactagggaattcagccaaaaatggttcctgatcatgttctgccagagcaaatagtactgaagaaaatcaaacttgtcagaatagattttctgagatgtgatgagctagtgttagaatgtgaaccaactagtgcttgaatgttgaactatgcttccagccttatggagagttaaggctccccaagctgcccaaggggccttcgtgatacctgttttgttactataaataatagaggttacttagtgaatgccaaaagtgatctaaacattcattagtattaactgtatacctatgttgcaaatatcaccagaaaagatattggaaaggtaatcaccatcaattcttatattcctaaagctttcttccagtcctctttttctcctttcatgaaatagttttcagacgcagtttggaaaacaagtatagtaattgactggctcataaaagcaatggaaattaaattccagctgtattgtcattttcaaactcatgtttttggctacctcatacctctaaagcattaaaattggcatgtgtctattaatacattcatcaattctttcattcaactcaataaaattgagttcttaccatgagctaggccttgatgactcatagataaataagataatattctatcctccagttttgcttagaattcagtaaggaaagaatgacaataaagtgctgtagctgatatattgtattcaggttaagataggaaataaggctgtaatgattcattctccccctgtgggattgggatcacattcataaaagcaattgtactggggtatcaaaaagtttgtgaggttgaaacagaaggacacattgggcatatatagtagtttgataaaattgaagtaaccttaaagtacgtgtgaagggataggagacgtgagcagagctgaggctgagagacaaaaaaaggcctatgtggtaaattcagaatttagactttttaataaacaggagaaaactatgaaagaagaggatttttggacagaaattctaaaatgtgttttatgtatacattaaaaagaacaaacctggatgttagagggctaatttgagggtaatttcaatagtgcaggggatgagcaatggaagcctgaacccaaatgggcatctctgtgatagagaatcatagaggaatgacatttgagaggcaggacagacagagctgactatcagttggatgtgagacatgaataaaaaacatgatttgactcccaagtttctggtttggataagcagttgaataattatatcattgggaaataacaagagtatcacattatttgagttttccatgtcttctaagcatgtagatttttagatctggagctcaggagagagatttggagtcatatatgtataagacatagagtgtggcagtggatcaaatagtgtgggcaagaacatataaggtaagaaaagggcttgatgaaaacacagtactgtcagaagctaggaggagaaaggaagtcatggaagagaaggaacggaggaaaagtcaagtagggtgaggaaaggtaagagtggggaaactattagaggaaaaaaaagaggtggtcagcaagtttgattgtcatagaaaaagaaggaagagtaggactgaaaatgtttgctggattcagaacaaagaagtccatggtgtcagttgtcaatgattagatagtcaacgagagttaatttagttccaatggaaatgtgaggaataggaggtagttaaagggcaatagaccagagggtttaactatatttcctgtaacaaatttgaatatattcgaacgctataaaagaggagccaaataagtgaaaactgagcagctaggtctccatacctgaggaatcagcaaccggtggaatagtacaaaagcaaagtggaagaagtagtgttaaataggaggaagcaagtcaggaaatacagatataaattacctgcaggtgtgagggctagctcttgggagatttcatgcctcaaggctcactttctttctttttttttttttttttctgtgcaataagatctgggtccatttccaacttttctccctatagctcacatacttgaagtgtgccaagaacaccagatatggcaacatcccacagatgatgaatggtatgaaaatggcctgagggttctacatcattcatatattctctgatcactagagatttattctcctatgttctctagcaaaatgattacagaaccacagcaataatagtggtctgctcaattagccaaaacatgctactgaaaccctttatttgttccacagaaagaaatgatctaaaaaaatcttttctgagggagtaggttttcctcctaagctgcatgtcatttagctcttccaatttcttctagtatagggtttatttcaatgatttctctgcctaatgtgatgctgtaacactctgaatctcacatctttcctcagtcattgatgtgctgatcgttcagtctgccagatcattaacaatgatttttttttaaagaacagttaacaccaattcttgcagtaatgcctaccctttaatctcccactgctcctaaaaaggaatcatccatctttatatgtcttttcatctatcattggtatttgtgctttgttctttgacagtttcagtcaatctgattaggttttatgcacagcaactcaatagcacaggataattatgatacagtgaggactacttttttttctgtttacttctatatgcccaacattctgttctgtaggcaatctgacaattggagaattttaatgcaaaaataatctctttaaaaaaactttcaaaaatttcaacctctattttagattcagggggtacatggacaggtttgttacattgatacactgtgtgatgctgaggtttggggacacaaatgatcccatcacccaggtagtaaacatagtaccaaataggtagtttttcagcccttccctcctccctctttccccccaactagtcgccagtgtctattgttcccatttttatgttcacatgtaccccatggctagctctcacttataagtgagaacatgtaatattaaagaaaaaatatggctgcaacatagtaggcaaaattcattttcaaggagatcagaaatccaattgattatagcctaatccaaataatttattatttaacaatttaacgagggggaaggggatatttccaaaacgtttaaagtttatttctcataggattttaaaattacctggcactataatatggaaatagagagtagcattaacttgtcaaaaattaataaaaacttgcttttaagaagaggacaaagggagtcaaaatggattgtctaaaatttaaatgcaatgttagaaagatcacttttgatgctatctggaaagtttcccagattccccattgagctaatctctgtgagtgctcattataagaagtgatagctatccctctgtctcagagacaggatttgtcttattctgattgacacagctcatgttatattaagtttgtgaaatgaatacaaaagctaagataacttttgtttttaatgacttgcacctttttttaaaagaactcttagggatgttataaggataaagtaacataatagatattttgctcagcaaaaagcatgattcagcctagcacagtggaaagatcatggtctttggagccaagaaaaaactgaatccaaatctaagtaacctcagctctgccactttctagctttatgacctcagataagtttcttaccttcttagcgcctctatttccccctgggaaaaacggggataaccagaagctgtgaaaagtaaataagatttgatatttaaaaccttgcctaatgctgaccacatctaggagacgctcaataaatgttaatccccccaggttcccaatagcatagcttttgaacaagtttatagatgccaaatatgaaagaaataaatacatattaaagactaccagatacgtgatgctacctagttaatgcttacatacagtaaatgctgaagcatacaacaaaatacaaaatgttttgtatttctttcccagacttgtagtggtattcttagttcttgagattactctaccaacatttattaaatacctgttttgtgacagtagagtataaacacagataagaaaccatctttgttcccaaggagtccatgatatactttaaagaaccacaggagattgaaattggcagaaaccctggaggtcaccaaatacctccattttttaaaaaaaatttattcattttatttttgttggtttttttgttgttgttgtttgttgttgttgttgttgttttacaaacccttgtgttgcgagggctgactttcaatagatcgcggcgagggaactgttctgctacgtaggaaaccccgacccagaagcagatagtctacgaatggtttagcgccaggttccccacgaacttccattgcgtgacgggcaagggggcagctgcctttgcggccagaccccgtttcccaggactaggggcactccgcactggaccctagtcctggcgcgggatggggcggcccccaggcggggatagcgggggaccgacatccgagaccagccaaggcccccctctgttttttttaaagaggagaaaccgaactggagaaagtttcaatgaattactctataccacattgctagttagtggcagctccagtgaagccttcctgactcctaacacagtgacttttcctttaacctggtcccccaaataataagctgtaaaaagatttactggaagaaaaatgcacaagaacttctcgagtaggtcagatttctttttttctctcttaagtataaccacatcatgtttgatccattgaatttctgtaatggtagtgtatcattacataaaataaaagtgaaaaagaaatacaacaaatttcagactgccttatgaaatacaatagctaagcttaaatattcacagggctaatcccagaaaaggcagtctggactcggttatccacataactacctctattatccatttcatattagaatgtagaattataacatagttaatggggtttcaatttaaagaccccgtgtcatcttattagcctatcatctgccctattttctccttaatttaccttatgtttatacaattcttatctcagggccacgttgctaccataaatcaaatatgccaggtttcaagtttcagcatatgagcacagatgtgagcgaacagcttttgatcactcagttatctctaccagagtaactgaaacagggattctcaacacatagaacttctaatccaggctgacctcaattaactgcaagctaatagacattgccacgatatcttcctagaagaacaaggggattcctggaaagaaaaggaatctatccgtctttcatcccactggtcaatacctttttctcagaatcaattattgacattttataatctatgatcttcaccaccgtaataagacttcaggaaaaaaaaatgtaatttcagcagaaaagattggaagcatggtactagggatactatacattggcacaggagaagataaatgtattgactcagcattttgttaccattatccttctctctaaaatctagttctgaataaataaaagcagggactcagagcctggcaggatatcttgccctgaatgcatggcccataatcgaagctttcaacaggactttttgggtgagtagataggaattaagggtccaaagaaaatttgggcactgccttccttttacattgatgacttaaagaagaagaggtacattagtaggtaaagaagaaataattaccaatttagaaagagggtacagagggtagaaaagaaatagtctaatgtttgcaatatgtttggaacatatattcagggtccaggagcactgcctgtatctgattccttgcttctgcttatccagagatgagtttagacagaggacaatgaagacagtactcagacagtacacttatcttctcccatcccaatatatagaatctctagtacaatgcttcaatccttcctgctgaaattgttttaacattttttctggagccttatgggagtggtggagtctctagatgtgtaaaatgccaataaagaatgcttactgggaaaggtattgactagtgagattaaagacaaatatgctcctcttctttccagaaattccctgtgcccctaggaggagactgtgtctgttaaataatgttaactccagaaggaaagatcaaaaacaagagagaacaatgaaaggatagtgctaagtgtgaaagaaaaacattaaggaaaggagtcggagggaaagtaagagtgttactgcattatatttaaaccagcctgtcacaaggagaaaagaggcagaaacatgtgtgcttcttgtctgaccacttatctaccaaatccagttcttctacctttaccttcatcgtttcaggctctcgtataggcaataaatggtgtcaaagattcagcaagttgctactatatatttatgaaataaattcacatatatttatgaaataaatacccatcagctttcacatactaaaataattagtgtaaaagctattacattaaattaaattaaattaagatttcattttctagcattaacaggtggctttccccttattccttattccatggtaacatacccttctaaaaataaaagtttcaaccagttttcctgctcttagttcaatgtcatcctaaaaacaaaaaaacaaaacaaaagtggccctaacacctactgggtgttaaaagataatcttggattagcagataagctttctgaagtgggaaagtgagattgagcaaggggaatattaaattgtcaagaacagtaccatgtgttctttctaagaatgaaaaacttagaaatttgctatcagaagtgaccacctctctaaatagtctagaacaaaaaataaaataatttattttgtaaaaagaaacatcttcccttcacggtcttcctccctttcctacctctgttcatcccctgccatgttcatgaggtacaaacaaaaataacagtaggattaacctggaagaccctactcatgaaaaatcatttatataaacgaggaagaaaattctgcccactttctagcatatcaaggaatattgttaaacgtatttaaaagccagtctgtgattttgcatggctttattaataatgttcttgagaaaacaaagccagtacatagataaattccttacatgatgatcaacaccaaggaaacctcttactgttctcagacctaacataaagaatgatgattttcattcactgtcaggtacaaaagcaataatatatgcaaaataggaatacaggaaatattgcacagctcactaatatactgcaagttactaatgggaaaaatatcaaaataccttaaggactattatatacattatcacaacactcaaagaatgaaaatcacttattcctttgaaaattgggatactttttattttgagagctgcagaaaaccctatgacgcactacatagctctcacagtaaatttccaggatcaaagttcaaaaacaggtacatgataaaatgagcaaagtgaggtagacaacagaaaatgccaaaatgacaataactgaaaatattaatttccaagtattatatctcataacataatagtaacatgatgtctcaccgttcccagctcatcacatgttctaaagctgttctcctcctttttataaaactttattatcctgctgaagtttcactcatacaactagtcattccttaattttatacttagttattccttagttattcttagttattccttaattttattttcttttaacatagttattttatagcaaaaatttatgatgataactggttttttttttttttgtactcttcttatcttaaaaacaccagttagaaaaaaatgacatttataacttgtggtctatggaacaagatcagtaattattccatgcaggataatgttagtatactaagtgagacagcatcatttagaggaaaagaggacaagaaaagatgatgatggtagaaacaggaggcagggtcagttatttccatattgatcatgtagaccgtgcctgataaggtaagaggtctattattaatcaaccaattcaaccaatgatgaaggctcaacagaaccccaatgtcagggaaaaagcattaaatttcaaatcccattatccaataagcagttatttatgaactacatacaaaatgtaaactgaatttctaagccacatacaactatcagtataattattctataatctaaatatatccttgactctaagaatatacatatttcctactacaaaaatttactcacccagtttactgataattaattccaccaaggttgagatgataaaacttcaagggtttatttcacaaggttgctttgtgtttaacttgaacaaaaaagggaaaataaacaacaaaactaaaacaaccattgaaccaacacacctgaattttcaggggtagaattttaggaagaaaacagtccctgacaagtacaaattctctacatagaaaactgcctattcggcctcagtctatacacaaaaattactactgcacagattctgtgtagtagcacaaatagaacaaaggtcaaagattaaatgtaggtatgtgcatgtgttttatatatattacaaatatagtaatatatacacacacattttgtattagcctatgttattctaagcattagtcttagcatatgctgtgtttcacatttagaaatccctaaatgtgttcagaactgagggatgtattattcataacttatctttaaatgtattatttaatgcagtatccatttgtaagttagtagatgctgatctcaccaattcattgactgtggctaggcatgcacaaatttcacataaagatataaagctaatatacatttccttcctctgatttccattgcccggatttcttgcactaaacttttctgctgtgttgcacatagtgcatgcagaatgcatgtagaacatgccctgaagaatctgcaatgcagataagaggaaagcattattcccaatttgcatatcacaccacacacagtaactgatttgtcaaatatcaaacaatttacatattctaggcctcctgctctccctttcttgagcgttcggtctactttttctttttgcaactgaattttatagagaggaaaatatatctttagctaaggtgatgtaatttgaaaatataagtattagatttctccaaatgacttaagaatattagaaaagaaaaaaaaagtacccattcagcttagattgcagaacagacagggagcttaaacagcaggctctgactgaaaattaaatttaagcttccagttactgcagcaaaacctaagaccaccttccctctgtagctcgagtgggagacattgttctgctgtctctctaggctctttggtacgctgaggctgatgtgattgcccagactcgtgtcctgcatggaatttaaactacttttgtaacagcaaaaggaatttactgacttcctctcagattgaaagcagaaatgaccactcgcatcaaattatttacttcgatttgtagcttatttaaaatgaggtaggttgtgattgatgttgatttttattcaatggctcatctattctgatatttcagtttcttaaaatatttatgcaaagttttgtttggattacttacatacgtagcacaaatgattctttatttgccatggtgacagcacaaatcacattatttgcagaggttggggagtcccacaaatcagcccccacaacaacaaatatttatttattgaactcttggaacagttacaaagaaatataagagacagtttctgttttcaagaaccttacaatatgggaagataaaatatttacagatacaaattaaccaataaaataaagacagagatacaagcaatgccacaaagccaaaatcatagtggagattctgccctggcaggaatgagatctcattacctgggtgaattattattcctctagttctcagtctgtctctgaaaaatgaagacgtgaactaaattttctcccaattcaacagccttaaaatttaatatgaattctcttacacctaaccttaaatgtcttcacaattgtactctatgtcttatctatggaaagggaagttagtagccaccaaaagatatttcaattgatctattttcccttggacattttaacagctaataagccaagaaatgctatctaatttccttacacatcttttttcttttttcttttttctttttttttttttggtgacggagtctcaccctgtcaccgaggctggagtgcagtggtgcaatctcggctcactgcaacctccgccttccaggttcaagcgattctcctgcctcaatcaggagatggtctcgatcttttgacctcatgacctgagatggtcttgatcttttgacctcatgatctgtccacctcagcctcccaaagtgtagggattacaggcgtgagccactgcactcggcccacacatctttatacaagaggagtgaagttatacacattgtagtctatcctacaattttttttttttttgagatggagtctcactctctctcccaggctggagtgcagtggcaccatctcggctcactgcaacctctgcctcaggggttcaagtgattctcctgcctcagccacccaaatagctgggactacaggcatgccccactacagccagctaatttttgtagttttagtagagatgcagtttcaccatgttggccaggctggtctcaaactcctgacctcaggtgacccgcccacctcagcctcccaaagtgctgggattacaggcgtgagccaccacgcctggcctaacctacaaatttttaaatgggattttgtttggaggggtcgttgagagtctatttttcagataaagaaaccaccttacctagttacaagcattgagttttctttccctgctaggtcctctaccttatctgtggtaccagccaaaaagtcaattatttttaactccgagaaaattctgactgcaaagcactgcctcttcctactcagtacagatgatcaaggtgggataacacagaagaatcttcacacccactcatcactctctctctctctctctctctctctctctctctctctctcattaaaagcactaagcggccaatgccttactgtctattccatgggcttcactaggctgtcccttcttaggcctagaacgaaatgggcttcacaaatagaaattattctaatccaaataatatttccccaagtctcacagtgcaaaacaccacagcagagagcacatggtgatcaagaaagacagcattatcataaacatttgtatttcttatgctaacagatcccattcttccagtctgtggcattgtcccaaactgccccatcaaaggttctaaaatatgcttagggcatctctattaagaggatgaggagaaaggaggagggggaagatgctaacaactaaatggtaagtttttacataatggtacatcctgccagccaacaagttttactacaaaaacaaacaaacaaagaaacaaacaaagtttacaaatcctttctcttttttttaagttttattgattctgctgaatgaaaacaaaaaacaaaaaataaatgtttatattagtcctaaatgtaagtttcgtaaattctaaatgtaatacagctgaagcaataatagtactcatttggctcacctaaagtgccaaaccatttacctcaaagtatgttcattgtacttacactgactatgtgtttcagttgtaaagaaaaataacattaaagagcaggtatagaaatttagtctataacacatacaaaagctagagctataccatcccctaaaacatgaagaactttgtaatactgctttgtaatggtaatataattactttatcatagtattctgttttctgggaaccaatcatcttttagaatattaaggtttggtcaaccttcacacaattaactttagtacaagcatgagaaaataaggctacctacacactaggatgcagtgttttccaaatacgctaatcttagaacactatacaaatacaaatacaaatttgcaggacattactggaaaaatctgattccattgatctgaggtgagatagaagaagttggaatttttttaagagtatctctagtaattcttattttctggcagacttgaagaacatttttataatgtactcaaaaccaaatactaagaattttagattatatttgccaggctgcccatcagtcagtatctatatgcatatcatttgaagaagcttgaaatagagttagcattaaaaatagttcctccattatctatcacacaaacagcataaattcttttgttttcatctgaagcactttttgctctttgaggatccttttctaaactgtaaatttcctggaaatgctaccagtcaatatctttgaggaactaaataatagtccttgaagagcaaaaacaaatgaaaaaataaatggtggtaagcaatggagaaaaggagtatgaaacgaattctgctaaaggaattgcaagatggaattgactcattttcccattgagattaatcttttgaagccaaaacaaaatccgaggaccacagatgtaaatgagcatgacttgtatatctatgacttgtgctagaaagggctatattgtcatgattacctcccaaatggtcaatgagactctggctaaccttccctaatgaccttatgtcatccatatatcttaggaaaagtaactccctcccctacacgatatctctaaaagagcccactgaccagtttccttaattctgtccatctttgcagattacagacacttagtatttaccgtttcaaaagtaagcagcttagtatccatcgctcctttataattccacatattcacgtaagaaggcaatgataattcaggaggtacttcaagatcagtcagtgcctcctggttattaaaaaaaaaactttataaataaaaaggctgtaccccaataatataaatttgtcaacaatgtggagatataaaaatttaccccagaacatcaggaagaaacatgtagaataaaagtactgaaatgtaacaaaagcagagatgtgacctataggttcctttaagggtaagcttttgtgtcacacaaagctaagtgaccaatgaggacagcaggatcacaccattgatccaccaagtcaatctgagcttcttcaatctctggcctaatgcttcattatagcatgaagttcccccaaaatacactaatatgggttcaacaatggcgactttttaaagtaaatgcttggctattaatgccttattggttccctaatagaaaagggcaatgctcatatgattcctttcttaccactcttccttccaggttcaatatgatgcagtatttccaatggcgggagacagaaacaatgtcacaaagtgggagaggcactaagaatgagatctggcaccacttactcttgtttctatacaatcgaagtacaacacttctcaattttctaggcgtctttggggagagatcttatctctcttaatggtaccaactcagtaacccaaactgttcaccaatacttcttttaagtagttgtgaggtagggagtccaacacttcccaagagatcctgttagtacattatagcaactacagggaatgttttacaaatgactgtcattataatgttaaatctaacatatatgccaacccccttagtttatacaataactttcctccaaaaatcttaattaaaaataaaatatagctgacttcgttataaagagactcattaaccaggacattgcagtttttattttatcaaatagaaatagtgaaaatgaaagatgacatattttagagtcagcacatcctgggtccaaattccacctctcctgcttcctacctacgcatctttgagacagctgcataggctctttgcatctcaactttccacataaaatgtggcaccccacatggaacataagtttgttttttatcccttccataggtgtcaccattagtacaagtattaaaacttctcataatttcccattgagttttcatattattggaacaaactcattaagcaaagattttatgaggctagagtaaaaagagagcagtcaaactatagacacagaaagcagtcatggacagagattcacaacagaactttacacagttcctgtccaaagggataattaacaaagcaaataggtaggtgttgttttaaccaaacagactaagataatgaaaaaggaaaactgcagctctggaaaggagacaatgccatttgcaggctagaaagttatggaaaattttctaagcaataaaaacttaacatgacccaaaatataatcaacacaatattttgaaggcagacaatgcttcagaaaagatgaataggatatcacttaccatgggctttgttctttgtaagaatttcctggtatttttgtgggagtaaggcttgggaatttcagacctcagagctaacagtgggcagaggatgaaagatgtacctcaaaggttcttaaaagccataaggatatcaggggtgtcttaaatttccccaacaacctccatatccctaatgataagttgccactgtaaatggctgttgtgtaatccatcatgaatatagatttagttattgactgggaattctggtcaaggaggaatattttcaggttttatttacactgatgataatgtgtttcctcatgagcataatactgtactcttgcctcacctcttatgttcttttgccacatgtaatatatgtatattatattgttgaggtggagatgaagaatgcttgtaaagtattggaaagaacaatgtcacgtttttatgtcctctgagaaaataaaagggtagtctacctacagcctgaaatacatactgtcgcccattcatggaatttatatcacataagagttgattaactgagctttaataaaatatggttggtatacaagttctaattcaagaactggagtgcctgtggacccactaggatgtgtttaaggaaaatatgtttgggaattcctttggtttgggtgaggcaatatttctctggcttgcagttacttctatgcataattggtcattgttagtcttcccaatgtaggactggattacaggaatgctcgtactacccatttttgcatctaattttatgttcacaattttgcattatttttcttcatgagggtctctcaaattgtataagcttcaggcttgtgaaaccaagatccactcctgatctgtatctgtaaacactgtacttcttaagcatcaaaggacaggtttgaataccatcaaaggacactcacaaactttctaaaatatccacattcctaaggataacaataagggcattccaaattaagtggcgacagaaaaataaacacaaacccaacagtcctccacccacaaaattacattatacagtaactttcaatcactatgatctcaagagctataattaaaatagcaagttcaagtactttatatgacaactatgatatgaataaatctgctagagcaggatgaaacaaaagacaaagtgtgtcatttacttgtataacctgcatcacctcaggaaggtgcatatgaggttacatcaatatcaagtgagagagcaaggattatgtggtggcctgagtgaatctgctcatgctcctgggtgcaaaagagtgggaactgactgagactgattatctttattccttcttgacagcttaattaagttctctaattagtcacagtcattaagcactacatcagcaattctgcctcctcttggattggcttcttctctagtctaattggttagaaaagttagctgatctaaaacattgtctttcaattttgggaaatcttctttttcacttttattgagatataattgacaaatagaaagagtttatattcaaggcatacaatgtgatgttttgatatacatataaattgtgaaatgattgccacaatcaattaatatatctattatgtcacatactgtgtgtgtgtgctgagaatacttaggttccactttcttagcatatgtcaagtatactctaagttattattaactatagtcaccatgctgtgcatggtcttcagagcttattcataactactagtttgtaccccttgaccaacatctctccatttctctcactctgggacccctgctacctacccttctactctctgcttctgtgtattcaatttcttagattgcacatataagtgggaccatgcagtagttctctttctgtgtctggcttatttcacttagtataatgtcttctaggtttatccatgttgtctcaaatgacaggatatacttcttttttaagactgagaatactgacccagcaacacgaggttggtttacttcaagaagcaccctcaggaaagttgtaagtttgctgaactgggtcctcagccctgtcctgatcaccattttaccaccaccaccacgatgagcttcttcttcactctctctcccactctcactattctctcagctattcatcctttcacactgtctcagtctcttttgccatcccttgaggaaaacaccaccaaagattgaagccaaaatatgagagttcatactctaccccacaaatcagttcttacaaagaagacttcaaagaaggtaatgctctcaaggatatcactttgcagaagtgatttcctataattccagaatgataggcaatcagcaggaaagataagtgattgcgcaaagttccccacatcatagacacacctagaaaagtacagtgtccccaagacctgtcatgtctttcaactaatcttttcttgcatgctggtgtctcttcactattatatccaatgcagtaatatatttaatacctcgaattacagttcctataatcttaggaaattattttgtgatcacatttctaatcacagcatctcatgaaacacccccaaccactacactgcaacaacttacaaaagtattctgggattatgcagataccatatttggtcttagtctatcacatcattcttactagagaactttgttctaggcttttgtcagataacatattgttttatgtattacattggtttcaagagaaattttataattcttattcttttttaaagtccaccacaggtacaatttctggctgtaaatcactactttaaaacaacagcagtaaattagcagtaaacaacatttgaagtaaattacagcattttgaaagaaatatctttggccctttctccactatattcagaactgagtgactggcccatgaactatatccctcctcacaaggtatcattcacatcctccattgccctgcaaggccccttttttttctgtgcgcagaagcccagagagcactttctacaagtttagggaacatgctgatgtagaaacatgaaggataaccacagtatacaagtagtgcaagctatttctctttttgcaagggttacctgttgtgtatctaaggaatcgtgactagacttgtaatgtctgcatcacagagcatctacaaaccagaaaatctgagttctaggctgttttctaatgattcttagacacatatcaatttctaagatcataaaatgaagatacttagtatgactacacctgcctatcttctaggcaggcgtcaaggacattgtaagccataaatcaccaaaaaaaggcaagaaattatttttatcatgactaaaaattttgttttccctcctttagtctttaaattctgctaatgcagccttctaagaaggacatttctcacaaaggattgataaatatctgcacacacaaatgagtccacttagtcttgagaatctaatcctttagtcataattatcttggtctccatgcagtctaatttcagagttctagtaacaaggtaacataacatccactttctaaatgccctcaagttggtcacattataagattaatgagccagatcaccattttccaaaaataaatacatagaaccttgatttgaattagctaaatgaattgacatcatgttagtgatgtcaaaaatggtagagacttctatttcagcagagaaaaagcaaaataatattttaagaccaatgaggtttaagaaaatgaggagtaaataaagaattgaaaacaattaattgcaaaaattggaggggtatttgggcacagacagattgtaagagacactcgatggcaagaatgaatttaggtcgaaggtaatatgaaatttagccatagaaaatttttaataaggatgatatgtcgtcaaagtatatttggtgccatttggaaaatgactgagtcttaaaggatttttaaatgatttcctttttttaaagttgtcatagtcagtttgttctgatcttgagaaagtaaatctgtcttctgatggtcaagtgatggtttccctgaacatccaaacttggtcttcatgaataaggaatcagaatggagaaaaatctgaaaatgcataatgaacttttcagtttagctatgttaatctgtctcaaaattaggagtccatgacttttatttatactaatgtatatttgcatatataatagcatgtatgtctttattttgctattaagtcattttgcaatgaagatatgtaaatattttaggtgccatagggacaccaaaaaatagaagacactgtttctgtttctaagattctacaaatatgttgagggagataaaattagcactaataagaatggcttttttaggtgaggcacgatgataaaaatgtcttttttaggccagacacaatgactcacacctgtaatcccagcactttgggatgccagggcgggtggatcacttgagcctaggatttcgagaccagcctgggcaacatggcgaaaccccatctccacaaaaaaatacataaaattagctgggtgtgatgacatgcgcctgtagtctcagctacttgggaggctgagatgggaggattaattgggcctgggaggtagaggctgcagtgagccgagattgtgccactatactccagcctggtgacagagaccttgtctcaaagaaaagtctttttaaaaaaattctgtaaatgtatacaattaattgccaagtgactaaacagaagacaagcgtatatgaaagtatgttctagtattgaagcactttcatgaaattttaatttatactcaagtacataaaagtaaatgtttccaattgtggcagaaatagccatgctcatcaaatattccagttagttttctaaatatcccagtaactttgcagttaggcagcaccagataacacattctagttcatgggcactagtggaaaggatttgtgtcacttctgggttaaggtagcaaaaatctcatgtgctgttggcagtttctctttctttaccatgggttcctgtctctctctctctctcttcttctaccatggccagtgaggagtctaggcatcattccagatgatgtagctagaaaactgtggtgcctctgtcagcctaggttcctgagtgactatggtccttaaaactaggtgtgtctcccagtacaaatggttgtgtacatatatgacatgaaaaagaaatacatttttgttttaagctatgactttaactagtttttttaaattgtttttgacagtgcagcatagactagcctatcttgactggtagaacaaactaaagctgtgtgaatgaagaaaaaggcatccagaagtgacctgtcaaaataacctcaaagagtcatgggaaccttccttagtgactcaatgaaattttattttaatacacttgaaataaaaattcattaattctattcaatcaataaaaaaaactaaggctaaaaattaacggtttggggaatagcagaatagtgaaaaataacagagctttgagagagttatcaccttgcttcctctatgatacctggcatattaataactaccaagactcagagaagctgaactgaatgaaagcattttacctttattctccccaactattagcttattgtccttcctttgcctccctaagaagttacatcaggtgcatattgctacaccaatatgtgaactacatgatgacagcactatttacaaaatagaaacgtttggttcatcagcaaagtaatttttagatgtggtatcagagttcctttattgttaactccccctgtcctgggtttttatttttctctctcctgcttctctccataccatttggctcttcttatctctgttctgcatctttagctggagtggaggctgcacttcccttgtcccttaacaggcatatcaaaaaatgaatataagggccaataggaaggctacctgtgaattgtagcaatgttttagcagaagagaaaggatgttccacagaagtgattccttttacctgtcctcacatctggtcaacataaaagggatgatgaaagagaaacgatatttcagcagttgtgtgcatattctaatatgtatctttgtttctaaatagttgatgcattctagcttaatccttaataagaaaggacagcttcattacaaaacaaattcctcattggcagataagcagatgagagggagaatatttaacattactgataaagaatcaagttatgttctagattcatgcagagttttatagaattggtgcaaagtattagaaaatttataagaaagcttatttactgtaaaaaaaatcaatcttaggaaatagccacccacacatttttcaacctacttccccaaaaccatagtataacccttagaaagaacattgaagaacagataggaaggggaggtaataatatctttaagaactcactaatatgaaccactttatatatatatacattatctcttaggatcatataacaaagtttgaggcaggtggatgatatttgtatccccattttatagataagaacgttaaaacccacagagagtaaattgtttaaagtcactcaagtactaaaccttactcagtgtgatcaaaagcccatattctttattgtaacttatagcatataagctcctataaggaaaatcacttactaaaaatgtcttctcttctgtacatgccagcagtgctattcctcaaagcaataatctgcatagttttaaaattagtggtgctaaatgtcagcgatgactcatgctttagcattatctcttaagtatgcaggtgataaactttaaaaattaagtacattcattgtatttcaatatttctctagccattctttttggttgaaagtgtgtgtgtgtctgtgtgtctgcgtgtagatatggggcattaaggcaggcaaacttagaacacaaaatataaaaattgggtggggaaacatctggatgacctcaatatttacctaacattcttctttgcaaatgttctgaattgtctcatcaattctgcatcatctctgcccccttatacacttttccctgcattgcctggaagctacactcccagaatttcttaccagcatggttccaaatttgattctgctaatgaggtacacttgcaaaagatttggaaggcagatgagaaagaaaaattaattttcctccaacaacagctggaaggcaggtgtcagacctgaagtttgtgtgggcttctgaaaatcaccaacttcagtgcccaggtagccaagatcagcagcaatttcctgcagtttttttagctctctcatatgctgagagttaatcgttttgtttttttttctgatcgttgtcttttaggctttccagtgctatgtaagcacctaatttcctaaagttaattacttctgacttgaaatattaagtgtgatttctattttcctaaccaaaccctgaccgatgcagtatgtccaataagaactcattatcagactaccaggaaaacatattttaacacaggcttacaagaaaaacagttaccaagtatggatgctcaagacagccttaaagcaatgcctagtaagaagtgctttataataactctgatgcaagatcacatgtccaatttttaaaagatgtattagttcacatttgttgcattaaatgattttggggaacaacatagcctgagataggacaaaactgagaatcaaactagataaagctgaatgtgataaaaatatatgcctttaaaaagttaggggtctcaatcaggagttaaattcattaaagaaaaggttatgagtactccaagttccaacagtgaggcagggtcaagagttcactccagctggcacgaacaggcaggtaatagaggacctaccaggtttaaatggggaggttatcactgtcagatatgaagtggctccaatgaaaggttgggaccagtgaatatctgccttagttttagataatgcatatgacatggctttacccactgaccagtgctctttcgagaataaatacttagacacctaatacgtatgaagtcacacagataattggcatgagccaaatgagggttacttgtactctatataaactcttacatactctcttatcagtagaaatttctattgagaggtggcttggagaagatctctaagttgctgaatcccacaaagactttaaaaaggtagaaaattctaaaaggatgatgctagcaatcaatcaaatactctggcctcctctagaaggaaactgatttgatatgtttatgggtgcatttaccttctgcacacacactcgtcagctaatcaacacaacaaaagtaacacagtcagttggatggaattttagagtcatctccctctatgcacgtgtgctttggcaaaatcaggtacaatatacctgacgcttcagcttttcacttaatagtgcacttatttctagttagcccttgagtcatcttcccagatgtgttagcctatcaacttgtttttttcatgaatatgataactacttatctttcatcttacatcattagaacatttgaattgttaaaattccacatatttcaatatgatggtgtcctgtaatctctgaagtcttgggttactgagtctgctgtgtgtctgaagctacactatgtattagcattcttgttaggtttaatttcattttctacaatgatccatcccttgaagctccacaaaaaatatgcagagcatatttattgctagtactagtgtaaccgaaattaccaaaatctatagaattttcataaatttatgtattttagaataaattattataaaaagaattaaaggatgtttaagttcacaataaattttacatcatctatagacactgaattattagtcagcaagctttctctataacatttataattagaaccaaataattttgactcttccccttagtcatcatttgtgttttaatttctgtccatgtcaataaggttattcacagaaggcaaagaaaaaatattttttaagggtttgttttgctaagttacatggggagtcagaaattcagttaagatgaactgtgtgaggtattaattgaaatttaagtgtataatattcttgagttaggtatggaagatgacagtaatttcaatctcacttttacttcacatacattagatgtggtaacttcttttcagtcagagggacagatgaattctctaggaaatttatatgtaagtatttgcaggtacctttaagctagttctgaggagaaaaaagttatatgaggcaagaagaactttcaataaagaaaatgcatgtaactgcccagaccctccttggagttataaaagagccatataatttccacagcttccatataccaccaacacttatggtcctacatagcaagtcccataaagcctcagtagacatgtgacatcccgaaaacagagcaatgcccatgatcctatgacatgaggtaagaaattcaaggcaccatggttccctctgacacctgataaactgtatgtatttattttttcctagaaaaaaagggtatttgacacatatcgggagacacagtttcaaatcccacgttgaccatacacatgctgtatggccttgggcaactcctttgagtctctgtttcatcatttaaaaaccaaggttaataattcctatcttcacagagttgtgataacaataaaaatatattatgaaaatgaggaggctttataattaataaaggtataagggcattgattattttctcaaccctttacataaattagtagattattctaatcttgtgacagagaaaataaaataaatattgaaaagtattatgacagaaactagctagcttcccaccacatctgttccatcttcttcctgggcccacaggaagtataagcttcccactctcctttacagttagaaatggcaatatgactgcattctaacatgaaggaagtggtgggatatttccagtcttagccaataaaattctccagtgcctggtcctccatgccctttccccaagcatgagccacgggaagagaactccaaggtcctagataaaaaactaagccacacgataaaggaggcatatatgtgaatgaccaaatggaaagcctcttactgaccaggaacaccagttttgaatttcacatgtgcaagttatgctaaaccagtgagattttggggtttgtctttgacataattcagtaggacctcaactaaaagagggatatagacaagttaagtgtgaaaaggaaataccaccctcaatcaggctgccattcaaaaaaaaaaaatatgccaccaagtatacagatgtcaactatgattgtcatattttgacaaaatattattagaaataataattgctcattttagagaactgatgatctatgaggttatttagggtctgtgtgaaacttttagttctctcaatcatctggggatcatgagggagctgagatgagatctaactttctcaataccatcaccagtgctcgtttccctatagcacactgctgtgcccactgaagtcactggctttttttttttttttttgagacagtcttgctccatcgcccaggctagagtgcagtggcaccatctcagctcactgcaacctccgcctcccgggttcaagagattctcctgcctcagcctcccaagtaactgggactacaggtgtgcgccaccacatcaagctaatttttgtaattttagtagagacagggttgcaccatgttggccaggatgatctcgatctcttgacctcgtgatccgcctgccttggcctcccaaagtgctagaattgtaggtgtgaaccaccgcacctggccaagtcccttgctttttaagatacagttagtcatgcagttcttgacaaaaaaaaaaaaaaaaggtacatacacaccaaccattacagaagccaaaatatcaagtctagactgacaacctctgcagctacactgaaaccccacatcactaaataataaaaaatcctaatgtgactttctcatcttgaataattgttaaacaaatattatccctcttcctttctgccttctactctttatattcttcattttggaaagttttgtttatgaactaaaatattcgatattatatttagtacttagacacatctcttctagcttaccatctagcagaaggaaatgtaaatagtgatgttatattaaaaatctgcctttaatttaattttaaaatgaagggtaatggtaaattaatatggaagtttggacatgagcaatatttatttggctgaataacaaaccctctttaaagtgaatcctgtctcttaatttaacagagtgaaatttatgtttttataggcaattatgtgtcaattcagagaatctcagatttaaaagtggcaaccacttctgaatgaaaatgctttgagtatatttgtgtgatctggatatatttttcccagaaagtcattatgtattcataaatgtgaataaaaaccacatatgacataagcatgtcatataataaatcttagcaaactatatggagaaatataccacagaagtgaaacaatttttaagtatgtgtgtatatttatatatttgtctgttcgtattagaatcattttatgacaaatggaataattcagtaaccactttaatactgcatgtttaatatttattgagcaataaaccatatactaagcaaaaagttactaaccctcccccaccaaaaatgatttgctcgtattcactttttcccttatctaatgctgcaaagataattactttgtccctataataacatttccacaattcatttcaggaccagtgattagtccacaaagtttggcaggtttcagatcagaaatatgtgcataaaaatgctgactatttgaaagataagtaaataaattaagataataatttagactcatgttccccaagcttatctaataaaaagaatctcctagctttttccttagagtacatcctaggtaacagctaagagtcagtattattaacaagctcttaggtgattcaaaataagaaactggaaaacatagattcagactaagctcaattatcctattcattcatttatgcagtcattcattcattattttattcattcaatctgggcacactatgtgctggatacaacaggataaataagacatactctcagtctcatgaataaatgcaatgaaatatgacaaacgcttggctgaaagtatgtacagggtccattggcaacacaaaggaaggaggtgtcaattcaatctggcaggttgggtaaaggtttgtcctggcttcacagggaaacccacatttaaaccaagtgtcaaattagtaggtaatcaatcaccaagtgaagaattaaagaacatcctagtaagagaaataaatgccgggttcattgtgcagaatgtatcagctgagtatcaaattagaagacaaatctttttggaaactatttagagaaataatgagagctaaactaagctgagtcagtggaaaatagaagagaaggggggaaggatatataatattagaaaagaaggtggattggacctgggaagtgactggatgtggaaagaggaaagggagggattggagagtccaaaatagctccaaggctgcataaaacacatatagatggtgacactattttcaggtaaagggaataataaaagatgataaggtttgggggaaaggtaggaattcagtcttgcatgtgttacgttgggggacattcgatggatctgtctgttaagtagttgaatacgtaagactagaaccctggagagttctgagtttagagacacagatttgaaacttaacaacaggtgaatagtgagtgaggtcttaaagtggttaaaatcacacaaagaattttatagtgtgagaagcaggtcaagaacagaactttggacagttcttatattttagtaattatcagagaaaaaaagacaagaagaaaatgagagtgacatcagaaaagctgaggggagagagttttaataaaatgagttatcaacagcaaatgacccaaatatgttagaaaaagactaaaataatccatcagatttgttcctagagtggtcagtgattaagaagtggtatgagtttggaccaggcattgtggcttacgcctgtaatcccagcactttgggaggctgaggcaggaagatcacctgaggtcaggagttcaagaccagcctggccaacatggtgaaaccctgtctctactaaaaatacagaaattagctgggcctggtggcaggtacctgtaatcccagctactcaggaggctgaggcaggagaatcacttgaacttgggaggtacaggttgcagctcagatcaccactgaactccactctgggcaacagagcaagacaggaaaaaaaatatatatatgtaaaaatatatatgaaagaaacagaaaaagaaaaagaagaagacaaaagaagtggcatgagtttaagaggaaatgggaggtaaactggcaacagtgaaagtaggctatagtctcaaacttgattagtaaagaaaaaagaaaaatatgcagatgaatgatcaaagtatacccttttttaaaaaaattagagaatctcagaattaaaaagagtttggataatcatctagtgcatttcttttaccccaatgcagaaatgccttccaaagtctcccttacatgtaatcatccaacttctttatttgaatatttccaagaataggaagcttattaactcaaaaaacgctcattgtaattaacttgtttttgaagtataagattttatatatattatatgtatacatatcatgatggtgaatattcataaactgaatacatctatgtaagcaatatctaaactaagaaacagatattacaaggtgtacagcagcccgccccaccccaccccaccccaccccacccagtccctgcccagagtaaacactatcctgacctaaatacatagattagttctgtctgtttttgaaatgtctataagtagaatcactcagtatatactctgttgtgtctgaatgttgtgtctcactcaacattatgtttataagatttactcattgttatacatggctgatattcattcactctcacaactgtatacttctactgtatgaatattcaaatttctttttacctaaggacccattgatgagcatttctgttttggcactattacaaaaagggctgtttgaacacttttgtacatcttttggttaacatgtgtacatatttctcctgcatgtatatctagaagtagaattactgggtcatgggatatgcattgtagatgccctcaaaatttttccaaagatgtttccatttatacacccactagcagaccatgagaacttccattgctctacatcgttgaccaacacatattttctgcctttttcattttagtcattctcgtcagtgtgtagtattatcacattttgacttaatttgcattagtataatgattgttgaagttaagttctttttcacacatatatatattgcaatttggatatcctcttatgtgaagtgtctgttcaagacttttactcacttttttattggattgtcttttgtctttatcttttttatttgcaggagttcttatgtaatctgaatgagtcatttgtcagatgtgtgtattaagaatatcttctcccactctgtgactgtcttttcattctcttaatggtatgttttgatgaacaaaagttcttagttttaatataaaccaatctctctctatatatatattttttatgtttgtgtcccgattaagaaatccttgtggcggggagcagtgtctcgtgcctgtaatctcagcactttgggaggccagggcaggcagataacaaggtccggagatcgagaccatcttggccaacatggtgaaaccccatctctagtaaaatacagaaaattagctgggcatggtggcgtgtgcctgtcttcccagctgcttgggaggctgaggcaggggaatcgcttgaacccgggaggcggaggttgcagggagctgaggtcacgccactgcactccagcctggcaacagagcaagaccccatctcaaaaaaaaaagaaagaaaagaaaaaaaagaaatccttgcctactccagggttacaaagatttttctgctatgttttcctctatttcctacctagttgccctgtttactatattctttttttctcataacttttctctgcattaatcaaacatccatttatttatttgtagtaacatgctaactacactttcttttactgttcttttagtgtttacctgaggaattgcaacatgcattcttgagttggttctatataattattacttttagtatcttcccagaattgctaaacctagaagttttaaacttcatttatcacttcttacttttgcaatggtattgatgtcacatattattctgtatgtattttaaatttcacaaagcatcactcttattgttcaatatagttcacattcatttgtataaaatgcatttacactctccagcattcttcaatcactcagatatttccaaggttctatttagggtcattcttctacttacaacaattccctttggtattccttttagtgcaggcctcatactgattaattctctgtttttgttttgtttttgtattttgggtttttttttttttggtcagaaaatgtctttgtttcgatattttcaatagatatatttgtattagttacagaattgtaggtttgcagttatcttctctcaacactacatttcatttatcttctcacttcttttgttaagtcaattctcaatcttgtacttagagctctttaaagttttttttgtttgtttgtttctttgacttcatttaagatcttgttatctggttttcagcagttttactgaaatgtccctatgaatgtttttattgtatttatcctgcttcaattttgctaaacttcttgaacttgtgtgtggcggtctttccaaaattttagaaaattcttggccttaactcctcaaaaaatgcatctccccgtgtattctctcctctcctttgggacttcatttttacttatgtttaaaaaaattagcataacacaaataccatttacacaatatctaatttttccctttttctttctatgctttgagtattttttcagttcactaaacttgtattatactgtgcccaatttatcatatgtccctagcaaactcttaatttcagatagaggtaggactttgttttgtttcagttcaagaatatgtgtttgattattatttttattaattatttttttgagacacagtctcattctgttgctcaggttggagtgctgtgcacgatctcagcgcactgcaatctctgcctcccaggttcacgtgattctcatgcttcagcctcttgagtagctgggattacagacatgcaccaccaagcccagctaattttttgtatttttagtagagatggctttttgctatgttggtcaggctggtctcgaactgctggcctcaagtgatccttccaccttagcctcccaaagtgctgggattataggcataagccaccatgcccaacctgtttgattattttctatgtgtcccacttctccaatcgaattttcttttccttcactttttttagtccaccttttaagtccttgccagttacctgtaatatctggatcatctatgtatctgcttcaaatgtatactttttcttttgattatttgtcatgtagtttcacctatttgtatgtctacgtactcttttattgtatgatagaaattagttaaagaagaactacagaattccaaacgatatcttccaccagagcaggtttctcactttcgatattaagcagaagagacagaggctggacgtctcaagccaaccaaggactcagctgggttggggctagattgcagttttagtggaatgtagtcttccccttgtttatctatacttgtaagccatgacactccctggattttgattgaaagcctggtatatctttatcttctgggccctgaaaaagttctctttcagaagttttcagctcatttctttatcttagggccctaacagctacaaaatttggtaaatatcttcaaaaagagttcaatggtatgtttgagtttggtgtctccaggctgccaagtccttttgtttgtttatttcctactaaaattctactgccttttggaagctctgcctttggcttcctatgcagcctcaaaacacagcaaacatcccttggagaaagatgtgtgttttagatccctcaagtctccagtttgtcccagccttgcagtatcactaaaagttttgctaacttttcttactccccaaagacaccttccgcctaggcccagtccagtcctcagaccacactcagaataagcaaatgccctcagggaaataaatacatgcatgccttggaataattttcccttctgaaattttagttcttttagtccttgttgcttccacagctctaggaactatatctaatttatttggtttgtacagaaaaactggtcctatgacctacttgaaaatcaaagctattacattttaatagctctgattagtttttaaaactctattgacacaaaattgactctcccatattttccattaattggctaaattttgaaacctggaacagtattttaccttcaaccatattgctttttttcatctatttaagattatctcccttaaatatgtttttccttcagtctaaatatcaccaaattctaaacttctattttatgtttaaatcctttgccatcctgatcatcatcttcagtaaaaactctcgtttgtcaacatccctcttaaacaagtatcaacaaaaatcctagatgctatgattaagcccaataaagagaaaaaatgagagagtcatattaaaaaaacagagatacaaaataaagaggaaaaaaacgagagaatcacacacaaaaaataatagagatacaaaagaagttatctagtgaggtgtttttaaaagcacatgaacaaaagatcaaaaaaaatcaaagacagataaacaaaatagagatcaaaaaaatgaaatgaaagcttccaaaattctcatgaaaaatgctaagcataatgaaaagaacattttgatcctttctaagtctttgtttcacaattacctgaattcattctcacaattcaatcacattttactgatgagttaacttggaaaatgttaagtaacttttgaccaataacaaaatgtaactaatagcagagtttctaggtttggatacagatatttatttcgcacagctacactcagatctactgaattatcaaaataatgccaagtagccattttaactcttttttttttttttttttttgagacagagtctggctctgtctccaggctggagtgcagtggcgccatcttggctcattacaacctcctcccgagttgaagagatcctccttcctcagcctcccaagtagctgggactataggcacgtgccaccatgaccagctaatttttgtacttttaatagaaacggggtttcaccatttggccaggatggtcttgatctctcgacctcatgatctgcccgccttggccccccaaagtgctgagattacaggcatgagccaccgtgcccagctgccactttaactcttttttttttttttttttttttttttgagacggagtctcgctctgtcgcccaggctgaagtgcagtggcacgatctcggctcactgcaagctccacctcccgggttcacgccattctcctgcctcagcctcccgagtagctgggactacaggcgcccaccaccacgcccggctaattttctgtatttttagtagagatggggtttcaccatgttagccaggatggtctcgatctcctgaccttgtaatccacccacctcgggttcccaaagtgctgggattacaggcgtgagccaccgcgcccaacccactttaactcttttcatacaaatttatctagagaaaatgtccttctaagaatagacatttctattattcaaagagaaatctgtgtagattctgtcttatgccagctaaagacatgtatataaaaccacaaaatacattcttaatattatgaacataacataatttatttatgtatgtatgtatattatgaattataattcatttatgtatgaaaagcacacatttgagaatcaagctacctattaaaatggtctatatttaacacacagacatcatgctgaaaatgggtagctctctacctcccttttgcatattaagcaatatctgtgtaattgattctctctcttttggtacttaaagatgcatttggcacttgagaaagctatcttcagcttctaacagtaagtttgtttcctagagctgtttggtacctgaacaattcagatacatttgtagttactaaggctcagagaagagggatacaaatttggttgttttgtgttgcttctaaggatttctgcacacacacacacacacactcacacactactatttaaaatgctcttaactgaacaattttaaagaaaaatataatggtcagaaatcttaaattaaaaaaaaatcaaagcctactttatccataagtaggtaaagcaatggttacatttaaaactgtattaacaagaacaagtatttcattccaccattaggaaaagagttaccctgagagagatgccagttttacttaaattcattgtaagaggtaaatgagagcagagttgacttgggtctgggcacaagtaggacacctgccactattaagatggaaaagagataagaaaggtgaagttggaaatacttaagattctccaacgtcacgagactacatacttgcagttctgccaatgtttaacattttctcaaagtaagatatagacaaagtgctccagtctaggaaatcagatgggcccaacctaccactaggaggaaaaggaagctatgacattctgaagtttggcacctcgtaagtgcccactactattaattgcattgaatatgaactgaactgtgggttcactaaaagcatgcttctggagttaggaggccttggcaaatgaggctaaaaattaactcacacattcaaagccatctatttttaaaatgcatgataagcaacacaggaagcttttataactagccagcaaaatctgagctttcaatcaacaatttctttcaacgaaggtgtggagcatggaaagaatccagaagcacagatggtattttacatctgcacatgcaatttcctttttctccatttttatataaacctctctctttttttaagaatgatagaatttaccagtaaaatgcagaactacttaattgcctctagaaatgttcacacctccatttcacatttttagcagcaatttaactgcctttaagtatatgtagaaagatgggagggtggaccttttaagctcccctgtattacaaagtgaataatttcagaagattcaattcctccagagagctacaatttttccagcacttaaaataactgcactccaccatccttatctctaactattttcctaggattaatgctaacttttcactggatcttaaggctaaaatgaacttcagagatcatgttacttcagtcctctcctcaaaatatgagtaatcatgatccagtagggctggcagcttgttcaaggtcactttgctgcatagcacaggggaaaggagcaaagtccacctgcatcataatccacaatcacagagacaaatgtaggaagaccaatacatagctgtgtctccaagaatctatttccaggactccatcagaatgccaagcccttcttcttataaagtaagtcagattcatttgagcacatagagaagcctgacttttaaaatctaaaagcgtttctttaaaaattgaatacaaataacaggtttcactgtcatattacattcaaaccaaagataaataaggcatgaaaataatattggatagaatgaaattccaggtaaccaaacatggtacaggggactgaatttgtacatttaggtaacggggaaaataaaaatactacaacataaactaagagaaactttcaaaagcaatgttcaacttacctttagaaaaatgctctactgaaataaaatcaattgacatatcctctgtttttcatactaattcctctggcccaaacctctctcttgagctctagaattgaacaaagtacctccatgacatctccattggactatgtcaaaatctcctcgtctttatcacgtctaacaccacactcaccgccaaagcaacttgcattgtctcttgtttcaggcaacgcccccaacatgaagatatttgtgcatccagaaatctaaacattcctctgagacctcctaatcccttcagcaaatcctgaccctctacctcaatcactcctgaaacctgctaaatttcctccatctctgtggccactccctgcatccacactgccatcttgcttctctcatggatcttccagtagcctttgaacagctttgcacatgttcgctctggacctttgttgtccctcctctccagaatgaacttttgtcaatgcaaaccagttcttatcactctcgtgcttaaatccttcattggcttccactggctttatgataaagtctaaatccttcaaaatccctaaaaatttataaaatggtccacaaggaactagtggccctgatggctttttgagtcccacctgacccagtccctttgccccactcccccatcctgccatatccctgtagtctccagtccaaccattctggaccctctgtcccctgcctgcctctcatcctttgcacaatgttaccttggcttgaagcatgcttcctcccactttctacttgattcattcatctcaactcttgtgaaactttcttaggaaaatcttctatgatgcaactccctgaaagactggttccctgtatttttcctctgtaaccaacatcaaaatttgtaatcttatatttgtataactattgtttaatgtgtatccccttatgataatatctatttctatttattcgctcatctcactagcacctaagacagtaggtggcatattatacatactcaatgatcatttattaaatgaatgaattaataaagagagaaaattactaataagagacaaaattaataaagaaaagatagaaatctttttatctagatttctagattaacagaggaggaagggaaggggacagagagagaatataagtgatttacaacacaaatctcaccaacagcttagaaagttcaattttatgtgtaactatctgttactttggataattctgagctagtaggatacatcctaactagaccacagaccagggtcatacttggaccaagtcaatcccagttacccaaacttcagtcagcttaacagctctctctcaggagtaataacctctaacaaaggtattctgaaagtctccaaataaaagaacaccacttttaggttctttgcttgatctcagtaaacatcctcaaatgggcatgaagagtgatcttcccccaattcaagttctggaaagacttaatgtgtacttccaagactgtaccactatagtgcctactaactggccaaggtacagtgtcaaaagccctaaagcacaattgctctaaagtttatgtgtgtgaatatttgttctgtaaggaaatgagaaagaaaatgatcagaaagaaaaatatttgagagagggaccaacaaaatgttactccccttaaattatttaggaaaacaaagtcaaggcaattattatgatttataaatttttttctgataccttttttattattattattatttgagaaggagtctcgctctgtcgcccaggctggagtgcagtggtgcaatctcggctcactgcaacctccgccccctgggttcaagcaattctcctgcctcagcctcccaagtagctgggattacaggcacccaccaccacacctggctaattctttgtatttttagtagacatggggtttcaccatgttagccaggatggtctcaatctcctgaccttgtgatctgcccacctcggccccccaacgtgctgagattacagatgtgagccaccgcacccggccctctgatgtcttcttaacatcacaattctcaaacttcagagcaaggttagcaggacacttgtaattttgacaatgcaaaagcagagagagacagaatatgccaatgcaatgcagtagaccacttcatttgattatgtgacttagaacactggcataatttggctcccattaagagttttctgaagtttggatacaatttctaagacactcttaatccacttcaactagaatgtacactatgaatttcaagccaccaataattcataatatctgggaggaccaggaataatccatatttataagtttcagagacaagatttgcattccccttttggtttctctgatgttctgctggctgtattttttgtgtggggatgtatgcaaggttaacttatgagcacacgctgtgcacaagaaactctgtgttatagaacaaggggaagagtcctaggaatttaagaaactatcataaatacagacatcatggccatgtaagccatggcttggcttgctgccagttctctgccacagttgcagaaggaacacagcgatagggcagttcctagatataatatctaacagatgagcaatctacataaaacatttatttctaagtttagaaaaccccaataaagccaataaattcgcaaatatctcccgaggatcagaggaaacaatagaaaaggcaaagtattacaattaagcatctgtgttataattaggaagataaaacataacaataagatagtcacagcccagcgcggtggctcatgcctgtaatcccagcatgttgggaggccaaggtgggcagatcacaaggtcaggagttcaagaccagcctggccaatatagtgaaaccccatctctactaaaaatgcaaaaactagccaggcgtggtggcgggcacctgtaatcccagctgctcaggaggctgaggcaggagaatctcttgaacccgggaggcggatgttgcagtgagctgagattgcaccactgaactccagcctgggtggcacagcgagactccatctcaaaaaaacaaaacacacacacacacacacacacacacacacacacacacacacacacacacaaagatagtcactaacacacagcagcatgtaagaagtgtcaagagaggagtaaaataaaaaattgctgtagttagaggagggtggttgtacaaggttttggttttgttttgttttctccaaagtcttcctacagcatgcagaatttaacctgcctcttgctgggatccaaagaggcagggagggcatggcaagaagaaccagaaggggtgacagccccaagtgcttgtatttcgttaaaaaattccctcttctcaagaaagaaaattattccttttacgtgagctactggattgttttgcaggctagagccattttctgctggattgggttttgaaatggtatttttccatttattttacagtatcttatgggggtggaaagagaagtatcagcaggttaatttctacctttcacagagaatctgctgtttacaatgtaagacaaaactaccgaagtatgggacacaattagggaagtcaggaacacatttaaataaactgatgttaatgaaaaaactgaattctgcatataattcccacttagaatgttaggtcccagcatcgcaatacatctactgacatgagatttttttttctcctcagagaggaaatttatgttttattatttatcattcctatgcttaagcttgcttattggatttattcaataggcatcatcttcatcatcttatagatgtgcatagaaaaggtgaagtaacggccgggcatggtggctcacgcctgtaatcccagcactttgggaggctgaggcgggcggatcacgaggtcaggagatcgagaccatcctggctaacacagtgaaaccccatctctactaaaaatacaaaaaattagcccggcgtggtggcgggcgcctgtggtcccagctactcgggaggctgaggcaggagaatggcgtgaacccgggaggcagagcttgcagtgagcccagatctggccactgcactccagcctgggcgagagagcgagactctgtctgaaaaaaaacaaaaaaacaaaaaaacaacaaaaaaaaaaaaacaaagaagaggtgaagtaacttacctaaagctaaacaataaatcagcatcctatattagaatcctcagtcccttatatttaccctagttggatatttggcacttaaactatgatgctttccagtaataagccaacaattttaataatgtctaaatgtttctctctccttcagttctgacagacagagcttatacatttttgagcacatcaatttgattgcatctcaaatacagattaatgtggaaacagtaataattattggagaaatgactgttggcagggcatttaaaatgcttaattctctaagctcatttcaggtatatactgaacagtgatatgagagtgacaagcagtgaaatatgtagaaaaagaaaggacatgaggagtttttcaatcaatcagtagtaatacaatcatctctttcacttattgagaacttactatttcaggaaacacaaatatattttctctagcactaacaacaaaactgtaagatgcagattattatatccatttaacagtgccaatattgtggctcagagaggttaattaacttgcccaaggtcaccaatctaataaatgatataaattgacccattgtttccaaccctattgatagtatctgacttcaggctctcatcatctctcgcctaccattttgctatgcctgtattctcatatgtatacctgtcactgttgctccatatacattctttgctcctgccattttgagtagttctagtctcctggaccagctatgctgtctcatgcctctgcacttctgcctagaacagtcttcctacttttctctgaatgagttccttgtcttccttcaagactcagctcaagagtctcccctctgaggtctttcctgatcctagcccagcagaggtgatcatgccctcctctggagccagtatatagccctgtttattcactagtttactcactagttatgtttatatgcatggatccctattaaagacttagagctccttgaaaacagtattcatgttttatctttgaattaccagcacataacacagttcctgaaacttaatgttcacaaaataggagtacctaggctacctttgttagaagtttaagctggacccaaagttgattgcagattgcagtcagcattctcaagaaccaattttctttcaatgctatagagaggattttttaaaattaaaaaacagagaatttttatattacattttaattaaaaattggatctgctactccttcatttgctgttcatttcccctgttacatttattaattatcaaatatattagttggttttaaccgctgcttgctcccttgtagtccatctgtgctttcttctcaataatgcattgaagtcataagtgctagatttattgccttggtgattttcatggcacaaattgcgatttcgctagcactgagcagaaggaagagctaataggcaaggcagaaaatgcctaatcaatatcactcctggcataagtttaaaaccctaaacccccaagcagattttgcaaagggctatacttaaggccataatctctagaaatgcatttactatagtaagaagttgagaatcactttctttcctaccaaattctcaattacttcacaagcctcctaggaaagcactaaggtctttgaataactcagctggcccgcaggagaaaaaaggaaaccgtgcaggaattagataggaatatgttatttccaagaagggccctttctcctaaagatacatccttttttctaaagataaaataaagtacttctacatcagcatagagaagaggatttctgaatatgagtgttaaaagacatcctaaggattagatatcagtcatgaaactgattggaggcatgttctaaactgggtagtctgggggatggaccacaatattatgagtcaagcaactaaccagattttgttgactagaagccacccacctcctatattaactacatcaatgaaattaagtgctcatgaggcattaactggattgctgaaccagacaggcatttctgctatagtcatgagttctaccagaagccacctgtgtgttctcacaaaaaagcaggtgttcacctaagggtcaggagaggcaagtgtgatcaggggaccagtgagcatcctggtataaagaccttcattactcagccttttaaactttgaatccctttaaatatccataggtctacctaatttgagaaaaaaaaaaacttcctttattcgaaaccacattgctaatgtcctcaagtaaaaagaaagtgtctaaagtgcaggcttagcaccataacacaaatataagccaaatagctgccttttcatttaatacactatgaagaccaagcaatcaatataatgattaggaaacagttccaatcagttattcaatgttctttcttggggctaccatctaggaaatttgtctcagtgcaaaaaaaaaaagtatagtcctatcttcctggccacccccactaaagcagaataacctgatcccactgtgttatgtttcgttgtctacctcaacacatttcaacaatgtgctaattttaactacatttgagttatatgtgaattgtttttattttttagaatttgtacattttaattttccttgagaagaagctaagaattattcagatactagacagtgatagcagtttcacaataagaacttgtgcatgtattaagcaaccatgtggctttccctctaccctatcaataatacatatatgtctcagtttcatgtcccttaataaataattaagaaatcactaaaataaacagccaaggcattcaaaatacattagttctccccatagacattgggatggttcccattacatactttttaagagtctgatttacttgcaaaagctacacatattttattaaaatgtaagtaatcaaagcaaaatttaaaagcacatgaaaagaataaaaataaagataagaaaaatctaatcagttctctattaggaagggagagggacacagtcaattcagctagaaatataatggtttccaaggtcaatgccagttcaaggaagaggttcgttgctttgcaacacttttcagggagaaggtaggatcaggagctccagtgtttccttataaacaagcacaaaatatgatatattaaaacacctatatttataactaatctcaaattcacttatcacttttaacttggtattcatatattcagaataataatagaagctcagagatttaagcaatctatcctcatatgtattgttccttgagttatcctcaaatggttggcaaaaatctacacctggagtgagaattccacaaatacttacagagaaggaaaaataataggaagaaaataccaaagatgctcctgttgggcaacagtcactaaccatgaccaagttaaaaatttttatattatctaattgactatcacaacatcatgaatacattttaaagctaaatctgaagtggagaaccaaatattaaaatatatattaatttaaatattgtttataattctactctaaatttcattcacagcagaacaccctcagccatgagaaaaaatcattttcaccctttagattagaaaatttcctgatcctacattagatttccttaaccatatatttttacaagattcatgatcagtcctgcctttccaatcttactacttgggtaacagatactttgataacttttataatggacacttaaataacagagtaaatagaatgagaaataataaattattgctattactcataaaagcataagattaagctttttcatagagaaggctgtatcgcataaaaaatctgcctagactacgtttataaattaaggttcatcctttccttcattgctgattttatatcattcaggttatagattagcagtataaatgataggatctaataataagaaaaccagtttaaaataattacatgaaactccttcatattatgttatatttgtgccttgtatgttataaatatcaagacatgtcaaaggagttaaaacatattctctaagtagggtatcctaatgatactgaagatcttaaccttgagcttcaaatttgctgtccaaatatggtctgaattatttttaatttttaattgcattcaatatctactttgaactgtgagtgaaaagcaaataattacattgttaatgagacaagatacactatcaagaataacacctcacattttttatgtagtttattttttaacttgttttgatcaaagccatagttgaaagaaaattgtctacatatatatgtggctgatcacataatagtaatcaaaaatatgactagtcttcttgtttattatttataagaaacaaaagaaatactacatcctatgaaataaagtaagaaaaaatgaaccctaatttgtaaatgctagatgcaactgtgaaaaaaaaaatgagagggactaaaagtaaaaaacataggtaagacactgagaagagctattcaccacatcaccctccaatattacctccaatcagtcaacgttagtcaccctcatataatctatgtgtgctcataaaatttagaagttgatctttattaaaatatcaacaagaagtattttattgcataagagctgtattgtcagacttacttttaaagtttatgtttgtgtcatataaaaatttgaaataatgagttagtttacctttacatattagctcatcccttattatgatattttcattacaaatgtaaatacatagacttggttataatctattcagttccctgccaatctttccactctcaagaattttcaaacttttactaatacgcaagcctgcacaaaccctgagaagtctttattctctattgaatttacaatctagagagatagattatgttaatatcaatgaaataacagcaatatataaataagaccaacctggccagcttaaacatgacgttatctatataaagcctcatagcaacagcagaagatctttccctccactctcatcatatcctacacataattccaccctaggaacatggtgtttaaaatggcttgcttgtaaaatcagggaattggtttcattcacccaagatctctaggatattcaataatgatggatggatatgatatggacagatgaatgagtggatagatggatagataaatggatgaaggggtggaagaaacagtatattttttttcatacttatgtggatataaatataaattttgaagaaattcatagcaatacctcatccctataaaatgaaactcatctgaaggattttctttaaaaaatgttacttgaactaaaacaggtgcaagatttttatgcaacctggcagatgcatacagaatatcacttcatttagttgggacagaatatcacttcatttagttgggagataatctcaaccaaagtctcaattaatttagtaatgaagttgaagagaaattcaatgcttatcagtaagtaatcatatcatttgaaagcctgtttggatgtcagctgcttgggttcagcaaatcctgaaatgctcctctgcaatatccaagtcctgccaaagcaggacaaactatttttagatgaggcatgtcaaaaacgtagtctgttttataaagaatgtgaagactacatcaatatagtaaggaagaaaatgccagttggaaagcaagtgggctattagaagtcatgagacacacacacaaacataaatgccaatgttcagggaaatcatatatagagcctctctgtgagaccaaaataccctatcagtcatagatatggagagttctttccaccagttgcttctataacaattccaaacactagtatctgttatgtttgtttgctttataatttttaatataatgtaattttcattctgccatacttatataaacctagaccaaaaacattaactgatgtagtgttattataagaccctccagtggactgttgtgactacaatttccaaggggattaaaaaaaggaaaagaagaatgagatgttttcatactgattagcaactgcacctcattgcaccacagtatgaagaaacggatttggaaacacagcaccaagattagagaggcttttgagccatagtttcaatttaggtctcatcactttacctggcaatagtaccaatttagcaggcactgggctgtgcagaaagatttacatgtaaatgaacacactttggggcattttgctttgcctcagttaaagagaaacatcacttttcattggcactacaaaaataaaacagaggttaacacagaagggtccagggaagagtccattagtggaaaagctaatttggcagctgcatcaaactcctggagatcatgagcagtgcttctaggaagcactaaagaatttgaaaaacacagatattgtggaagttattagatgataaagtgtacacataacattttgcaatttatagggggaaaatcaccaaattaagggatgattatcttatttttaatattcttttaaaaagttttatacatttagatacacaattcataccttctctaatataaatatattaaaataagtttaaaataaaataaagttttaaataaaaataataaaggatttttaaatagttaaaatcaaataaaaaataaagtggatctcaaacatcataatgcagtgccatgtgcctcatcattagtgtggatttctgctcactcattttagccctctacctctaagctaatgtcataatggcctggatccttacataattcgattttaatagattatctcagtcatatagttcctataaagcccagtcaccgggggatggaggtttgtgatttcttctcagactatattaactaacccttactcttttctttcattcattcaagtattcattcattcaataaatacacatatagtgcttaataagtataaggaatcatgtgagacaatataaggcatggagaaatatgattagtcatagattcttgtgctcaaaaaggttatggtctaatatgagataaaagatctgtgcaaataaagacataatctaaaaacagacatataataatatcatgtggaaataccatgataatttaaagagaaagaaagcaagaacaagagtgagagagtaagtgagtgagtgaatgagtgaaaaattgagagatgccaaatggggagataagaaatgcttttcctacatggaatcctctgtcttctgcttgctaggcatgtattggaatggcttatgttccatccagaacccttcaggacaagaacttggcatatggcccagagaaggcattcagcaaaccttcactgaaggaatgagtgaataaattaacgaatgaatatttctctttggttttgtagacattagcatgtgaatttataaaaacaatgcatatagccaatccatatttattttttcttgcaaaactgaaacaaaatgcttcataaaacacaaaatatattcaaaagtggccacatcatttaaatagttaagattttttattgcaaagataaacggtgcctgcattacataagactctccctgttacttagatggactaggggcattactgaaagacaaatttgcaagacacccataaagctaccaaaattcagaatgttttttccttactctaaatgcattttgatgcaaggagaactgtgacctttcaaatagaactcttaagtttttttcactttatattttaactttgcaggatttcactataatgaagtttttgcacaaataccactaaaagaattattattatgttcctgcaaaaaatattttgtctctcattattctcgttacagacacttgaaaatctgcaaatttatattgagttcctgccttattatcctatactgtcagccctccatatccataggttctacatccataaactcaactaactgcaaattgaaaatatacaagagaaaaacaaacaataaaaaataacaatacaattaaaattaatacgaatagaacaatacagtataatgactacttagatagaatatacattgtattaggtattatgagtaatctacaggtgattttaaatatatgggaggatgtgtgtggattaaatgtaagtactacacaccattttatataagggacttacataaacctaagggaccccccataggttttgctatcgggagtcctagagccaatcccccatggatactgagggaggactgtacttgtgacctcagaatagtaactgttactttagttggcaatttagctcttaagaaaatataaaaattaagtaccagggcctggattacatttaagaattataaaggttattttcaaatgttaggtgtttaaatttaaagatagacaacataaattcaggctcttaattatgtgcttcttgaaagtgctttcttaaaaaataatttactagtagaatcaagataattaaaattaatgatccaacagcctgttgtactcacaccaattaaccattggaatgctaaagagttctaggagatagattgctcttcgaacaaataaatcagtttcaaagtaaagtatattatctctgtgggggagtctataaagtaaatattgaatcacttctcagcaatatggactcttgccaataaatctcaaaaacaacattattttcaaagaaaaaagatggctacctcatttggcacacataaaggatgaatgatatagttagtcgaatcagccaatcagagtatacatatgtgtatatacatatgtgtgtgtgtgtgtgtgtgtgtgtgtgtgtgtgtggacagaaacacatatactgtatttgtctcctaggccccccatccattgccttcctttactatcttgcaccatttgtccatccctttcacaagcctataattttgccagagagcagaaattgtgtcttcatcatgtttgttctccatttcccagtcctgtacttctgcagcacctgcctagctatgttttacataaagaaaaaattcaagacaagtatagtctcatatgaaacaaaataatcaaactacagattaattcaagtttctttttgcacattttgttaaaaagaaaagctaacatattttaactggaaaatatctgccaatttctaagtcaacacagggatctaactttaaaaaccccaaaggtcttcctgaacatttttacacatatatgtatccaggagtatacttaaggttcctgtccccatcttgagtgttttcgagattggactcttctttctatgccttgtattggtcaatatgtgtgtagtaagaagcagagaactctgattttgagctgtcactatcttacccacatcttaaatccatcataaactacgtttctttcctgaagacccaatgtgcaaagaagcatcataaaactacagtataaacataggaaatcttaatgttcacactaatggaaataagagctaaatgttgagaattagtgttacagagaatcagatgcctatattgtgttcacctctctaggttctaaggccagtaagaattagatagagtgatagataagcaacaaaatgtagtggttaagaaggcaggcaaccacttaggcaactcactagacgagtgattttatacaaattatttaaactatctaagtcttccttttctcaactgttagtcttagaaggcttaaaataggcaacctctgtccagcatgtagtatagtacctgtgctacatagtaaatgcttaatgaatgaaaataatgaagagaatattagagacgtgtccaggccacgcatcaactgacagacgcaacaaatgcccacagcttcttcaggtggctaggcagagtaacagctgcagaaatcctaaagaaactaaggtagaacctgcggtaacatctaggccgtccctgacactttgccagggacccaagctgcagtgtgataattgcttacactatttatctcatatagcacttatattttatcaactgccttaacacttagaaaccaaaatagtgattagtgacaaaattttcaagctgggagtcaagccggtagaaaggtattttcaatcaagagtttcttaatattactcaaataataccaaagggacagctttctattttgactctaagtaaaactaccagcctgtatataaaggtcaagcttcataggacaaaataaacgttgctagccaatctccaaacacacatcaaattgcgcataccttagcaaaacccaaagctagttatgaaaatcagcttatataaatgaaacagatagtagaggcatcaaaatgaaaaagaataaagtcatcatcaagtgtattttttagaaattaaaacatttctttaagtaaattgagaatttaaagacagtgtgatacatacacaaacatacatgcataaatatatacatgtatatatttaaggaatatatgtaaataatatatttaaggatgccaatttcccagaataaagtatactttaaatcccacttctttccaaagacaaagaataatgcttcagacatgaccaccccccaaaaaaaggaaaacaaaagaagaaagtatttactattttctacatattgcttacatttaaattaaaaatatagctaatttcctccaggataaatttataaatgcccagttttattggcaattctacagattagggagaccagtcatagtcactaaggtgaaaaaggtaatgatactttgagccgagatagtggtaacagagatgagagatgtgtgtgcctgtcattgatgtcaagaaagtaactggcaaatcatgggacatttggaacaagagacagggagtcaaagtagatgggcaacaagtagattaagctgacttaatctaataagtattccctagaacaaaatagggaccaaggaagaggaaccagtttgtattcagagataatgagctcagtttgaaacaaatttaaagacaaattagagaaatatcattaactagaagaagactgaaatgcctatttcttattttatatgttagtaggtagaaataaactcaactgaaaaccccttaagtttagtagatgaaaaataaaagtaagaaaatacgcctctgaatttcaagataaaatgcagaaaaacatttcgatagtgacaaggactacatctaaaaaactgaatttcttcattaagaagtctgtttctttcactgtatgcagatgatcaaaaatgatatttacaaaaaccctaaactatcatcttttcaacaacctagagagttagaaaacttactagataacattcagccttacaaaaatgggaagatttcccctgtgatatatgaggagagcatgagaattctctcaatgagtagagatatttatacatactaaaatctctattcagacataacacttaccaagcaaactagagagagaattctagagaaggaaaacatggcctttttgttattccttcacaaaagaagactgtcattttctgttcttcagagtattttgtactttaaaaataaccttttctatccaacagaagagattcttgagtgaccttaaccaaattatgagaaattcatatgaatgttcatatatatacaaagatatttgtacaaatatacctagatattacttatatagttaatatgtggtaaaaattattatttttacttaatcacaacttagaaactttaaaaaactattcttatcctttataatcacaaactcaaatattacatatgaatgggaaaaagaccattagtaattagttatttttaaccatctaactttgtactttttatgtgaaaggtacatagcattgatgttgatacgagacagtgatatgagacttggcacatcactggaaaattactgctagggcaaatatcattgatgtcaagacactactagtgtagcagaatcgaaattattcctaagggaatttcctaaataatgggtcagctactactactcattattacaatagcatataacgattttcttagctaagagtatacatgataatgctttctagagagtaagtttttatacccctgaatctccacaattcatagccttaagaagaattacctttcttggaaaacggtgatttagaggattaaaagaaaccagaagtaatgataaacaggagtttagcagggtaaattcatggagagaaacttaattctcagaaagatatgacaagaagattctatggacactttaaatagagccttccaacaaaagatctggagaagcaaatgccttattagatttaaatttcctattgcccttccctgagcctattccaactagctagttcagacacttagggtaactgtttattttatgaaataatgtatttgggtaaccttcaggtaggttgactaagtcatttattgtcaaaatgggacgataagcataaattgggactgtactgttgaacaccctaatctcaggagagaccatgttaataaaaattaggtaaaaatggagaaatagagagaggttactgtgaaaaaaagaaaagaataaaaggacccaaagtcacttgatggttatgtgaagagaatggaatttattgtgagttggtgacaggaagggatctacaaggttgagtcaaacagatttgtttttttaatgccagctggtagcctctccattactacccagcgaccagtcattttttggtgcaaggacataccctcccaacaaaactgaaactcccccccaacaaaagattgctgaattcacagtcgttgcccaaacctctgcatcaggtatttaccctggtgtgaaaaataccatatgcagattttaatttcttatcattttagatttagtttatttgaaacataaataggtttcatcctagtcacactcctttttcaaattatggcactaacacaaattgtcatttgccatattctcaaacaactgactataatttgaaagggacggataatctcttcatggaagaaccaaagaatacctcttaaggcaataccgtgatgtcaggcagcaggtagtgcactgctacttgagcagaaaatgtgttgcacactcagcatctgacttcctactcgaattaacttatgtaaaaatctaataccctaagctgagaaagtaatcaacatatgatgttgatatagagaagaaaagatattacaaacaatatatgtaatatttttcatgaggaagacttgctctgacaaagaataattttctcattataaataattagaagcaaaaatatccctcccttacaaatttagataatagagactatttttatttttattacatttaagaatcattgggttcctaaatggatatcctacatggatattctaacgaaataagtatttccagatagcatagccttttaatgtcatctcattaaacagtgaactaggtcttttaaattgaagtaaaatttattttcattctacatattttaaaatacatgatagcaattgtatttaatgtaaacatctagtaaattattatttatagtaattgggggaacagtgtataattaaaaagaaaattactggccatattctatacctaaatcacttggtccttccactgatatttaggttcttcatattgtcaagcatggtgcctcatatatcacacagtttcaataatttttatccatctgattagccacaaaagaataaacataccttgtactacatctgtatacaatacttataaattaaaaattgaggaagaaatgacttaaatttaaccaaatattttatatattaaaaaattatcttacttgacattccaataaaattgtcagtgcaaaatattcataattcaacaaagacttacctgaacacaatttgaaaaatttatgagtaaatgtacacacatgtgcatacatataccatatcatgtatatatccataggtatgtatactatatttacatgaatcttatatagatgtcatgagtatgtaaaagtggtccaaaactgatgtatcaccaaaatttgcattttccatacctgatttaaatgattttgaaactataagtaattggctttaagtttatacatatatgtgtatatacatatatgtttatatattatatatgtatctgtatgtgtgtacccctatatatacacatgggtatatatccaatgctaactctcttaaattttcaaaatcatttaggtcaacctgggaaaaatctactgtgatgctgtattcagatatggctagctgttacattctacttactgatacatcttactatgttattttattgttaataagatagaatcaactttaaaatgcactctcaattacatggaaatgatatatgttaaacattcacgttgcttataagttccatcctaatttcagaaataataaaatgtgaaaaaatgtggatttatatttaaacagtataatcatggcataaagtatttcaaaataagacatatccaacagtaagaaactcactaaagaaaataatatgtgggatttttaaaacagatcatcagagctaactatttaattgataatggttcaaattaggacttgcactctgcataccagtcagtagccttgatacattaaatcaagcaggaaattgtgtgtgcacacacacacacagaataaatgtatcatggtttattatttttcataaatcatcaccatagaaattacaaattattcacagtagagttaattctaagtaagccagaaatgattctgcatatatgaggcataagtttccatgacgaataaggacaagtatataaaatcctacagatatatgacccataacacattacagagcactgatttcccagaggataatgtaaaactcgtgtacccagtaacagttctatttttgttctcttctataactcaaatctattcatgctgcacatttacttttacataaaaatgtattttagttatctgggctatttcatctgtgacaacaagattcttatttattttaaatggaagtatcctattttattcttaagcattttctttacgatctttcagtcgccttgaccattttttaaagtatgtgatatctttcattcacgcatcagataacttcatgttttaaatcttaaaaatccacataaataggaagagttactctggaattttcatttaataagctggattacatttctctaagaactaagctatatatattttatatgccgaaatattcatattataagcaaataatcttaaaagaagtgattagttttattttttatttttttgattacttttattaaagagataaaaggtaatatttgctccaggaattttcactgaagtagaaatacatgtaagtagaactgtagggatggaaacagaagtggcaaagacggttctaatgcatggagagaaggggaaagaatgtaaagatgcagttaataaaaaaataatacctaggccttctatttttcttagctttggactctaatctcagctaagatcagaaaggaagttagtctgatgtgctcaaacaaatatacattctatctgttcaccaaacaagaatggcagaagcttttatcctccagagaattcaacagcatgaattagtaattaggatattaaaccaagatcaggactgaaggttcctgaaatctgcctactttttaggacaagtttttatcttattgaaaaagaaatgggaactatctctagactttgatatctgattatatttcaggctcccctttgtctgtaactgtgtttcccttctcaccatggtcatgcttgctttttccctcacttttagaacttgctttctttagttggcaagggagtcccttcctcatgtatactactggttccttcaaactagcatcatcctttgatgctttttggactttcataggaaccatagatttttcctgggaattctctatgctcatctaaattttagatatatggaccaaactacagacattaatattttaaggaatcttcatgataaaataaatattaagaagtcatgggtaagaatagccagaatggcttgtctagataattctcttctgcaatggttatcgaagtgtggtgtgtggattaatagtccagcatcatataggaacttgtaagacatgtggattccaggacctataccagacctactggatgaaaaacttgggtggcagggggttgactagttaaagaagtgggtggtgatttttgtgaatgctaaagtttgagaatcactcttgttctattgtatcctaaccaaataataggataattaacactaataataataataatagtgtttatcagttctaaaaacacaattattttcccagttagcgaaagcaattttctgactgttccaataaatcttttatcattttcagaaccatgtaggctactacttatccaaatcttctagtaaagaattaagcagtttcatcccaggatttaaaactgttgcactgatctcaccatataggaatagggggcattagcgggataatatagggacacctgggccacagggccacagatataaccatggaggttagtcaggtcagcacttcagtctctaaatctttcccctaaagttgtccatatttttataactgacttttctcatgtcatttttccccagatacctttatcaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatccaagattgattcatgaaataaagaagacatgaattgttttaagtctacactttgtaattagctaagttgtgcagtattttttgacttaaacagagtatgaccctgaaaaataaaagaatctttttttttcaaaactcatcctacctacctgtaaaaactgtacaaagctaatgtatttttcatattgtaaagtttcaattgtagaaacaactggtatgtacagtaccataatttaattacattttactttaaaaactttacacatttcagtttctaaaattttaaattaacaaaaattatttcttgtgttattcagagttactcagttttgtaaggactgttttgttactgcttttgtgcccagaaaccttgactctaaaattctgtgctgtgcgaaacatgcacgatttttattatgcttactgcgtagaattttatctacttgttccagaaataatacattaaccaaaaaggatttaattgttcagacttgtaagaggttcttcaattacataggcaggtttttcttaaaaatgaaaaaaaaatcaaagatttttttaacagttctcagacttaactgttgccttgaattacagcctagtttctaagcagtgaaatgtaatgataaagagggatattttaacatatttccgaatgaatgactcattatttcattcttttgagtaaccattgttaagggttgggggaaagcatggacaaaacatcactggaaacaaaggctgtaaccacagcaacagactttgtgatacagttaaaaggtgcagctgccagtgacaaataaaaacttttgttacatctcattattttcaggccaaggtgggagtatagtgcataataattgtacagtagcaatttttatcctaattaacccatagcggtttacctaaaagtaaccatcagtcagtgcaaaatgtgcctggttcttaagacaactttttatttagaactgtgagaccggtattttggaaacatttcaaaggaaacatatgaatttgttttgcgttgtgcactacatcatttctctcctgaggaagaattttaaacatgtacagctcattcaatatagatatgagccatggtggagaactttatcactcaagtagacggtaaacatccttaatatgttctaaattgtttatattgctatccataatgggattcacctccaaattatcaaagaaataactcagagtaatttgacaccagcccagatcatatattgattatacaattgtattataaagttcattcaaatcaaattaagaaaacctgagtctttagaagctgaaataatcaacttgtttgtgctgtttgcttgacataggttattgtttgaaaatattgttactttatcaatagtaatcatgcattcttgtgtttttttttaatggaaaactgcaagtttcaattactgttgcactagaagtgctttttatgttgtcattttatattcatgccatcaaaagtagattgacaatacatcaatctaacaggggccaatcaaaacaatgaagaaaagaataactgaaaacaatgtcaaacttttaaatttttatctcttccaaagaagttatatctataaaatctagttttatgcaggtttgtcacagcaaatgtaaaagcggattcaagaagaatgaacttaaaaactgtggagcaaatttttgttgaaaatatataaagtcagaaagaaaaaagatgtaaatgttggaagaagcaaattctattactaattcaaatgaaactaaatgtcaaacacagtacttgtgtcaactatttagcatcccagattttgtaacatattttgcataaattatttgctcttcaaaaatttttgtcattttaaatctaattttaatctttatgttttccattttctaatttccttgcaatgtattattcttattcttaattctctacattgaaatttggctttacgtcgttagcaaatttataaagggttataaagctatgattcgtgagtctaaaatcaaatgcaaaattttatttattatgtaaaccaaaatgtcatttgcaagttttctcattagaagttatccttgcaaagatagaaaaagaagaattaatttgtgtaaacaagcacaaattaacatatttgttaataaataggtttatctactaataaacctatttctagacacattcaaattgataatgatttttagaaatgttaaggttccaaggagtcttacaagtgtatgcccttgatttcctgaaggaaaccactttctttcttaaatattttaaattcatctaaagtgaacgactataaatagaagcaatcaccttggaaccacagctctgtgcaaccaaggccctaagctacaccaaatacgccaggaattttgagacttctcatctttaaattcaaccaaaagggtctttagcaagaaaaaaaatgctggatgatgattattattatttttgcttaatttttattttgccatgtccaggttaagggtgagggtggtgacaatctgaaagactgtgtctggaatctttatcacatatttccaatttatttcagtttttgtctaaaacttgcatttctaacctatcttttccagcatttgataatctcccatttcctccttctaacccccattcctatgtctcccttcctgtctattcctcaccgatttaaacaactgaaatgtttacttatgtttggagctgaaaaatggaaagtttcacccagcatggttacaataacagccagcagctgcagcaaaccataaagttatgcagtgttttgaagttcacaaaccacattttacataaattatctcattttgtcttcataacaaccctatgaagacacattaatctcaaagaaattgagctcttaccccaaaacacagggccaataattggtgcagttgaattattctcaaaatttacaggctgttagtctttccactgtactaaaagatttctttctctgatcagagcaagagaacttccagagataatggatagaatgaaagaatatatatctatatatatttgacatgttgtttagtaatccctattttaattcaattctccatctgtaaaatattagctaactgaattatttctgtgttctactctgggctctcacattaaaactctgttcaaaaagtttaacaagtcacatatttcttaacatacaagttcgtttgtgaatgtgcagaacagatgctcccaagatgtggatgcatgtaggccccgaggtacagacataaaatcaaggaagcacaaggaaagaaaccccaaggaaaaaaccaaagaccttctaaattgagactgcataattataaaagagatccatagtacagggttgaacacatgttcaacactttgtcaactgaacacatgttcaattcggagctaattgggaagacttacataaaattctttttctttttttcttttggcaagatttcttcttaaaccatgaaattttttttacttgtaataatagagaacaattttctccattttcttataagaaaaataaaatataatttatccaaattgatgtatagaacctaaaacatatgctaacttgcaaataatatattttactgatcaactcatttttgtcaagtctctatttctagtccctcctgaatgttttggaaaaccacaaaactatacagattaatacaaattacatttttacaaggaaagaaaacattcccaaatttaacactcaagactaatcacataatcctattttgaactcagatctctctgactccattgactgcttagaaatagtaaaatctttttgaaaaaaaaattttctaaaataaaactattgtatatgagagtaaaaatatatttgtttttgattgttcctgactagaagacagatatcatctctcaaactaaacactcaaaataagaaattgaattcatgaaaaccaatacctgatgtgaattgttgttattcaactgtataaaagaaatgcagatgttctgggtatgtcagagcatgcgaaagaagaagttatgggactggcaggtatttggcctcaggagaaaaggtgaaaattttccagaatagatataataacatcttatattggcacagctcttaacagtttataatgctgggtaatataacaatctcctaattcatcaaaaagtctcaaggtgcagatgaattggtcttgcaataagaaagagcttccaactcctcccatgaccttcccaattttccccaactgtctctaaatagggaggcgccaagtacaaaggacccaggagcaatgctttcaaaattctgatttaccccaaaggtagggtacctggacaatcaacaattgggcttcattttatcatcaacattaatgggaaagaaatgtttaaaaatttaaaaccaagcaaacacacacacgcacatcaaagtggtgatgagtcttttttgaaggtctctcatgacttgcattatagttttattgtgagataggaggcaacttatatttaatttatttagggtaaatttcacattttaaaaagtccaccattgacttttttattctatgaaggacagtgatcttacagcagcagagtgcctcaaccatctaggacttaggctactaagtttcttcctcctagctctcatttataaattttgtgttatatgatatttgtcttcctgaaaaggtgagtgaaaatttattttgtgtaaatcaaataatatttcaaatgtatcaagagaccttgtgataaaggaaccttgaaattgctttttaatctaaaatattacctgctaatttatcttttttaaattgatttccatatatcttgtgttattataacacagcacacttgtactacatggtttaaaggttctgcaagacagtcttttcctcagtctataggaaatgacggtctgattccaggttttgagttggtcagttgagcagtttcagtcatttccacttactgactttatctggattaatgtggaaaatagtagtaagacaacatggatggataaatttgacaaataattttatttgtttaaacttttgccacctataatatccttgaagttactattaagaggtcaagttgactccaaatcccttgtgtcaatactagatttactgaatcagaaccactgggatggatcccaaaatatgcattaagacatgactgaggtgatactaatgcatgctaagttttgaaaaatagtgctcaaatgaatttatttttcctaaatcattcaattgctttctattctaaagtaaaattgtgaattcttgtgctttcccatatcaatgtgaatctagttttctaagcctgactgaacatttttcttgactgaggaaagcataccaaaagacaactatatataaaatgctcaggttgcttcctgacagactgttgtttatagattttattccccattaactctttcgagaggcatatctgaaaagtcttaaggcttctgggttagttacttgttagttgcacccatgaatataacaactgaaaagctggaagtggggagaaaggcaggaagtaaattatgatgtagcaggcactatgccctcctctcatttttaaatcattttaggaaagaagtataaccactattttaaagaaaggaaaataaggctcatagtaattaaataatttgccaaggctcacacagtggggttgaagattcaaatctagatttgttaggctctaaggatgtgctcctacccccatcatagcacattttcaaaagtgagaagagattataatcaacataatgaggcttatatatattattctgaataatttatacagaattatttattctgtattcagaataaattcttattctgaacacagcagaaaaagaatttgcctatttccaaatagaaaaattatcttacactgtgtagagacttccttcaatatcctaaaccagaggcctaatggaaaaaacaacaacaacaacaatattttcttgaagttttatacatggttccctaaaaagagtagacatttgaaagaaaaatccttcaaaacataaatacccttgaatattgatgtcatatttttatttccaatcatcttagcccttttataaatttacagccaaaattacagccaaaattacagccaaaattgataaagaaatatcaataatataaccttcaactggctgaaaaaaagaggtcaggttgccaattttaccaaaaactatatggatgaatggtcaataaagtcaccaagtacaaatgacaaggtggagaaaaacaccaataatctacagtcgcaaactgtagcaatgacatggcttgagctacagaatatttcctgtgagtgattttaaatggcaatattccttataggagtattataacttacacagatgatatgggatctggaagcatactacatcaaaagaggctgaaagataacctttataataaggcagactctacttgtcctactcagaatgtaatatgtagtttaaatataaaataaatatcatttccttgtttcattacttcgtggagatggacaaataaaattattttttgaaacttatttttaaactcacatcttgaaaaacatcttcctcagtctcagctattcacaaatgattcttaagtagactctcgactccattagtgtctcaggagctttttattaaaccattgagttatctcttctatctctccctgaactccacaagtgcaagtaatcccattggtttaattacattagcattttactccatcacaggatctgaacatatagcatccatgaaaaacatacttctataatacacacagcattcaagagccagtaaagcactctgtaagtcatgcctcctactaaaaatgatcacgtctataactgtgataaaaactaggctataaatttaaaacaataaatccagcaaagaaagaaattctagcacactggatctaatatcattgtgtcttctcattgtggcaccattaccaccatacagaaatgttatctgaaatatctagaataattctgattgtggacaacaaagatgctcctggtatctgggttgaagatgtggtaaaaaacaacaaagaagacaaaaattacacataccaaggtaagtgaagggcatgtgatttattattaaataatctgccagtaattttaaaaactaagacccattattaaaatttacaataacatttatgccatcaagtgtcatcataaaggctaatgtggatatttggaatataagagaaatgtggtatttgtgatggcaatacatattaaatgatagatagatagatagatagatagaattaattctaccaaaagagagactattaagaataaaaattagtccaagaactatttctattatttctctagagagaaactgaatagacagagaaaaagatttaaactaaatgctacatgttctttccaaggtcaaatttgaaatagtccaaaactataaactcttgaattgctgcttcaaccatatgagtaattacattaattcacatacaccttgtcaaaacctgatgttgagaaatgaattgtaattttaaatatactccatctgttcttgctgttttacatcaatgatatatttgctttcaattacagatccataaatataatgccctaaacagtctgatgaaaatgtggtgaaagattggtcaccgctgtttttctgttctaccataaggcaattatcagagtggaatggccaccacaatggggagctggaaatatgatttttaaagtcctctctagaggtcttattttatattcacttataaattaagaaaattattgccttgaggcaaaagcctgagagcccataccagctctagtctgactacacttacaccagagaggtctagggaaagacactgaacatctctgaacttgcatattatctggagaaaagactgagatccttgtgatgtcaacatttttccgcctttggatgtgatggaaacttaagttcagtgtattggacatccttcaaaactccctgccagtttcctctttaacaaacttcaaacctgagtttcttgagccaccattggctttgacacgcagctatttaataatgaatccttgttacacttcatcattttgtggaagaattacacaactggggttgtagcccttagcggcttttcccttgcctttggatccagttatgggataaaatgtgtgaacttgacatgacacattggtactaccacaggggtactggaagaagagccttctaacagataaacattttatgtaatataaaactgaaatgtagtttggggccacttctttttaacttaataatctgatatagttttcagataactgcatgcttttctgccactgagaatataaatactattgtctgtaatgaaaacatggttttgttgtcatatactttcgctttctgaggacagatttcagacaactgattgtgttctgtaattaccaaaaagaatgtctatttagtttcagaaagaatggcttaatgccaaacactttaagacaaaataacaactaacacttactgaatgtttacttttctaagcattttacgggtgttcattcagtcaacattaatatggcaaacagaattaataataatcctatgaagtagatactattgtttttcccttagaaagataagaaacggatgcacaaagcaattatataacatatagctattaaattgtgcagcaaggattcaaatccagttgactgatatattgaaaaactgacccctctaactgctcatttaaggtccactgtatagaccccaatgctaagttcaaaattctacctatttaaggctatcactgaagacattttttcaatataattaatgtgtttattacatacctaatatatgcctcttggaaggtaagaaaattttagagatacatgagtatatgacatagtccctgtgcccaagggacttacagtcttagcaaagagaaaagacatccatattcaacagaaataaaattcaagaactaagtttaatacctgcaatcataaacagcagttaggagaagataaaatcaaagttaataagtttgttgggaatatctcaaggcaaaagtgataaatgacatagaacttcaaactagcagtgaattcagatgggcaagacaaagatgagagggcagtgaagggagaatattatatttttatttactaacatctattattccaataggatttgttaaattcatgcttctctggaagagaaagaccaggctcaatttttgtcctgattgcctaaaagctcagagccaaattaaatctcttggcctttctaggcaagcctacatatttcccacatttttctgaactctaattctctttacatttctattttatcttctttgaggtgggggaaaagaatattaatcctttgtttaaaatgttatgtcagtttcaataaaatgttcatacaacattttgaagactgatccaggcaatggcattaatttcaaataattatgtgaattaaatcaaacaactttttagaagctaataattgtaacatcctccaacaaaatactgtttggcacaaatgaaaacacggcctttagattgattgactttttcttttcaacctttttagtctttatgttagtattggtgaatattaaccagaatttttatttcaaagagtaaaaataaaaatcatttttgattgctacattttacaaacaaacaaactacagtagaatattattaaagaccatgatcaaaatcatttaggtgatagtgagacagccaggtgtgagggggtccctggcaaaactccaaacaggtctgcacactgggaaggtgcactcgggtgcagtcacacagaggttccagtccatttgcagcaaggaagagcctggcccctcctcttcctgtgtggaacttgggattcaagcggccaagcaggaagtgctctagcagggactctggccttgcggagagtccctgtttcccccttttcttccttttcacccaataaaaccctgtcttactcaccattcaaattgtctgtgaacctgaatattcctggccatgggacaagaggcctatctttagctgaaataaggaaaagtcctgcaacaatagcaaacagaccagtactagaatgtacatttacttataattatttttcactagagtgaaatatttttaatttatgaatgcactgacattaaagaatatgcagaattatttctgccttaaaagtataaataattgtcagtaaagttgtcatttaaaaagtacagtcaaatatatatatttctaatctgaaacatgatacataagaagctactttagtttttttgaatttttttaagttgagaaatattctcttcatcaaattctggacaattaagttacagttacctctgtgtttatttggtaggtacaaattttcattcacgggtatttgttcaatgtgtcttctatatattttatactatataatgatattttgatatttttaattcaaatcaataaaataagcatttattcatttttattatggtattccagtgactatgatgtgagacacagtgatcaaatgcttatagtgaataaataattgtgactcaatgtgatatttctaaaaatgaagtctgtacatgatgctgtgaaatgattgggtttgctgaaaatcagaaaagacctcacagagtaaatgctacttgagaaactttaggtttgccatttataaaactcaggtctgtctacaggctccacatccagatcctaactaaaatttagaagtctttagatgtctgtggatattatcatctggaaaactgggactctaatagtttctgagtctagtattttccccatatagctactcagttttttctagtatatatgtcaaataaaattttgaaaaaattaccccttcccacaatctttgcaaattaatcctcaaatgaaaaggatttaatttagctattccatgataaataaaaaatatgcaattttattgaataaacttaaagtaattaataaattcaatgtactgtcagaagttttctgttttgttttgtttttaaaaatgtccattaaaatgctacctatgtgggttaaaaagcctataatacaatttctaacttcaggaatatgtgacaacatgtagaaagggtatattgggctgtgcaatttaaattttcatcacctacaggttatggcataagactgatatgaaaatgaatgagaattaggttatatgtagagtcttttgtcttttgttctattactataaaatatttcatttaaaaagtagggaaaaaattactaaggtggtgaatttgcctgatataccaataagcacagttgttttggaagttgcttggtaccactgactttttgcttctttaaataagtatttctttccttagcaaacacttctctttatgagaataccattactctcaaaagattccaatgtttattttgtgcttatggcactttttaatttaaattttcaagaatgcactttgcattaagatgaaccaaagtagtattagtgaattcagcaaccagttcaaggcatagttttctgattttcctacttaagaaaatgaaggccaggcgtggtagctcacgcctgtaatcccagcactttgggaggccgaggtgtgtggatcacgagatcaagagatctagaccatcctggccaacatggtgaaaccccgcctctactaaaaatacaaaaattggctgggcgcagtggcctgcgcctctagtcccagctactcgggaggctgagacaggagaatggggtgaatctgggaggcggagcttgcagtgagccgagatcgcgccactgcactccagcctgggcaacagagagagactcaatctcaaaaagaaaagaaaaagaaaatgaatatattttaattttagaatttcagaacatgtccgtattaactcgaagaaagttatcatgaataatgctattttaatgaatgctgagggaattgtgcctaatattctaaaatactcttgagaattatgaagagtgtgcagtatggcaaaggcagccatgagaattcccaatatataaaatgtatactgtattcaaataattatttctcaaaagtataaattttcactctagatagttttctacagggtggcacatgctatgtggtagtaaatgagcctgtaaaactgaactcattagacaataactacttctattaaatacctaaaacacccttaatgtgaatgttttgaatttatttttatatgtgtagagtctataatttgttagtgactataaattaaattataacaacctttagcttttttaagtttcacaattgttctgtattccaattaagaggctcaaaatctagtctgggaaactccacttggcttacaaaaaaaaatcaatatgctttttatttcatggggctctgggattgttaagattagcatgaaatactgacatttacactcctgagtggactagaaggggagcaggatggaatgatgatggcaagtaattggacaattggacagtttccagaaaggctttaagaaatactattaaatctccatctgctgattgaaaattccaggttcataaggtataacaatagctgaaatacaagccttagatgatctctatctttcctttgcaggtttgtaccccacctactttgcaagaacctgtgacaattttttaattaaaacatctgcataattaaacattttaggctaatgatgacaagaagacaggccatattttattacttttgttgaactgcccagtgtatattacatttgctataaattaattactcaaaatcctgccttgaaaatatctgttataatttttaaaaaaagaaaataaggaaaagagaagaaatagattaaaaattaaattagggtcttacacttataatgagatggttctaaggaggtaagacttaacctaaataagttttcgttcctttgaattagtggaataaatacatcttaaatttctccattccattaggacagatcacaggtgaacttggtgagggagtaagcgaagaacagttagagttgcagggtcctaaatcaaccacagggagaataatatattactctgcttattttactcttcctctcctcttcacgtttatgtcttcttcagtatttccttctcagtttgagttttatatagcatatgacatacacatatgtgccaacacaatgtgagtgacaagactggaagaggaaaagcttacattaatttatcttgaaaaatgaaatgtccaattatacaacattatagagtgctaatagctcaccaaataacataaataagattatatttcactcagtgccagacctgacaaccaaacctaggttccaaagtaagcctttctttttatcaatagattgaatatactagaggttaagaaaattcacataaggccgaatctcctctttaaaaaatcctttggcatttttcataaaaacagctctttgcccgtggctcaatttaggactttcacaaatcccttgaataatgaaggtcttggttttacatgactgtttatgtgtggtattctatgaaaggtccaaaagcttgttaaggacaattgctaaaaaaattaaaatatatcaagattatttttgtcaaaccaatatgtgttagaaagttatctattgaagtgtattccatatacttaatataatattattataataaatggcaagataaaaagaaatccactacaggatattcccatttctctccagagtcatggtatcaacagataacacgccagtctccccaggataccactataatttaatacatgcaaagtatccatctaatttacctgttactgatgaggaaattccaaaagtaagcttctcatcatagcaaatcctgaagaactagcatttaagctatttcattatggggtgaaaaaaatcatcatttagaaataaaagtaccaattagtaacaaattatgtacaagtcactctagcacagtgtatttcaatcacttcagtaatttttagcctcccaaaaaaaagtgtcagaaatgaggcatgaaaagctattaaatgaatcattcacacgttgaatagatgttgtcgtcagtttgttctctcaatggaaataatgaacaactgatttatttataactggtcattatgataatacaccttcatgttccacccttttcaatatattatggatatgttataactgtcttattttatagctgatctaaaatcatatgcttccattaaaatttcttcttttccaggctttcccttaattttaatgttcctttggcttggggtgtaattaaaatgtttttactgacttggttcccttgtcttttttttccttccaattttctgtctttttgcctggtggaatttatccatatcttaagtgtatgtaactagagtctgaaatatgaattttaagtagctgcagaatacatttatgtaatcactataaagtggatcttgtcagcacttatttagtcaagtttaccttgttttccttctgagataaaggtaagcagaatggataaagtaagataatggaagctgatttgtatttcagagaaaaaaattcttggtcttaagagtcaaggcaagaagacttcattcgtttttcattctttttttttttctaaatttcagagcagagaggaacatttcccttgaatgttccagttctaacactgtaattaattttgcagggttacattcaacaatttgtatgttttgctgcataacactctgtatatgcactggactctgccctcaatctgcactgcaggtttatataggaaaaagccttcagggattttcttctacatttaatcaaaactctttttgagaaatacatccatcacattatggaatatcattttttaaaaaaaaacatgtgagtaatgtacttcagagctaggtctggaaaaaagattcccttgggaaatggttatgcttcatccccagtgagtactagaggcctgtaacacaacctgtcttctctatacctttgctcagaaacccagaactgggttacattcgctatcatggtgaccatgttaagactcccatggagtgtcccagctttctcctttgtaaatactttttatatactttttctaatcctgttttgttaatcctatatcatatgtcttttgtaatatgttctctgaaattatttagagagaagtaaaaggtagaaatgaggaaataaaccagagatactattctttaaaagaattttttttatttttactgaaatggtggcattatcttaactttaggatgctaatttttttcttcctaacatcatgcccacgtaccattatctcatccctgactcatcttttaaaattttagttcctttatttgcaatttacatataagatgtgtggaaaaacccacagatacacactcacacagcacgccactcttctcatatgctgttgttcagacataaagatcactaagcaaaataggagataacatttcaagactttctccactaacagaaacatattctcaggtgatcggttagagtccaacaaggtttattttcaaaagagtcagcaagcgttagaaatgaatttctcaacaatttttgtttttaagagacagggccttattctgccacccaggctgcagtacagtggtatgataatagcttactaggctgggattggaggggcagacaggcagctcagaaaaagagatttaggctatcagagaaggtggaagaataaatgtttggatataattatcatggcttattatctacaaggtggaatttggctaactttgttaataaaacaaggtacaaatcatttaatgacaacctatagacttttagcttacatttagaaaatacttaaaaagaatttttccagcctgagcaacatagtgagatccccatttctacaaaaagttttttaaaaaattagctgggcatggtggtgcacacctgtagtcccagctactcaggaggctggggtgagaggatcactggagcccaggagtttgaggcttcagtgagctatgatcacaccaccgcacttcagtctgggtgacagggggagaactcaaaaaaaaaaattcaaaacagatattagatgcaagaaaagaaaaaaaattaatgtatatcaaaatattaaattctgttcccaattattatataattcctatatcaccaactttctttgaaaattaaagactgaatttgtaccaatgtactaattatatatctataattggtatatttaataagttaaaattttggaatataaggcctctacatttacattttaaaaatattcttagacaaggttctggattatatttcaattctgttcaaagagtaaaatggaaatgtaaaaacagagatgtctccttaacagagtgaaattaatttacaaatctaagcaatataaaaacatgagtaaaaatctaatttaattgaattattaatattaaagctagtccacacaaaatgtatttattctggagtctctgtagattttttttattgtttttcctgctgccatcaacttttgttatactataaatatggatgtaactgtacctacataactaccagcacacacctaaaattaaataagaaattttaatccagtagttcttaatttcttttctaatcctaagtacttaaagatataacacactattaataaatcaccatagtgatggttcttaaaggtgtgtgtgtgtgtgtgtgtgtgtgtgtgtgtgtgtagcatgtggggaaggtgtcctggagaggatacaaccttctgtgattttcctctgctaagaatcagccctgaagggtacaattcaattacctctttttttaaaaaaatctcagatcttggcttgggtctgaagcatgaatcatgtggagtttaatgcagctttgggtcaaccctgatcaagaagaccccaggaagagtgtgggaaaatttaaatttggataccccagaaatgggattatgtatctaagaatcctatatagcatgtcttgtcgtatgccatttgtgtcagctcagaacttccacagttctttcacaagctcagatcatatctcttggagccactttggtccctacacaccacagattccatctctgggctaatatttgactaacttcaagattatgtcaacactgtctatgcctcatgcaaaagcctcatggaagcaattaatctaacaacagtgcaaacaagacgactataatcacccaggtgatcatgaaaaagaacatgagggaaataaaaatgagatagacagattctggaagcatgctgtagatattatgtttttcagtaacagatttggggactgttgtggggttgggggaggggcgagggataccattaggagatatacctaatgctaaatgatgagttaatgggtgcagcacaccagcatggcacatgtatacatatgtaactaacctgcacagtgtgcacatgtaccctaaaacttaaagtataataataataaaaaaataaaataaaataaaataaaattgatgaacatgggtgctacatgatacaagtatcaaaggaatttcagacttgagtaattctgaagcccacaaaattagccacaggatttatcttttgttcttcatctactagaggaatggatgttacaaaccaatacaatgaaattaaaaataaaaataaaaataaataaacagatttacaccaaaacttttaaagaaatttgtgataggaaatggttaagagggtggggagagagggcaaaagttgggtcttcagatcctacaagcagaaaggggctctcttttaggtcagagctgatctttagttgttttgtaatgacatttcatctgacacttcctaggccaaatatttaaatagacacctctaaagaagtttagcaatttgatcctctctgcttgctcatttatattatttctttaagttacatttatgctcagtattcctatgcttcataggtatttgacaaaaaaatttaaagagttattttttctttctttgtttttttctttttctctagcttgctaaagaacaatcagccagatccaactagatgagtcaactattccccaggcataactcctggggtcatatcaattgcatttgcagcagtggtataataatttactataaatgtcttaaattacagcatttgaacacgtgccaggaaataatacttttccccaaagcagatgaatcatgaacctgaaatacataatgcacctcaaaggcatttaaaattcttctaaggagtgacttattcagatgatagaatgttgaccatttgatttgagtggtgaccttccaaaagcaatgaatagcatttcaatgattttcaaatgttattatcaaaaataaagtacgatagatatataaaataggtaaatatagaagcttctctagtaatgcctcccttgggaggtagggagcctgggaaccaacttcaataagaatcttggcttctctgcccttagtttttgtagaagggcccttctcatatgtagaattttgcctctccaaaatagctcagatatctgtgagggagtttggttgaatttgagagtctgagagcaagtgatattagataaagtttatataaaggctacagtcaacatcacagaacaactcagtttatttagaacagccagttgaaataaatctaaggatcgtagcacctaaccatctggaagtcagttttgaaaatatatatatatatatatatataatatataaaatatgctttatgattttgtttatgtgatttaagtagatctatgagataagtaaaataaaaattaaaaattctatagctttactttatatgtgtataaacacacatgtatatgcatatatattgttgagtctactaaacagtgtgcttctagatttattcatgcattcaataatatttattgagaacttactatcttcaagacactattagagatttaaaaaataaattagatatagctgatggtgtaaaagaggcttaaatgtgattcatctcaaaatcatcagaataaataagacagaaaattttaattactggtagtaagaaacaaagatgatgaaaacctaagccaggctgccatgaattgaacaacagagaaaaacagccctgggtctgatcagtttgaccttcagcaatgtcagctcacttctttgggattctgcttctttatctgaaaaataagggaaatttaaccatgtgatcttcagagtcccttctggctccaatatttaaaaaaaaaaacaactatactccataagtatgatttaaaccagaaggttcaaacctcattcttcacttgcgatagcttcgctgatgaataggaatgtcagccaacattccatctcctttccctttcctgttccagtttgatggaggtaccagctagcaataaaatagcattgaggagttgggactcacaaaaagaattgtatccaaaaccacaatactgtgactatggaattattgtttctttaccctaacatattaaaaatagctgatgaagaaaaacaatgaaaagaagactgtaaacaagtcgaatttcagaaaatacctgggagacaagtgtataaatattgtttgaaatttttttaaaaaatgaacattcaagtatttcattcagaattttttaaatgtgcaaattcaattataaagccatggtgatcacaagatacaaggtaaagttttattattaatttgaaatgtcttggtttgaaaaaagtttgatagtaaaatcaaggttaaatgaaatatcatgaagctgtgcaattaggttaataatgaggtgcctcagggatcagtgctagcacaggtgttcagtatatttattaatgacttagaagagttctgaataatatggaagcacatttggatgacttcatagatatttatagcaatcaaacgggtaaatgactgcttttcatgaccgattcaagagcaattatttaacacattacagcaaataatcaacaagagcaaattaatgtgaagtgggtggaattacccaagttttcttagcatgctaatagctaactgaaatagttattgcctttcagacaacagtgggcgcatctaagacatctgtccagtaaacagcactttaggaaaaaagcataatcaataaaggttggaataaagaataatgcaaaagaattatctaaatcaataattattgctgaaaatttctacacaccagagacttgctctactgaatggcactgttggaaaagagtgtggtttcccaaaccacatgctaggattatctggtgtcttagctggtgattttctaagtagttttccattatcatccattcctctccgatatccattcactggcattcccagatgcctctcaggcaggaataaaacttacaaggacatgcccttctcacttctgctttgctctgttctaaaggatttcattgatattaacttttatgttgaagatctcaaagctttggaaaaattaaaagtcatcccttttcacaagaaagatggcataacactattcaataatagcatgaactctattatatcctccccttatcccaaagttaattattgtgcatagaaagaaaacttaaatgtagcatcatttcagttataattcattcattccaaaatattttctgagtgcctattttatctaaagcacagtagtaatagaataaaaatgatattaataaaaatatttggagcctgccctaaaaacttagaaagccatgtctcccctctcatgaactaagcatttctcaatcctagtccatataaactacacataaatgtcatcaattatatcataatttgaaatatatgaaaattaataagaatcagaactgtttatgtagaaatatataataacatttttaaccaaagcatcattttccgctgccatttatcttttgtaccagagaaaatattatgaaccctgaggtaaattttctcatatgaaatataacttagatacttccccaaattttagagaaaaatacaatttctggactgtttgggactaagaaagtaggccaatataactggagtaaagccaaatactaatgaaaacatcaatgtgtgttcatattagctctacaaaataaccaaccagcaaatccactgacagaatgaagatatgtgtgaagtactgagagtgagaatttttctttttctttttttggaagatttggtaaagcatctctattctctatttatgtccacctgcaaatttcagatgtaaacatctagagtaatataccatgatcacataagaattcacagactttcagaatctcagtgttaaaaggaaactcagacgttaaccattgtttgagctatacatcttctctacatcactggacatactactaccggagataaaaaaaacatacacacaaaaactcattaattaaagccaaagacttgcagcgaaaagcaaattttcagcaattaagtaaacaatgaacctctgttagaacctcaaacatacttactaatgagatttaccagagggtctggaattatctatttaaaatataaaattacaacttggagaacaattcacttatcagaggtgtgacaattctgttaatttttctttctaaatcttttagtatctatgggtttttgtgcagtgtgatttaaatataattttagtaagggaaaacaagtagtgaatgagaattcattaacaggtggtcaaatgcaaagagtctatcaatcatgctggtatttttaaacatcagcaaatttaattccatctctgggggagtaaactcattctctaaggtatgtgacacatcgtatttatttttaaaggacatttcagagtgttccttgattatgaaatactgcaagtatttcctgccttaggtttcctaggcagacaaaaaggcaggcagaatccaccactgcaaatcagataattctaaaataaccaaatagtgtttctaaaaatgagaacatttccatatcttagctctagataaagagatttgtcatggtaaaaccaacaaatctgaatcagaccttaaactatgaaatagcacacaagagggatgcagaattttgtgctgaattacaaagagaagtcagatctgcaaatccacaatgacataataattaaataaatttaatcagcttttactgaattccagtttttaaatgtcaggcaattattatgaaatgactttttctacttgcataatccattgtgtattatatttctaccctgaatcaagtgaatgacttgttagtttgatcaaaaattatcactttatactacgagggaaagcaaccatcttatccaaactacatggcattagactgtataagcttcctttggtgaagcaagatatatatattgattttatcatacacatagactcttcaaggtcaaatagcaagttgaagggagaagaagtatcctgaatgaccattaatgctcttctataccatggcttcaaaatcttaaaatactttgcatttcacaagaagttatgtggcatttgaaaaccctctgaaatgaaaagaaatttctgatccccaaatggagtagtcaagaaaattgagcactttccagaaaataaaagactcaatatttcagggcaccctcctgcatgacaaggagagttacaaaagagaaaagccaacaaaaacatctcacctactgtatatatcttgtttattgcccattttcttgatgaatattataggaacatacagactgataagattcccttaccgtacaaagaaaagttatcctgttttgtaatgcgtaagtctttcctaaacacagagactgaattttggttgttattctactacgtggagaaagaactgatgttggtgaaggtgagttgcaatattgtaccattaacgtataaataaagcatgcccattgctggtagttatcccttcccaggtttcaaataggaactgggattttaaatatttcagaaataatttcttctaagtctctattgtcattgtatctctttcaattttaccacaccaatgatattcactgagcaagattccaaaacctttataaaagcattcccttgaataacaccttaaatcttactctgttctaaatttttaaactaataatagtttatctgaactctcccaactggtcaattctgtcataaagctacataaaaaccatcttccgtattgcagattatttttgaccaatcgatggatgaaattttggctattcttgttaacagtgtctcagtgtaagcattgttgtagttatcagctttgtaagaagtttatggaaatgacagaagctttggacatgtactcactgatagacaccagaataaatcatgaacaaaaccaatttgatagagaatcaagggagtcaaactgtaaatggtaatggcagattacccagtgcatgggtgagacaatggcatccaaagagatggttagcctctatatacctcctccatagaccatgtaatctgaaactcctagccgttagattcattcctctaagataatggctgcaagataaactactttagttgaaagtatcatgtttggaacacactattgagtagtataggataactttcagtgccccgcagtgctggccacagtacacgtaagttccaaaaaatcattcacaacctcaagtgttcagagggtcaagcaagtactgggcatgaaaaaataaacaggcaagtgctaatgtcaattgaccagcagcctcaatgtctgcaaaacaatagagagcagtgtaaactgaggtaagcccttgtcccatctaaaagggacaactaccactgatctccagagaactgttgccaaacagggatataggtccatatcttccaggttttctagagaggtaaaaaatctgaattttttatgtgaaatctctaattttcaaatgttagaaactaatttaattgtgtagcacgctcttagccaacattattctgagcaaaaaaaaaaaaaaaaaaaaaaaaaaagctgagggccagatttggccaacttgttggcaatttcctagaatgccagtcaaggacgtgaagaagggagattcagttgggatgaggatgagttctagactgtcaattaagagaccaggtaagggctatagatagcgtctttcctaagggaaaggataagcaagcagactctacatatgaaaacctaaatgcagtaagccacttgttatgaatagtacattttaagaaaatgtacattattcatttttttaaaaaaaggtctttttaattattttattttctaactttgtctttaccctttgtccaaaaaaagatttacaataacataacaaagtcttcaatagaataaaagtaaaaataaattatgaaagacctagaagaaatgatgttagtaatagtaacctaaagtacaccaaatgcacgctgaatacagtcaaaagaacaaaaatctcattagccattaatttataaaatggattattatctgcatggggcgggggaagatgtgtccatttgcaaagtctattttcttttttaaaacatacaatttggtctgtggtgtggatgaatctatcttgttcataactaatacagtaacaaatgctgcatatcaaaacaaaggagcattattacttattttgactctctagattatttgtttccagatttaaaaagcattaagggatgtctttgtgagccaaaatagagggcagaacagatcccttcctacttaggattttaatactcccttgcctgaaagggaaagatttttcaataataagaaaaggcaatgtgagttacaggagcatcggtctgatgaggccatatacaggatatcttaccatcaatattcctacctaatgtgtcagaattgtacagctcttttttaaaaagccacattaataaaaataagcacttctaccaagacaaattgattgttgtttgttgttactctaaaggaaaggaaaaaaatagggctgcagcagtatcagcaggtaggtattagtgtattctagtctaatttcaaccccaaatccatactattaaatacaatttggaaaggctcagctgttagaggatcagagtatgtgcagcccatatgtaatgaagaaacactcctgtaaatcagtgaatgagcaccatgcattctgatgaaccaagtatagaggctgaaattttaagtaggcaaaaagctttctctccttacccagcattcctgaataaaactgataagctacagccctagagaccaggtctctgcatttaatttgtttaacaaatatttattgagtatctgcttgatgtatgctagtcctggaaaaaaattattccaatgaacggccagttaattcatgccaactaaatagtatctattctatgtgcatagctacaaaaatagcagagtcaattcaccactgcagcataatacaattacaataacagctctagtttattaacaccattatttaattttattttgtcttataacaaaaaactttttactttaaatcattaacagccacaacaaaatgctgccagatatctgaacacattttctttaacccatctacactactaaacctaaaattgtacacaataaaattccaccttgaagtaacaaccttggagcattgcaaaatgttcaattataaaagataaagtaaattttcatagaatggtgtacttactgagaaagaaaagcatcacacatacatcaaaaagatcttcaatgtcaaagaaagaaatcaaaaattttggtccttgtaatcttgaattaatcagataatgtaatgcattagaatgctttcttctttctactccagtatttcaaccaagtaggttatactgtttccaatactacaaatatgctatcttaagggtactaaacacagccctgaggacaaggagagaaaaactagaatctagcatcaaatcttctgtcaattacacatatacacatacacacacgtgtggacataaagtgtaaacttcagactagcctcacctgaaaattagttagaaatccaaattctgaggccccagcccaggaactctaagggtggggcccagaaatctgtgtttctacataaaggggattctgatgcatgctgaaaatagaaaatcattgctccaaaaataagaaatgatactataaaatgttcagacctctcaattccaaaattgacataatgtttcaaattttaaaaatatgaaatgctactcaagctcatagctgttacttatacttaattatgattaatgggagccagtcttctcgcttcctctagttctctctctcctcctgcgtgtaggggtgtgttagcggtgtgtgtgtgtgtgtgtgtgtgtgtgtgtgtgtgtgtgtggtctataaatgactgtggaaggttctatgtaaacactctttactcccaatcataaacaaatctatatggaaaatattacaaaaaatcaatttctagattacatttgtcacatggagaataaccaatttctagtcacttgtcatgggtgcataacctattaccagaactgattcacggtgaattgactagctatgtcaaaaggaagatctgcagtctacagagaaataatccatttagtgttcgaaattttacagtaaaggctgccaaaataacagaatttattacatatttttacaggtatattaagctataataaattcgtcattcctaaatcaagataattcatttatagcctattcaaaacttacttaaattaatcatgaaacattaaatgcaaaatgtttttttcttcacataatgtcacaaagtgacatgaactaatttgccaacatgttttcacagtattgttattctgacatatactaacatactaaccaaagattatcaccaataatgttggcattcatggctaaaggggcagtaataattttatatctacaaggactgaattaggcctctcagacaggaggcttgggaaaaatcatttttcaagttaagccaggtgagtctgtaatcaatgaccagagctctgctggaactgcagtgcctcgaaggaatcaagttaagttatgagctacagaagaaaatattgattcttgcttttacctgtttgtttcacaaactagaatagaaataaatattactaattttatgttgtaaatatttaatacgttttttcaatagtcactatagaatatgtaaggaaaccaaaacaaccacagttgaaagtcctatgacattagcaaagctcaggaacttggcattttcccagtgatgatgaataaaattaaaatactgatttcagtgacctgagtgtgactgtcatttgtctaaaatatacttattataatgtagtaagaatgcgcccgggaaaatacgttattcccccaaatctcattttttaaaaaattcattttataaaaaaatgaatcattagcaattgatgttctttccaaatattttagtgcccctaaagcctaaaagtgtatcctagaataaatttataccattcctcaaacttacatctatgaatattaaacatttattgcttgactataaaacttttctccagactatgtcagtatctccacttataaaaaattagggaaagattaaccaaatagaactgaagagaatagaatctacagtggggttgtaccgtaaacgcatataacttacacaacttcaattatgtaagttgagaagaaagcaataatgccaaagattggtctgccaatttgtatggcctggacagagtgtgaaatgggaagtgttaatccaccatgccctcataagcacaagtagccctgttgagggtgattatgatatttaaaggtatgtcttgtcatatatcacaacccttgaaaaaaagtcaagtatttctgatgctcaactagaaaaaactggctattgaacttactgagacatagtatattgatccccaatatgccctttttaagagtactttatgcttggtttttcacgttctgttaattctggaatctaacctctgaatacagtgcaatgttttcctgtggatcaatcatatcatgaaatgcctttcacagcaaagaaaaacaaaagtgtctttcagcataaaagacattgtggaaaagagaagaaatactaattttattatgtatctttcatgagaggtttcaggacagcttaaaatagtaaggaatctctgacatagcttcagaatgatagacaaacaagacagataaaattatttataagaatacaaaattaggccaggcgtggtggctcacgcctgtaatcccagcactttgggaggccaaggtgggtggatcatgaggtaaggagttcaagaccagcctggccaacatggtgaaaccctgtctctactaaaaatacaaaagtcagctgggcgtggcggcgcgtgcctgtaatcccagctactcgggagactgaggcgggagaatcgcttgatcccgggaggcggagccaagattgtgccattgcacttggcttgcagcgagccaagattgtgccattgcactccagcctgggcaacagagcgacagagcaagactctgtctcaagaaaaagaaaaagaatacaaaattataattgttactcagattccatctcaaagaaaatcttcatgccagcactttcttcaatatatctcagccacaaggcaaatatatgctgactaaactctactttcaaagtgtggttaagagataggtggtggttgagaaacctcctaaaaagatccatatacattggggtgaattcatctttgtccaaaaatgtaaccgttgtaccaaatgtaacctaatgtaacaatgagacactctgagccttgctggatggtttaactagacaggtgttctgggaagccacataatgacaaccaagtaaatgaggaaccaaactatgcactgtttgggagttttcagattttgtttttgtttttttcttctgttagggagcagaaccctctctaacagaattcttcactgaattccatcaaaccttttaatacagctacagcatatattttctgcctgacaactcaagtgagtaaacactaaacactcatttctatgtatttctttatttcctcatgaagaaataattattttcccgctttattttgatgtattttgtacatttgtatttagattttaacccatgtaaataaacatttatgatacaaccccactgtagattctatcctatctagttctatttggttactctttccctaattttttataagtggagagatactgacatagtctggagaattattgacttattatacacttcatttttaaagctaatgaaaacaataataattcagtacataaataataaaaggagttccaaagtttgtgcttcataggagaaagaccattctcaagccctactaatcaccttcacttacataaaatgaacatcatcattccaggatttaagctacatgtcccaagtcttctttccttctctagcactgacctcgcattaagatgattgagagtggaatatccattctttccaggaaaagatgaccctataatcagagatgtggtttgatcttctgcaatgccagcaaaacaatcagacttcatatcactccccaacatctgagtcataacattgagaatataacaaaaataacattgtgtgggaagtaccgagattcctgtctaggtacatctgtaccaggtacagtcaagctccttttcagtctctccttaggacctaatctcaccctcactcattttttacattatatctgtaacaagtaataaacatttcttctacactctgacttagagttattattcaaacttggtaggaaagaacttgagattgtgatcagagactttataattctgtgtgtgtgtctgtgtgtgtgtgtgcatgtgcgtgcacatgtacatgcatgtgtatcaaaaagagcttgggtttaatcgttcacattaattaccccacatctttactacccatgtttttcctcacatgtcctcaacttagcaaatgacactaaccaatagctcaaggtcaaaactctggagtcattcttgactcctcctcttcatcatctcctatatctaattaatgttcaagttttataaaattcacatttaaccttgtgatggttaattttatgtgtcaacttgactggccatagggtgcccagatactcagtcaaatattattctgggtgtttctgtgaagacattttagataagattaacatttaaagttatagactgagtaaagcagactcagtttataattttaaatgttaatcttatctaaaaaagattattccaaaaggatgtatggtttttctaaaatcagtccttcatagaaagcccaattctatttctacttttaaaagtaatttatttaatttctacatctctcaactgggaaacaataattccaaaataatctgatccttttttttttaaagaataaccatgaaatattcttccccaggttaacaaaactagtagcccacctgcaatattctcgatcacaagcactttgcaggctgcactatacagagctacttgggtagaaatattttccttttgttcctttaacagctttacccctttgacaagattttaaaacaatcaagtttaatttttccaatttcttcctcagtattactttggcaaaggtttgggcattaagtgaggtagaaatcaataattctccaagtaatgcttgccccagaaggtgtccacatgaaaataaataggtgtcctgagcataaaatattttttataaatacctatttgagggaaacaaaaatcttaatgcctcaagtatttaagactttttaaaaagtaaaagaaaaaaatacaattcctcatttaatggtggaataactacatctagtaagatttttttccttttccttctaaacatagaaaattaatacaagttgaaactaggctaatcatgaaaaagtgtaaattaaaaatgtacattaatttaaaaattcttctgaccacatgaattataaaagactgcaaatataagggaggaaaaaagaactgtgaaaattagactgctcactcatttgaaaccctttgataaaaagcactctatcttcttcggactgccacccctgtgagggaagggactgtgacattttgtattaatctctacatagcacttgcctctgtactatgcctgtgacagtatttcataataaaaaattttcagattttttcagtggaaccatgttcattaaataagaaactaacaagatgtgtttgtcatcccaattgccttggaacattaaccatttcatttcaaatgttaccactttgcttgctaaatttacttattcctctaagtttaaaagtatctcaaatcctgaaatgactttataatttagctgttaattttctctagccacttgcttttaagttaacaacaattctgacactatagcttattaaccacaaacagttatgaattaaatcaagtataatgtgcaattaaaactcagatgcagagtcaaataggatttccccacgtctacataagaagctttgaaatgcatacaataatgacacatgaatcattactattatagagatgagaaaaatgttgaatactaggattttacaatcaaacgagcacttgttatttactagatagtaaatttcaccatttacgtttctttacttccttatgccctgtatgaaaacacaatagaaacgaaagtgctaagtgaagtctttcagtattttaagaagtagaaaaccttggttgagacctcactccattcaaacatttagcaaacatccactgatcacaatctgtagtcaatcactgtgctactgaaatatgtggccaccatgattgtgacagttaaggaaccatctgtaaagaatgattcttgcctggtatttctcacttattctgaaaaataaatcttgactagaagagagttatctaggatccatatagaagcatacttagatattttctgatatataaaatgaaaaagagaatgtcttgcaaagaacagaaattaaaagcacatgaaggacactgtctttgaaatctaccccccttccaacatcatgcttgttcaagcacccatcaccattcctttaaagaaaccctcctttaaagaaacctcaggagggttcctgcctcagtgttgctcctctatgaacctccttccactactaagagtgccatctttctaaaacctgaccagaacatcacggtgccttaagccctcagtgtctctttcccatcaactagatgaaatccagtctccttggtttgtatgatgaggctctttgtgatctagatccacttatagggcaggcagggagaagccaccctctatgagggaggtgaggaaagagtaacccataacttttgctatctcaaaaggttgctgaccctaacaccatttaggcaaagctggtcaatggggagatattggatagactcacattagaagtcactctgagaaattactaagactccagatcataattcccaaaatttaaaattagataaaccttctgaaatggacctgtgacagataagagtgtaaatctgaagaaatatactcaatacaagggcctaacgatttgttgaagagatcttttcaatacattgtgtagcttatgttggaagcctttctaaattaatacattttagcatagttatgttgagcatggaaatgggaactagaacggtttataatcctgtgatctgagcttggagcatcaatgggtcctggcctggaacctgtcccacagcagaagatgaggacctggtagacgatatccaacacagcactacatacaaatggaagcactgacagtaatacagacattggataccctttcttcctctgcttgaattgcattaacttctggcattttggacaggcatcaagaaggtaagtcattcaagaaggtgaggaaatgaatcaaggatggcacaaagataaatatagggcatgcagagtctagagtaattgattcaaaaaattaaagaaacttggctccattttttaccttatcctgcttatacttgcaatacctctgggcattatttttcactcttcttcccttcctactttacgcttaccaactcagaactcagaatacactatgctctcccatgtctcctcgttatgctctttcctttgcctagaatgctctaggaagccttttctgagccaagagggttgggttaggtacctttctttggtgtttccattgtattctgaggatgtgtttatatgatacaatttattcaagcagcttatcctctatatgcctctatttcacttgtaaaatggagacaataatagcatatactccataggattgttttggttatcaagcaaggtaatatatgtgaaaccatttaaacaatatctggcacaaataaacaactatataagtaatagctattgtgttattattattattaaaacacattatgcttttatcaggtactatgtggcagtcattatgccgggtgttggtagaccattggtgaacaaaggaggcttggttcccactgcagtgatgctatataaaattactcattcttcagtatgtgtctccatgcctcccagtgtcagagatcaatctttgtcattttttgtgtgttatcagcacctagaagaggatttatcacagagctgggcatataagaggtgctcaaaaattatttaaaaataaccccagaaagtcctgagcagaggaaaaaaacatgtggcttgtagacatgcaacagcattaaactcactgaaattatgtgtggctgggacccaggttaaatgagaataagtgaaagaaaatgcagctgaagagaaggaagcctagatcacagtgggcctaatactatgagaaagagtttaacttagaatgggaattcagaaagcattttaagtaaggagtatcatactcatatttccattacagaaagaatggaaactgtgaaggccaatgattggaagaaactgagactagaggtagaaaataggatggtatttgcagtattctgcataagatgtgatgaaaatgtgatctaagatagcatcagtgtgaatagacagacaaggatagagcaaaattaagacaataggtctgataggccaataggatacagcatttgaagaaaagacagaaatctaatatgactcttatgtttctagcttgggtgctaaatacattgcaaagcattaagtgagatgataatatgagaataaggttaggattgatgcgacaaaatggagatcaactgctgaattttaggcatatggaggcatctatgagattaagtagaaatctaagagtcggtaggttatatgcacttaggtatcaagaaagaaaatggaaagtggtctttgctggacaactataaaacctggtgtaaattaagagatcgtgtttccagggagatgaaagagaaagttaatcatggattaaaaagtatatgtagatgtacaagaaatcgaggagatgtacaagaattgacgatcctttctagtaatattttagtcaagattatcaactcaaagtaaatgagagggatatgggttacgaattgaggtggttagtgaaggtttgagagaaatggaaaagaaggttatcaaggacacataaaatatattaggcaaggaaccaacctaagtgtccatcaacagacgaatggataaaaaaaatgtcgtatatatacacaatggaatattattcagccataaaggaaaatcatgtcattcacagtaacatgtatggaacttgaggtcattatgttaagtgaaataagccaggcacagaaagacaaatgccacacgttcccactcatatgtgagagctaaaaaacttgatctcagggacatagaaaaaaggaccatagataccagagactgggacgggtgagtgggggtgagggggtatgaagagaggttggttgtgggcacacacatacagttagatagaaaaaatatgttctaatatttgatagcagactacagtgactatacttaacaacaatattatgtatattttaaagtaactagaagagaggacttgaaatgataccaacacataaaaatgataaacactcaggtgatggagacctcaaataccctaacttgatcatgacacattttatgaatgtagcaaaaactcatatgtactccgtaaataggtgaaacattgtatgtcaataaaagagaaaaaattaaaaagcaaggaaaggatatatatatgcttgatacctaaatgcatagtgttctatagccttagctagagcatattgcctgatatatatatatatatatttatacacacacacacacaatggtagatacatacatacatacatatatatatatacacacacacacacacacacacacaatggtagatatatatatagcaacaatagtagagaaacacagaaggtaaatggttggactgatttaaagctgaagctttacaaagtcgtggtgaagaaatacaaaggagcaaaggaatggagggagctgcatgcctagggagcatccattgctgagaattatgccacatagagaaaaaatgtagttagaagaagggattaacaggcttaagggaaaaaaatgaaagaatcaggagattaaaactctaattaatttgaagagtaaatgcagcagatcaactcaaagaataagaaggtacgtcttggagtttaagatttcagagactgaaaattctaatacatggaaaagacctaacatgtaaccatatgaaggagagctgaaacttgcatttttgagcatctgtaggcattgtgcttggcattttacatatgccatctcatttgataatgattttctttatttagagagacaaggtcttgctatattgcccagaccggtctcaaactactggactcaagtgatactcttgcctcaaccttctgagttgctgagattacaggtgtgagccactacactcagcttgattcattatttttatagatgaaaagactaagtatgagtcaagttacatgatttgcccaatgttacacagttagtcagtagccgaactgggatataaactctagcctgtgtaattccaaagcatatactctttctagaataacacaccaactgctcaatgtgagaaggttgtcagggaaaaatggagcaaagattacttgaagtaagtaaattaaagaattctgagactagatggtggatggggtgattcaggtagacacagaagtcattcacctgacagctaaacttgaatggaacaatctattagttaattccataatcattgaaaaatgtagagaagtgataacgagactgataaatggagtatcccatgatgagctctgctacaggttggcaccatgatgggtgaagaacacaaaaaaaggaatgtatattactgcagcatatcatgaatgaatttcctaataaaataatacgatggatgctagagattttatggggccactctcacaaaccctctcattaaaagccaagttctgggaaactggagctggtggattcctcaattcctgcttgttacattgaccctgaactttgagcacccatcaagagagcaaggagactggaaatctgcatccattcagttttattaagcttgtatcctagatatctgcatccattcagttttatctagcttggatcctagcttgcactctttgtttgctagtttagtgataggacaaattaaaagcaactttaaactaaggctgagtcatcatcctacagtcttctaacctctaataactgctgaggagtggttagttcaggatatgggatatccagaagttatgagttccaaagaaggagggatttttatatgacagagaggagtcactctgtagacacagaagtaaaaggcaaggtgagtgattgcccactaccaccgctgagacccatgattcctagaaggtgggaacataggcagacaccattccatatggtggcaggatagagctatcttttaattaatagaaaaaagatagaggggtaatgttccttaaggtgttctggtttgttttcaagttgatatggttctggagaattatgggaagggttgggagatgaaaaacaaagggaggaaatatctagagatacagagaatgaaatagtataatgataagttcattaatgaatatgggtgactcctggagcttgtattttgttaggttgacacagatggcagggaataaaagaatggtggtactaatttcatgtgtttccttgtatctctgacataacaaaaatatagtctttcagctgagcataatccccgcttcacaatgagagtaaatcttttgtgtcacaacagacctgaccagatatatgcagtaacaacaatggacatacaggtaagtcacaatggctcatgcctgcaatcccagtactttgggagaccaaggttgaaaggattgtttcaaggccagcctgggcaaaacagtgagacctcatctctactaaaaaattaaaataaaataaaataattaaaggggtatggtggtacatgcctgtagtcccagctactcaggaggctgaggcaggaggattacttgagcccaggaattcaaggttgcagtgaactatgattgcaccactgcactccagcctggatgacagagtgagatcatgtgtcaaaaaaacaaaaacaaaaaaaccaatggatgtacatgttttggaagggtaagatgatcatatatgccctccacataccaacaccaaaagcattgatttaaatctcacactagtctcaatctcacaaatatctcagttttccttataaataataaaaaaattaactcattcaaatttcttttgacccaattatatgtttctactttactatgtatttgcataacaagtttcaagaaccacttaagaagcaaagcagtttatctttcttcttgaatcatgaatgcctcttttaaagttcacataatggttatagaatattctagtattcataaacaagatttggagaacaaggtcattttaacttttcctttattttttatttagccttcaatcatattcctttgaagcttttaacttttatgctaaacaacactgctgttctgatttgagagggtattttttgtttggttatctgttcatctgggtttttttgtttggttggtttttttaccagtcattacatattccattatcccttatattttctatttttagggtaatttctattttccttataccactattatataattatattctctcatatggtataaagatttatgtgtgtgcttccaaagctataaatcctaaaaagcagagagtgttgctgctacctttatttattccgctttcaggaaataaacaatagttacactatatttttaattaaatttctatgtaattagaatttttagaaagttaatttctccttagaaagtaaatttccaaaggagaagcaggtaaacgatagtgcacacaagagaaaataaaagaatgattgcaatattctaattacaagaacactagaaaaagagaaagagagaaggagagagagagagacacagagagagaagtttgcattttctatctcccaccagcttctggccatattttcaactagtattcctacattaaacaaaatcaaggaaaaatactctagaaaagtctttcaatttgaaggtaacataagcttcctccaactatactgaacttcctcaaaaaagaaacttgaatctatgaacccagcacaagaaatcttgccagggtgagaatatagaaagaaatcatcctagcagggggaaggaagagtaaaagccaaattgccttaagtatttggatgtaaataccaaaattacagggacaacatctctcattcagagaagaaagaagagaagatgatgagtattagttcatttttagttgagagagtagggggcatataaaaaggaccaggcaagaagtgactccaacctaaactccaacatcagagtagaaacagtcttcccaccatttcgtacttgctcctctgggtagctgtggctgaagatcaagggttggatgaggagaggcaggaggacagacccgaaacattcagaaagacagatgcccaggtcaacaggcctacagcagtaacagtaagtgttgcatgaatggcatttggcagagatgatcgctctgagggttaccacaagtctacagatagatggaaaagtatgttagctattgtaataaaagtttatatattgtttatatattgtttttgtcataagaaaatgattttgttgcattttctgtattaaaaaaatatcaaacatcttggattgctcttacacagttccgcaaatagattgagcctatcatgttttaattttgttaattttagtaatcttaactattaacctttacacttggaagcatgatttgtcatctaacaaagtgttttcctatagttactcaatttcatatcagaggcacaagataaggttgagaaattctgctcctatatatgcaagtcagaaaaagttttagttttgtaacaaatcatagcacaaaacccatttgaccctagccacctcaaaattgtctcattctcacaaccaattttgaagacacacatacatcttttctctccacataatgttcctttgtcatagccactgaatagcatgaactaacagcggtcctgaaattgtgtaggcttggtaaagccacctgcagaggaataaatatgtttaattaaatccttttaaaaaaagagtttaaacagtattattccatcttccaccctagccctgccaatgtagtgattatatgtctattaaaaaggagggcttgtatgagttatcatgacatgcatcactagattgtagataatagaatttagtatgtaatttattttatatatttatttaaatatataataaaatataatcccagaatacaaggtcctaaggttcaagcttatgcacaaaattgtgtcctttcttgggatatgccatcctccaggcatggacatttgcttacaaaataaatattgtatattataacaggaagagacttcaaaattcatgattgtttattttttccctttcagatgcacctccaagaagaaacattagatttatatatgtatgggtgtgagtgtgtgtgtgtgaaatctggaatggaagtaaaactgttaaaatccatgagaagtcttgaattaatgaagattcagaattaggaaacacagtacacatgtcccataaacaaagaagccagcagtggaccccttcaggtagtcatcaaagaacaacataagtggatatcagaaataaactttcccaggatttaacaaaaataacatttctcatttataaatcatactgttcagtagatcataatctgtagcaaactaaataagtagatccctgtcctctgaaacagaattgaaactgctgcctgagcatctaacttatctatactgctctatcaaatatttcttaatcagttttagcatttgtttattttctctcttctgaaacaatggctaataagtgcccagcactgtccctgacacaactcacatacgtgctcattaaaataaagctatttaaagtagacattgtcttgtcgtacagcactcctcttctaaaaattattcctttcaaccagagggttcaaatggcagctgccagcttctcagatgatttgcccataaatgagcacccaacccaactttctgggttttttgaaaaaaaatagtggccttattgttattgttttgtatgtatatcttagtgtccaccagcatccatgcattttcctctgtgggatatcctagagattttacagaaattaaatttcctaagtcatccatctataggggtagggacagtggacagggcactttaaaattatttttcttggaaaacagaaatgagcacggatcttagaaagctcttatatatttagcagatgtaaatctgtttaatataaatacaaaataaaatcatactcttaaagattttcaggtacaataaaaaagctacagtgtgaaaataaaagatacatatgtgatttttaaatttgacattatactttttcacaatatttcaaattcagattaaaacatttaattgattttatttatttattgtgatggagtctcgctctgtcgcccagactggagtgcagtggtgtgatctcagctcactgcaacctccgcctcccaggttcaagtgcttctcctgcttcagcctcccgaatagctaggactacaggcacatgccaccacgcccggctaatttttttttttttttttttttgtatttgtagtacagacagggtttcactgtgttagccaggatggtctcgctttcctgacctcatgatccgctcgcctcagcctcccaaagtgctgggaccacaggcacgagccaccatacccggcctatttttattttttaagatggagttttaagatggagttactgcaacctctccccttcccggattcaagcaattctcctgcctcagcctcctgagtagctgggattacaggtgaccaccaccacacccagctaatttttgtatttttagtagagacagggtttcaccctgttaacctggctggtctcgaactcctggcctcaggtgatttgcccgcctcagcctcccaaagtgctggaattacaggtgtgagccactgcgcccaacctaaaaaatgtaatagatttaaaagccaaatataaatccatagtttagtgaatattgaaataaggctataaataattttataatcagtgtgtttataaaacagcgtatcattatggtacagaatttaaaagttcagaaaaaaatgtaatgcttaaacttttgtcccaatagaaagcttccattaactcaaagggaaatctctgagaagtattaatgtttcctaatgaacattatggaatttctaagcctacattagacacttgcaactttgatctgtctatagagtgctttaattcttcaagcaattttttagaagtctccaagtgaaaatatattaggaaaatctcttactaaagaaatgcagtaggattgatgggatgttttatttcttacctttgaaaacatcccttatttctagcctaatatatacagacaacacatatctacatttattcattcaaattgctattgaaatagccataaaaagaaaatatcttaaaattggtaagtcatcacttctttataagatggttttatttgtaggtcaattttataaaattctctttttgagtgttatggttaataacatatttaaagatttaaatccatctgagagtttaaacaaattgccactatttatgattattttgtattagaatagcaaaatgggctgcattaatagtccagctctaacacagaagaagcattcgatttatattaataattacatataactggtttataaattatttgcatacatcccagatatatatacatgactgaaatttaaaataatttttttaaaaataaaaagacttctgaacccagatctactaattacatgtacaaagagagatgccctataagttggaagaaaaacaagtataatttaaaagacagctaaaatgtatgaaaagcaaacacgtttatttttaaacttcaatatggcccaataacaaagactgtgatattagtgaaaatggtaaaacaaagtcctttttggtactataaatactaatattctaaggacaggtcaagtcctatttggttttatgtgccacgtgaagggggaaataccagttcttttgttattccttttcctggtgagagagggccttcaaacggccaccacagtagcctgcatgaacagtgctttcttacaagacagcattgctacattacattgcatctttaggcctatttaatgggtgaggtgttgatcatatgccaagaaagacataaagagaatgaggaatgtacatagaaatgctattaaaatgatcccatgcttgagaagagaatcaagagctaagaaattaagaaaaacagtttctgctttgaaggagcttaaaataggacatcacctcaatgtagaggcatgctcccttgccgtctcaaagataatatttggtgatcagagccagaaaaaggaatctaaactacttgtttttgtagttagctctgtcatttaaccatagtctaattatccagctctatatattaccataaaaaaatctttaaatgtacaccatgtaacaacacttatcaacctaagaggaatgccaattaatgcttgcaaaggcactctaagattttttttttacaagcaagtgctatataacaacaaaatatctattactattctatctttccaaccaaagcaagttttgtcctcctaggattgctgggagcaaaataaacccgacgtcattctcctaagcccaattggcagcccagctgtgccattatccccgggaagtgtggtcatgtacggtaatacccgcattatgtgacaatgaccaagtcaaaattacccccttggaatagagttcagcctctgaaaatgtagaactgagaagacatgctgggttcaacagagtagccatagtgagggccatttttgtttgataatggccctaaattactgatatcaacttggcgtctaagactcagggcaaaagcagctattttctttctatggaacattcaccaaaaatataaatgcagctgccttagtcttgattttcttccctgtttttatgggatatataaggtcacgactataaatatagataaaatttatataaaacaccaaattaactggaaagcattttatatattctaaaatatatccagggtgtttttttttcttatttatagattttagaggcacataaaacctaggccccaagccaatttacagtttaataaacagctgcatagttgtgaattttctggtataaaatataccaaaatgataagaggctggtaattcagtgcattacctacagcaatagcttgatgcaatttttccatatgcttgatttataaaaacaaactcattttctggaaatggaagattaatcttcttcaacaaaattttctttatgaaaatgaaaaaaagtgttttctataccaagaaaaaataacatatattaggacgtagtcgggggcaggtgagaggaaaaaaaagagatattattggagaacaaaaactatatccataatccctttctcagataactgcttattgacttttttagaaagtagaacatagtcaaggttagtaaaaggtatattctcttctcctccacagttctgtctccctgggtttccttccaaaaaaaaaatttttttaatgtgtattagtacatactcacatgaaaaatacatgtgtgtatatatcaacttttgttttttcctattacaatgagtgaacctgctgggttaaaaaatacaggcattcctcagagatactgcaggtttcgtatcagaccatcacaataaagcaaatatcacaataaagcaagtcacatggatttttttggtttcccagtgcatgtaaaaattacatttactctatattactgtagcctattaagtgtgcggagcattatgctaaaaaaaatgtacgtaccttattttaaaaatattgctaaaggctgggcgcagtggctcacacctgtaatcccagcactttgggaggccgaggcgagtggatcacaaggtcaggagatcaagaccatcttggccaacacggtgaaaccccgcctctagtaagatacaaaaaattagccaggcgtggtggcatgtgcctgtaatcccagttacttgggaggctgaggcaggggaatcgcttgaacccgggaggcagaggttgtagtaagctgagatcgtgccactgcactccagcctggagacagagcaagactctgtctcaaatgtatatgtatctctctctacaaaatgctaaaaatcatctgagcctttagtgagttgaaatctttttgatggtggcggttcttgccttgatgttaatggttgctgactgaccaggatggtggttgctgaaggttaggggtggctgtggcaatttttgaaaatgaaacaacaatggagtttgctgcatcgattgactctttctttcacaaaagatttatctgggccaggcgcggtggctcatgcctgtaatcccagcactttgagtcaaaggccaaggcaggtggatcacctgaggtcaggagttcaaaaccagccttgccaacatggcaaaacaccatctaagccaagcgtggtggcgggcgactgtaatcccagctactcgagaggctgggacagaagaattgtttgaacccagaaggtggaggttgtagtgagccgaaatcacgccactcactacactccagcctgggtgactgagcaaggctctgtcttaaaaaaaaaaaaaaaaaaaaaattatctgtagtatgtgaggctgtttgacagtgtttcactcacagtagcacttctttcaaaattgtagtcaatcctctcaaaccctgccactgttttttcaactaagtttatggaatattctaaatcctttgttgtcatttaaccatgttcacagcatcttcactgggaatagagttcatctcaagaaaccactttctcatccatagaagccacttctaatccacgataactacgtcatgaaaatgcagcaatttggtcccatcttcaggctccatttctaactcagttatcttgctattcctcccctgctttaatttgtggtatcttcctccactgaagtcttgaaaccctcaaagtaactcatgagggttggaatcaacttcttccaaactcctgataatgttgatattttgacctccttccatgaatcacaaatgttcttagtggcatcaaaaatggtgaattatttccaaaagattttcaatttactttgcccagatctatcagaggaatcaccatctacagcgagtatcgccttacaaaatgtatttcttaaaaaataagacttgaaacttggaattattccttgacccatgggctatagaatggatgttgtgttagaaagcatgaaaactccatttatttctttgtgcatctccatcagagctcttgggtgaccaggtgcattgtcaatgagcaatattttgaaaggaatcttttgttctgagcaggtttcaacgttgggtttaaaatatttagtacaacatgcagtaaacagacacgctgccatctaggctttgttgtttcatttatagaggacagtgtgggtttagcataattcaagggccccagaattttcagaagagttaatgagcattggtttcaagttaaagtcaccagctacattagcatctaacaaaagagttagcctgtcctttggagctttgataggcattgacttctcctctctagttatgaaagtcctagatgacatcttcttccaacagaagactgttttatctacattgaaaatctgtagtttagtgtagccaccttcatcaatgatcttatctacatcttctaaataacttactacagcttttacatcagtacttgctggtttaccctacacttttatgttatagagctgacttatttccttacatgaaacaaacactgctggcttcagacttttcttgggcagcttccttatctctctcagtcttcacaaaattgaagagggttaggttctttctctggattaggctttgtggctggtttgatcttctatccagaccactaaaaccttacatcagcaataaagctgttttgttttttaatcatttgcatgttcactggaatagcacttttaatttctttcaagaacttttcctttgcattcacaaattagctagctttttggtataagaggcctagtttttggcctgcgtaagctttcaacatgccttcctaactaagcttaagcatttctagcttttgatttaaagagacgtgcggctcttcctttcattgaatacttagagggcactgtagggttattacttggcctaatttcaatattgttgtttcacagggaataagcaggcccaaggagaaggagaaagctggaggaatggctgttctctggagcagtcagaacacacacaacatttatcaattaagtttactgtcccccatgggcatgttccatggtgcgccaaaataattacaataataacatcagagatcactggtcacagaacaccttaacatatataatactaataaaggttaaaatattctgataattgccaaagcgtaacacagaaacatgaaatgagtacatgctgtcagaaaaatggcactggcagactttttccctattcctgaatcagttaacccaaaagagttgtttgatggggtagtaggtgtggaaaccttggtaataaaggaactaagctgacattattattttttaaatttttttagttttttttttttttgatggagtctcagtttgtcacccaggctgaagtgcagtggcgcaatctcgactcactgcaaccttcgcctcctgggttcaagtgactcttctgcctcagcctcctgagtaactgggactacacgtgcacaccaccatgcctggctaatttttgtatttttagtagagacggggtttcaccatattggccaggctgttctagaactcctgacctcgtgatccacctgccttggcctcccaaagtgctgggattacaggcatgagccactgcgcccggcctgatattattttttcatacggtatctattataaatatatatttgaaatatttttcactattatcctaagctaataataataggaacaaagttaccacatgtgcaaaaagctagatgtttagtcagcaaatatctctaatatttatttgcagttcttggttattaccatattgaggatttattctaccttgaaggttaggaaaaatgccacttcagagaaggtttgctaggagaaaaaatttcttccttggcctaatatatttcaattgttgtcaggtgttccaagtgtgaattactgggtattgtactgaatcatcttctatggatccatgtactgcaccttccaaccaacacctctaccccagcacccctccacacacacacactcatcagatactttcttgaaatttgcattaaaataatgttgaaatgacttggctcaaaagcattaagtgaagaacaagacttagaaaaagcaaacctttcattattcttctctgcattaagtgcctagctctctgtgaattgcaacatttttaagaacatatccatagtttgataacctatagatacatagaaattgtctaagtgctaattttccaaactaactgagaatattttaagtgtctatctatatacctctgcctctaggagagtagcaaagagattcaaatatgagcatactcgtattctccttgcttcaggaatctagacgaacatttttacaaaaatatatacacaacactgttcatgcatattatagccacacatattatagcactcacataaacccatctcagagaataaatgaaattgttcaaaaaagagagccagttagtaatcatttgggactctcaattatgggcaaataacgttcattctgtataaaggtaagtacaggattggtgggatttaagagagatgcttgcataggcatctcttaggcaatctgggtcagcttaggcaatctaggtcatttcccaaaatattaaagaaaaaacatccagaaatttctggaaacatcatgtactataatttatatacagtcatgcatggcataacagtgttttagtcaacaatggaccacatatacaactctggttccatagattataataacatttttactgggcctatatctagacatataaacagttaacattatgttaccattgcctacagtatctagtacagtaacatgctgtacagatttatagcctaggcccaataggctgtaccatatagcctaggtgtgcagtagtaggctataccatgcaggtttgtgtaagtcccctctataatgttcacacaatgacaaaattgccaaaggacacttttctcaaaacatccccactgttaagcaacacatgactatacatccacctctttctacatttaaatctttctccttgctaagtttaaaaaatcataaattgaccctgttcaaattgcaatttgtagtcttttaaatgaatacaacttaagtagattagaatgaatgcagcactgagaggcaaaatagcctgaagttttaagttctggaccagacaacttggtgaacttttacaagttatttaacctctgtgcccattttctcatctaaaagcctgggataataataacacctatctcacagaatggttatgagaattaaatgatgtataaagtttctaaaacagtaactggtactgagtaaatattctataagtgtttatcaaccacataaaataaatatttcactaaagcacaaaatgtattcttttcttccagggtcaaaatacactaatagctcttcaaatagcctgctagatctaacagtaattgatgaacacctttaagaataaactgagataaatgagaaaagcaagatatttttgtattgcaatattcagattgtttcctggtcttcagtacacgtgtaaactttcaaatcaaaatagtacattttacactacaattgtatttgtcttctgttgttttgctcttcttttctcataatcaggctcttttttttctagtcccaggaaattttggttcaacattgaactcaaaattacaaaaatgtgaaaaaaatgtgtaaacattactttcatagcagtttgctaatattgaagctgtatagattgaacatttagacattatttgcatttcttcaaagcctagtatcttattaggtaagcatcaaaaatatatacaagaattactcttgtttcttcaataacttcagaataaaagcagaaattaatgggatgggtgggccacatggttatcaccaggaagttattaggacctaacagcatctgaagctggcccttatgatgggaagagaaatggaaaggattcaacaacaactaaaatgtctgttccattaattatcacttgcttataaaagctatatatgaactagaaaaataaagaagatcccactggggaaaaattggatttaggacatacatacacacaaaaacccaaaaatacattgttcccagaacaaataaactgccattctcattgcatacagccatcctcctaaaaccaaatccagccttaggaaaaggaaatatatttcctgaatagccagcaacctccttgaggtcctcttgaatgaactaatatacttctccatgtgtgcccaagccagtgcagaaggaaaaggctgactctctgtcaccagtgtctcgtagagggaagtaatatgatcatctaggtacctcacataaattagaacagatggaagtatgagtttctctttaccagatcatggggttaggatggaatgactttgattctcccaatttaaatcctagcttgcctgaaaatgcaggcttgtccttactgtaattccttcttcagaaaaatatctttaatacccaataagcatagagaaatgaaaatactcagataagatgcatttactgacaaacatatcacatcaaaatttcctcatccagtgcactaccctcttcttacatgtgggagcaaatgtgacccaaggtgaaatctacataaagatgaaagtgaaaacacatagcaatttataggtaatttgtaataaagcttgcagtaagcattactgccaagaaatgcagtaaatccacaataggacttctatcatagctgtaagaactgggtttgtgagagtttatacatttaagctaaatttctcatatttcccattttggctcctcttatcttcagcatattaaataatgaaaaataaagcttaaatctaatcttcaaagtataaattgtcttatggctaaattcaacatccaaattcagccctccactgtgaccattgttaacaacactcaggtaatgtgaaaggcaagaaaagcaggggcctgacataaaatatatttttcaaagtaaacgcccaacataaaatttatccaatattcccagtttactctcaggcagtcatgatgcttacttattttacacattaatatagcttgtgaacatcactcatctactactactactaggtactagggacaatcatggcttggaaaatgcaattcttgtcttcttcaactataagtaaggggacagtttgagcagaaagtcaaaagaggccgggtgcagtggctcacggctgtaatcccagcactttgggaggccgaggcgggcagatcatgaggtcaggagattgagaccatcctggctaacacggtgaaaccccgtctctactaaaaatacaaaaaattagcccagcgtggtgacaggcgcctgtagtcccagcttctcgggaggctgaggcaggaaaatggcgtgaacccgggaggcggagcttgcagtgagccgagattgcgccactgcactccagcctgggcaacagagatagactccgtctcaaaaaacaaaaagaaagtcaaaagaaaggtggtaatatgaaacttctaaactaagagttgatttcctgatttgcatgtgaacatggtaagtagcttgtccaacatcacagagtaaatgctagagtctagaagttctctgagaacaccaaataaataaaagtatataaaatgcatagctcagtgcctggtccatagtcaatattcaaagaatgcagctcctgcgccgatcaaactctcttagtccaatttgagtgtaatacactatcaatcagcataccctggcattttgataatgtttttcgagtttgagaattataaaacaacaaataatgaggcattcttatttagaattttaataaataattcacactattcagaaattttacaaatcagaagatttcaatgcacatttattgaaaatcacttccctaaatcaaattatctaaaagagcttaccaaaaccactgagtatagaaaggttataaaagatcgatttacttaaggtcaattatgcatatgaataatttatctccagtgtttaatgttacttaatctaaggataaaaattatttttaattattaaacttggaatatcaagcaatctctctttaataagctaaacttattaatgcttaaatgtgtatttggaaattccatggaattttgatttgcaaacatcacatataaggtacttcaatatctacttttaatttgtctgaaatgaattaccttgaatatacttaagacatatgctgtatgtaggaaaaaaataaatatgaatgaatcagcatgtacagaaacactaattttaatcagaatatgactttattttggccatttgcttaaataccaagtagtttatttgtttgaggaacaaaatattcatctccactttaatgtaaatgcccttcattccacaaagatcatgttagtaacattcttgcagattctccaacggagaattaatccaattataatgccatttcaaatttaaggttctaaaccagaaaatatagtcaaaaagaatcacaacaatatcagagttgagatcattagaagtcttcaacagctgtaagaacattctcttttcaatgatgctgtataatacaaaacttgtgagagtttactagcccaaagtcagtgataaatagggtaataagacatggacagattccattatctgtatgcactcatcatggggagatgtaaggaggccaacaacacatcatgtttaacagatttatcagccttattttgagatttggtatgaggggaagaattttttaaaagatttacttggaagacttcattctcaatctacacggctatcctttcttttaagttcataaatggatagtaagaggtatgtccccaccctgagttccagctctacacacatcttcaaaaaactcttcttcagtagataatggaattttttcccatgatgcacagatggctaattcccaaggctgtcttcacacagatactttttcttcatttcctcctaaaactaaaaattactttaaaaattttttttcaagaccatgtttccaatagtgcttgtttttcttataaggtgagaagaaaggccttcctttggctatctccctcaaaataattcaattaggaatacagaacattaaagagaatccttaaatgtcaatatgcctttttgtttaattttcatctgtatgtagaaccacgagaagtatgccatcaaattttccagcactgtgcaaacttacagtgaataaaaaaaaataaggtaatgtattttattcctttattatttcaaaaagcaagacaacgagttaacaataacatgacaccaagtatcatatggaaaagtggaaaagtgcccaatcactttaattaggtttataaacaaaaatacaagacatcaagtcagataatcaggaacaaaacaagcttcatctccctcatatgacctcagaataatcagtaatattgtgtatcccttttcaccctggaaaataagtccttcaaattccctttctatggcttatataaagcctgatgtgctccccaaggtttctgtaaatcaccataggcttacatgctcagggagctaagctgcagcttctatcaaagcagttcagtttacggagtatcacagcattctgcagagcagcatccatatgtacaagtcagctcttttccatgactcacacaaaataaaacttggtgttcgaagttttgaggaaggaaatatacatgatagaatgcaaacttaagattatccattaaaaactcttgttcttataggccactccagccattcccctaggggataacatgctgtgtcatcccctttctgttgttcctttcttctccagtttccccctattctgccctccccaaaagaaagtctgaagccactagttgacaattgttgttttccttgatgtggtctttaatttagctccatattgtaagagtttataatctaaatcagtgtttgtcaaactttctttttagcagaggaaccttttgaaaagtgaaattgtacaccaaactctaacatatgactaagagagtagagttgctgtttgaagtggaggcagggagtgaacttggagacttcccttcagcctcatcatctacctctcttgtctaatggctcccagtcactcactgaaagatcaggtcttcatatcatcaagtttgaaaaatattgaactacatacagaataagaagaaactgccaaattaggtacttttttgtatttaagaaataagagaagatgaatcaaagttgacctaaaaattatgtgcccgttacactgggagaaagataacaccattgatagaaatcaataaattgggaaaagcatacattacgtttagtgtcataattagtaatctataaatgtggatttatttcataatgcaattagatgaaatgcatataaagatggtgacttatgaaatgacaaagaattctaaagcttatcataaaacttaagcattttcaaatgaataataaatggccatattcatcaatgcctcccagtattataattacacatttttaattaaatctctgttgatataggataagctaaattaaatttcaacatctaactataaagaaagggactatttataattacccacaaaatagcttctacttgttatactttgccaaagagaatgattatactttttcctatctttcagtaaacctttatatagcttatagctgtctttccagaaggaatctaagttttttataaattgaagacaactaacttatatgagaaagagaatgaaactaacgtttattacatgcctaccataggcgaggcactgtgctgatgcttttatattaccagttttcaattcacactacatactaaaatcgcccagcaatcttttttttttttctgagacagggtctttccctgttgcccaggatggagtatagtggtgtgatatcagctcactgcaacctctgcctcccagattcaagcgattctcctgcctcagcctcccgagtagctgggattacaggtgcccaccaccacacccagctaatttttgcatttttagtagagacggggtttcaccatattggccaggttggtctcgaactccagatctcaggtgatccacccaccttgacctcccaaagtgctgggattacaggcgtgagccaccacgcctagccaggaatctttttacaaaacattttgattcatgagtgtatcctccagagattcagatttaattggtcaaaggtgggggccttcacttgagaaatttttaagcctctcatgtgataataatgtgcagccaggattgaaaatcacaattttatatactttatctcatgtcatcatcaaaacaatctgaccaggtaattatattattccttttttcagataagaaactggaatttcagaaaggttgtgaaatttgccccagggcatagagaaggtatcagagttagaatttaaattcagagttctccgacagcagcgatctttctaacctccactttgtcaaattcaaaacaccagaattattagtgtgaatttagagtagatttctatattttattttactcctggcttcaagaggtggtggagtaaagtatgttttacgttaatttgctagcaaaacacaatattctttattgaactaattaagctgttactcaaaatgaagttgctttgtattttataacataaagtatggaatattttctccctttcaaaatgttcctttttttcataggtacactatttaaaaattattgattttagagtttcttatcagagataagaaggaaaatgcaatgtaaaagtattcaaggaacaaaaagtagattatatttgccaaccattttattttgtcaaccacctttaagggagaaaggtaatttcttataaaatataattatttgttaaacagcagccaaaattaaacagaattctcaattaaaaaaaactttgttttacaaactatatccaatgtataagtattttaaaatataaatacatttcaatattttatttaaactttaaacaagcctatacatattataagttaatttaggaatgttttataacttttacgataagagtaaaatgttagcatgtaatttcaactgtcaagctgaaaataaatatatgaataaccttcattctattacttttcatcttaaaatatatcgttaatgggcttttttttaagtcataccaaaggtgatattaccaactccctaaggacaacgaattctgctaaactagaattcatatttcagagaggagatggataacatctcacaattcaacttcagcaggagtcattaagtcagacacctatgtgagggctgtatttctcattgaattacaaatccaataagagctttgcctttgaattactagcactacaaagattaaatcaatatactgtgaaaaaaggaaaaacccttggatgcttgaagattagaataaaacgcatgaattttttagctcaaatggacaaccatagaagtcattaatcctactttttcattatacaaacccgctacacggcttttgcagaggtccccctttcattcttcacccctccaatcctatagcgactgcactcagtttaatgtcccaaaatgttcatatgagctgtatggcccagcatgacccctaccttgcctacctgcctcccagtctcatctaacactatatgccccctcaatctctgaactgaagccactcagttctttccagaattcacgggcactgagctcttttccccaggaggatgtctgcataaactgttatctttttaggaatgtgttttttcatcttcacctcctacttctcctggataacatctaccttatccttttggcctctaacatagagaggttttctacatcacctctttccctttaaattcaaattgtttcttttttttagcaccctgtatatttctttcatttctactccattcgtaattacgtattaatttagaggactactgtttatgtctatgttaccagtaggctgttggcttcccaagaacaagaagcatgtctctttagttcattaatatatcctcagcaccttttacaatgccaggtgcataacagaagctcaataaatatttatcaaatgaatgaattaactggatactaaggaagagaggtaaagagcagaagctctagagtcaggctgccttggtgccatcattaattcaactacaaagtggttgttaattcttttacctttaaagttagcattttaactagctacttagagaattgttgtaatgattacatgacaataagtaaattatctagtacaggccaaagaaatgttaagttatcattaataattaccaagatataatgtttcattaatgtattatttaaaatatacatgtatatactatgtatatgtgtttgtattaatatatgtgtgtgtgtgtgtgtgtgttgtacattcattcttcttttagttaccaaataatcctattatgtacattgggatatgttgtttattcattttacagatgaaaatacagattgtgttataattgttttatccatgattggcttccatcttctttatcagtactttttttctaagtttttctagcataaagtaaaacttactaagtttggcatcctgcattggtggtataatggttagcatagctgccttccaaagtttgtcatccctaggtcatttgttactgcgttcagaagtgttcccttctcttcaatttttagaagagcttgagaaggattggtattaattcttctttaagtatctagtagaattcaccagagaagctatctgatcttgggcttttctttgttgggaagtttttgattactgattcaatctctatactagttacatataatgatcagattttttatttgttcatgattcattcttggctaagttgtatgtttctagacattcagccatttcttctgggttatccaatttgttagtgtagaattgttcacagtagtcttttaagatcctttctatttctgttgtatcagctgtcatgtctactctgtcatttataattttatttgagtctttttttctcttacttttgctagtggcttcccaattttgtatcttttcaaaaaaaccatctcttagtttcaatgatttttttctattatttttctatgttctcttgtatttatttttgctctaatctttaccatttctttccttctactaactttgggcttaatttgttcttctttttctacttatttgagatgcaaagttagattatttacttaaaatatttcttctttttgaatgtcaacagtcatggaaacttccctcttagtactggttttgctgcattccatgagcttggtgtgctttgttttcaatttcattagtctcaaaatattttcaattgctttagatttattctttaacttgttgtttatgcaagagtatattgtttaatttcaacatacttgtgaattttccagtttttcttctgctactaatatttaatatttagtttcattcaactgtggtcagaaaaaaaaaatacttggtaagatttcaatctccgtaaatttgttgatacttgttttgtaacctaacatgtagtctatcctggataatattctgtgtgcatttgagaagaatgtatattctgttgtttttgatggaatgttctgtccatgtttttttagttgcattaagtctaaagtattgctcaagtctgctgcttccttattgatattttgtctgtatgttctactcatactgaaagtaggatagtaaaatatcctactgttatattgctatctagcttttccttcagttctgttaatatttgctttacatacttaggtgctctgatgttgggtacatatatttatagttgctgtatcttcctaatgaatcaacccttttatcactatataatgtcctcctttctctcttagtacagtttttgacttctgtaaaacatagtactataagtcctagttagagcaattaggcaagaaaaagaaatacatagcatccaaatttaaaaggaagaagttaaattgtctctgaagatgacataatcttacatgaaggaaattataaagactacacacatgcaaacacacacacacacaaatacaccaatgttagaaccaacaaaacgtatcagtaaagttgcagagtacaaaatcaacatacaaataagtatatctgccatgaattaagctcatgtgcaaacatgtgtaattactggtcttgtgtcatctagactactttaaaaaaggtgaaaaaggtcctgtttagttccaaaagggagaaggcagcccctcctgtatgagtggaagctacaaccccttgaaattaataattacaaatcccttaaacccaaggtagaaaaaaggagaacacatatctctgggcatcaataggaaaagactaggtcctacagtaaatatcttagtaaaagaggaggtttgtaaactctctccggaaccagtatttcagactttctatgatgaactaaatgtgccagtaccagagactctaggaaaaaccaggaatttgtttttgcaattagccgcgcatgtagcccagtctctaaatgtcacttcatgttatgtttgtggagaaactgtaataagagatcaatggccataagaagcccaagaattagtgcctacagagccagttcctgatgaattcccagcccaaaaaaatcaccctgatcatctctaggttctaaaagtctcaattattgaacaatattgcatagctagaaaaaggaaagaattcactcattctgtaggaggacttagttgtctggggcaaaaactgtataacagtaccacaaaaaaagcagttatatggtggagttcaaattacatagaaagagatcctttcagtaaatttccaaggttgcagactgtctcggcccacccagaattccaccgggactggactgcccccaccgggttatactgaatatgtagacatagagcctacactaagctgcctgaccagtggacaggtagttgtgttactggcactattaaaccatctttcttcctactgcccataaaaacaggcaaactcctggcttccctgtctatgcttcccgcgaaaaatgaagcatagccataggtaattggaaagatgataaatgacctccaaaaaaaaaattatataatactataggcctggcacttagacacaagatggctcatgggaatactggacccccatttacatgctcaactgaatcatacggttgcaagctgttttagaaatcatcactaataaaaccggtcaagctttgactattctggcctggcaaaaaactcagataagaaatgctatctatcaaaatagatgggctctcgactacttgctagcagctgaaagagaggtctataagaaatttaaccttactaattactgtctacacatagataatcaaaggcaagtagttaaagacatagttaaaaatatgacaaaactgacacatgtgcccgcataagtgtagcacgaattggaccctgaagccatgtttaaaaatcagttcccagcactaggagaacttaaaactcttataataaaagttatgatagtaataagaacctacttactgcttccttgcttgctacctgtacttcttcaaatgataaaaagcttcatcgctatcttagttcaccaaaatgcttcagcacaagtgtactatataaatcactatcaatctattacaaaaaaaaaaagtaacaaaaataaaagtgagaactcctactaataaaaaagtgagagcctcaaaggggggaaaggagggaagagagagaccctctcatattgttttatattgttttatactcagtacctgtttttaaaaaaaacaacaaggaagtaaaaccaaagacaggcagcccagagccacgcctgaaaccaggcctgggcctgcctggcctaaacccagtagttaaaaatcaactcataacttaaaaatcgatgttattcacagattccagacattgtatagaacaacactgtgaaactccctgccctgttctgtttctctctgaccgccagcgcatgcagcccctgtcgtgtaccccttgcttgctcaaatcaatcacaaccctttcatgtgaaatccttagagttgtgagcccttaaaagggacaggaattgctcactcggggagctcggattttaaggcagtagcttgccgatgctcccagctgaataaagcccttccttctataactcagtgtctgagaggttttgtctgcggctcgtcctgctacaaaggaatcatacttctggatttcaaaaaagattacaaagctacactaattaagacagtatggtactaacataaagacagacatacagaccaatggaacagaatagagagcccagaaatgaaaccacatgttatttatcaattaaaaatgaaattaaaaatgttttaaaaatctacatgtgtaaagtcaactaatcttcaacaagggtgtcaagaatacagaatggggaaaaggtagttccttcaacaaatgatgctgggaaaactgaatatccatatacaaaagaattaatttggacctttaccttacaacatatacaaaaatcatctgaaaatggattaaagacttaaacataagacctgaaactgtaaaattcttagaaaaaaataggggaaaaacttcatgacattggattggcaataatttcttgggtatgactccaaaagcatgagcaacaaaagcaaaaatagaaaagaaggattatattaatctaaaaattttctacacatcaaaggcaacaattgagagagaagacacaacctatagaatggaaggaaacatttgcaaatcatacatctatctgataaggagttaatatctaaaacagatcagtaattcaagcagctcaatagcaagaaaacaaataacccaataaaaaaaatggcaaaggacccgaatagacatttctcaagagaaaaaatacagatactcagagtatatgaaaaaatgtgcaacatcactagtcatcaggaaaatgaaatcaaaaccaggagatattaccttacatctgttaggaaagctattatcaataaacaaaaaaagatcacaaatattgaggaggatgtgaaggaaaaggaatgcttgtacactattgatataaatgtaaaatgatgtcacagctatggaaaacagcatggcatttcctcaaaaaaattaaaaataaaaatactatatgatccagcaatcccgcatttgggtttatacatgaagaaaataaaaagtagctggaagagatatatgcactctcatattcatcacatcttttttttttttttttttttttgagacagggtcttgctctgtcccccgggctggagtgcagtgatgtaatcatggctcactgcagcctcgaccacttgggctcaaacaatcctcccacctcagcctccctagagctgggaccacaggggtgtgccaccacacccagttaatttttatattttttgtagaaacggggttttgccatgttccccaggatggtcttaaaccctgggctcgagaggtctccctgcctcagcctctcaaagtgctgggattacaggtgtgagccactgtgctcggcctcacggcatcattatttacaatatccaagatgtttaaacaacctaaatgttcatcaccaggtgaatggataaaaaatatgtggtatatacatacaatgaaatattattctgtattgaaaaacaaggaaatcttgcactgtgacaacatgaatgaattcttgagaacattatgctaagtgaaataagctagtcacagaagaacaaatactgcatcataccacttatatgaggcatatgaaatagtcaaacacagagaagcagagggtagaatggtgggtgctaggggattggggagggagaaatggaaagttgccattcaacaggtataaagtttaagatatgcaaaacaatttagttatagagatatgttgtccaacattgtgcctctagttttcatttgatatattgttcacttaaaaatttgttaagattgtagttctcttattgagtgcttttgtcacaataaataaattaaaataaataaaagtagtaatctctgaagatcaagagagaagaaataacaaaaaagtaaaaatatgaataaaaatacacttctttcttcagttttctaaattatgtttgatagttgaagcaaaaattaaaacagtcttacgtgtttctcaatatacataaaacaaatatttaatatatttatataataaatgagtgagataaaattacataaagggttctacattttcctcaaactggtaaaatgtcaactttattaaattatgataattatgtgtatataatgccatacctcgataaactactaaaatagctatataaagatatatactcaaaaatactatagacacatcaaaaaagaatctaaagtgtattcaagtaactgacaaaaagtcatgaaaaataaattaaaaacagagggaacaaacagaaaacaaattagatggataggtagatagattagacataatccttaccacatcaataattacttaatatacatggtctaaatacaccaattaaaagacagaggttagcagaacagattaaagacctaactcaactacatgctatccttaagaaacttacttcacacatcatgatacaggtatattaaaagtaaaagggtggaaaaagataaaccatgcaaacattaatcaaaagaaagtagctttattaatatccagtaaagaagactgcaaagacagaaaattactcaggagagagggagacattacataatattaagagtcaatccttcaagaagacatagctagcctaaatgcgcatgtacttaacaacagagctataaatatagatgaagcaaaaactgacaaagctgaacggaagagtggacaaattcacagttatagctgtagacttcaacatccttctctcaacaattataagaacaactagacagaaaatcagctaggatatagaaaaattcaacaataccatcaaccaacagattctagtcaacattttatagaacaccttacctaacaacattatttttaagtttttcaagttttcaaatttgttttaaatttttcaacaaattctcaagaccacgagtgggacaaggaaatatcctacaggcagcaaaggacaataagggtaaatacatattatttttaagtgcccattaaactatattaagatagaccatatcctgggccataaaatagcctcaatatatgtaaaaaaaaattagtcacaaagagtgtgttctctgcgcacaatcaaatcaaaatagaaaattgattattgaaagacaacaggaaaatctgcaaaagagaaaacattccagctctcactgggcttgagtttttaaaaaaagaggcagagaaacagaaaatatctcacatcagtaatctaatcatctatctcaaaaatctagaaagaaagcatgaaatacacccaaagtaagcagaaagaagaaaataataaagaacacaaataaaattgaaaatgaaaatcgagaaattcaatgaaataaaaaagcttctctttgaaactatcaagataaaatgttaaaattctagaaaaattaacaaaaataaaagagaagatacaaatttttaagaccaggaatgaaacaaggaaatatcctacaggcatcaaagcacaataagggattatacaaacaactttaacatgtaagtttgacaagttagatgaaataaaccaattccttcaaaagcaaaagctatcacaactaactcaatatgcaacagataatttaaatagctctataattattaaggaagtggaattcataatataaaaactcctggaaaagaaatctccatccccagatggttttcttggagaacactgccaaatatttaaacatatgtaacacctgttctacccaacctttctagaagataaaaaaagagggagtactttccaatcaattttattactaccatgataccaaaaacaaagatattataagaaaactgcaaattaatactcttcattaatagagatgaaaatatttctaataaaatattaacaaatagaattcatccatatgtaaaatgaattgtataccatgaccaagtaagatttattccagggttgcaaggctagtttgatatttgaaaatcaatgtaatctaccatattaacaaactaaacaagaaaaatcatatgattatgtaaattgatgcagaaaaggcatttatctgacaaaattcaacacccatttatcacacaaactctccaaaatctagaaacagagaagaacttctatatcttgatttttaaaaatctatcaaaaagagatctaaagctaacattgtatttaatggcaaaagactgaaggctttccccctaaaataggcaacaaagcaaggatatcagctctcaccacacttacgcaccatatttctggaagttctaatcggtgcagtaaggtatgaaaattaagtaaaagacatacagatttaaaaggaagaaataaaactattcctactatctatacatgacataattttctatgtagaaaatcccaaggaatccaccaaaacgacaataataacaattcctgaactactaagtgatttcaggagggttgcaggatataagataaacatacaaaaatcgattttacttgtatatactaataacaggtgaaaattaaaattaaaaatataataacatttataatacctgaaaaatgaaacaattaggtataagtctaataaaacgtgtacgacttctatactgaaaactgcaaaatgctgatgaaagaaatcaaagatctaattgaatggagagacatcctgtgttcatgaactggaagacaacacagtaaatatgtcaattctcctaaattgatatacaagtttttataattcttataaaacctaagaaaaaaattttagacattaaaaattattgtaaaatatacatggaatgacaaagtagctaggatagctaaaaacaactttgaaataggaaattaataggaataactctaagtgatttcaagacttattatatagctacagtagtcaatgctttgtgatattggccaaggaataaacaaacagcccaataaaatagaatcatgaaactagaaatagccatacacaagtacagcaaattgatttttcacaaatatgcagaagtaatccaatggaggaacaaatagtgctagagcaactggatatcaataggcaaaaagtaggaactttgagaaaagtctcacacttcataaaaagttaactcagaatggatcataaatacaaaatcaaatgtaaaatataaaacgtttaggaaaatagcagaaaagaaattttggacctagaactcgttgaaccattcttagacacaaaaagcatgacacataaaagaaaaaatagataaagcttacttcattagctacaaactgcaagaaaatatttacaaaactaatatctgaaaaggtctcatatatagaatgtataaacaactcttaataattaacagtaaactactatacaaaaaatcctattagaaaataggcaaaaaacatgatgagtcatttcactgaagagtatgtacagacagcaaataaacacatgaaaagatgtttgacatcactggctattagaatgaagatcataatatcactacacactgattagaacatctaaaataaaaaatagtgaaaatatcaaatgttggtcagagtgttgaataactagatacattgctggtgggaatgtaaaattgctctggaaaatagtttggcagtttcctaaaaactatgcatcacataccataacctagcaatcacacttgtgggtgtttctcttagagaaattaaaatttatgactacacaaaaatctgtacccaattgttcatagaagcattatttgtaatagccccaaactggaaaaaacagaatgtcctaccatagtcaaatgtataaacaatggtatatcctaccatggaatactaattagcaataaaaaagaataaactatcaatatatccaacttggatggatctctaaggcattatgctgagtttttaaaaagccaatctcaaaaggtcctacactgtgtaattccatttataaaacactgtataataacaaaattatagaaatggagaatagatttgcatttgccgagggttaggcacggggcaggggcaggtggtaggggtagggaggggcaggtgtgattggaaagtggtagcacaagggagatatttgtagtgatggaatatttctgtatcgtttttgtgttggtgattacacaaacccatatatgtgataaaactatatacataatttatgtcaatatgtcaatgtccttgttttgatatcttgctatatagttacacatgatgcaacctatataggaaactgggcaaagggtacaaagaacctctctgtgctgtctttgctacttcctttgaatctataattatttcaaaattaaaagtttttttaaaaatttagtttctagtctttgagaggtattcctgggacgaaaatgagagaagatggataggctttcccatatagcataaacagctgaactaaaattaaaagcagttatcaagtagattcagtcagttttatttttacaagtgttaggtttaatataaaagtcagaaactaaataaaatgaacagtcaatacttctaaaggagttgtcaaattagaaagagcttgtttctacaaaagacaacataattatcacaaatagtgattatcatatctctgctatgcaccaaacaaaaattatttttctcttcccagttgtaagccaactgccatactaaccgtcttgccaactttgtattttctttgcatattccttttctcctgagcccccagtactgcacttaaaattgccaaggaggaagggagacttagaaactgcaagaggctaaataaacatttgcctgtgactattccacagcataaattatataatcactaggtattcaatgattctaatttaatactgctaaagagggcaggtgatcataacgcacattttagaaatatcaattgtgggtcacctgaaaaagtttcagtcattcttaaatgcaattaccaatatcattataacataaatgcactcagacaaaactaaactcattaaaatggaattctgcaagagtgtaacttacctagctttcttggttttttttcacactggacactagaatctttacccttataattagataaggttcacccacttcagatctctgttataagtgtttaatttatatacactggtttaatttttaacccgagacttaaagaacatgaaagatttgcagggattaactaaatctattctttgtaatagaatccattaataattttctctacatctttctacctactaacatcagttttggattctttctaataaagctgtaactaacaactcttgaccattatggctaaggagacagtctaactcatcctagaataccctctaggctattccctacatttgttgttagggtaattcagatcctttatgttcttctcaaagtaaagtctttgcctaaaaaattgtatagtattatgattatctattattgtgtaagaagccattgcaaaacctaatgtttaaaaagcaacaacttctggccgggcgcggtggctcatgcctgtaatcccagaactctgggaggccgaggcaggtggatcatttgaggtcaggagttcaagaccagcctggccaacatggcaaaaccctgtctctactaaaaatacaaaaattagccgggtgtggtggcacatgcctgtagtcccagctactcaggaggctgaggaaggagaatcacttgaacccaggaggcagaggttgcagtgagccaagatcgtgccatggcactccagcctgggtgacagaacgagactccatctcaaaaaaaagaaaaaaaaaaaggcaacaattttttattctttcttatggttctgaggtttggctgggctcagctgagatttgacacatcaggtctctgagcagctgcagtcaaagtttggctgcagtgggaaccatataaaattttgaataggctagacatacaagataccatatttacagtgctggcagttaatgcgggcttttggctaggaatgcagctctatcaaccagagtgcctacctaattgttatctctctgtgtaggctgggcttcatacagcctagaaattgcattctgaggggaaatgtctcaaagttgagcactccaaaacaatcaggtgaaagctaaaagcctttttataatctagcctcagaagtcctagaatgttacttctgccatatttagttggtcaaccaagttattaagtccagccaagattcaagaagaaaagtattaaactctatctttttgatggaggaaaagcaaagtcatgccagaggagaatttgcaaaatgtgaaatattgttgtagctatcattagagaatacaatctatgacatatagaaaatttcattcctttccaatatacaagtataaaatgccacttgcttattttactggataaccctaggaatgacagcatggtgaggtagctctagatatccctgacctaagtattctctctcctttcttttattaccccaacagtagcatttttaaagttataaaaatatagaggttatcggccgagtatagtggctcacgcctataatcccaacagtttggaaggccaaggcaggtaaatcacctgaggtcaggagttccagaccaccctggccaacatggtgaaaccccatctctacttaaaaaatacaaaaaaattagctgggcattctggctcacacctgcaatcccagctactcaggaggttgaggcaggagaattgcttgaactgggggccagggattgcagtgagccgagatggcgtcactgcacttcagcctaggcaacagagtgagactccatctcaaaataaaaaaaggttatccaacattaaaaacatcatgatgtagccaaattctattaataccagatgtacaaagaagagctggtaccattcctacagagactattccttaaaattcaggaggaggaacttttccccaactcattctacaaggccagcatcatctggataccaaaacctagcagagacacaacaaaaaaagaaaacttcagagctatatccttgatgaatatcaagacaaaagccctcaacaaaatactggcaaaccgaatccagcagcacatcaaaaagataatccaccatgatcaagtagacttcatccccagaatgcaaggttggttcaacatacacaaagcaataaatatcactcatcacataaaaagaacaaaagacaaaaaccactattatctcaatagccacagaaaaggcttttgataaaattcaacacccgttcatgttaaaaacttctaataagctaagtattgaaggaacatacatcaaaataataagagccatctatgacaaacctacagccaacattatactgaaagggcaaaagctgcaagcattcccccttgaaaactggcacaagataagaatgctctcttgccacttctattcaacatcatattagaagtctaagccaaagcaatcacgcaagagaaagaaataaagggcatccaaataggaagagaggaagtcaaactatctctgttagcagatgacatgattctatatgtagaaaaccccatacccatagtcttagctcaaaagctccttcagctaataaacaactttaacaaaattttagtaaacaaaattgacttacaaaaatcactagtattcctacacaccaataacagccaaactgagagaaaaatcataaaggcaatctgattcacaattgccacaaaaagactaaaatgcttatgaacacagcttaccagaaaggagaaagatctctataacaagaattacaaaatgctgctcaaagaaatcagtgaagacgcaaacaaatggaaaaacatccaatgctcatagataggaagaatcagtatcattaaaatggccatactgcccaaagcaatttacagattcattgctatcctatcaaactaccaatgacattctttacagaactagagaaaatgattttaaaattcatttggaaccaaaatgagcctgaatagccaaggcaatcctaagcaaaaaaaaacaaagctggaagcatcacgttacccaacttcaaactatactacagaacacagttaccaaaacagcatggtacaaaaaaagacacgtagaccagtggaacagaagagaggcccagaaataaggccacacatctgcgaccatctgatcttttgacaaagctgacaaaaaataacaattgggaaaagactccctattcaataaatgatgctgggataactggccagccatgcacagacgattgactctggaccccttccttacaccatatacaaaaatcaagtcaagatgaattaaagacttaaatgtaaaaaccaaaactataaaaacactggaagaaaacctaggaaataccatcctggacataggaatgggcaaagatgtcaggacaaagacaccaaaagcaatcacaacaaaagcaaaatttgattaaacctaagagcttccacacagcaaaggaaactatcaacacagtaaacagacaacctacagatgggagaaaatatttgcaaactatgcatctgacaaaggtctgatataagaaacttataagcatctataagagacttaaacaaattgacaaaagaaaaacaaccccattaaaaagcaggtaaaggatatgaacacacttttcaaaagaagacatagatgtggccaactagcacataaagaaaagctcaataacactgatcattagagaaacgcaaatcaaaaccacagtgagataccatctcacaccagtcaaaatggctattactaaaaagtcaaaaaataacagatgctggcaaggttgcagagaaaaggaagcacttatatactgttggtaggagtgtaagttaattcagccattgtggaaagcagtatggtaattcctcaaagaactaaaagcagaactgccattcgacccagtaatcccattactgggtacatacccaaaggaatataaatcattctatcataaagacacatgtacacgaatgttcattgcagcatgattcacagcaaaaacatggaatcaacctaaatgtccatcaatgacagatttgatgaagaaaacaaggcacatattcaccatggaatattatgcagctataaaaaataatgagatcgtgtcttttgtgggaacgtggatggagctggaggctattatccttagtatactaacacagaaacagaaaaccaaataccacatattctcacttataagtgggagctaaatgacaagaacttataaacacaaagaagaaaacagtaaacactggactcttcttgagggtggagggtgggaaaagggagaggagcagaaaagataactactgggtaccaggcttaatacttgggtgattaaataatctgtacaacaaactcccatgccacaagtttacctatgtaataaaccttcacatgtacccctgtatctaaaaaaaggttaaaaaaaccacaaacactatgatggagaaggcaattctgcatagtgctatgctgtctaccatggcagccactggccacatgtcgctattgaacacgaaatatggttagtccagctacactataaatgtaaaatacacatcaaatttcaaggacttataactaaaacagaatgtaagatatctcattatgatgtttatattgattgcatattgaaatgatgatattttgcatacactgacttaactaaaattaatttcacctgttccttttactgtatgtagctactagaaaatttaaaattatctatttggctcacatattattgtagtttgcataatatttccataagatagtgctggctaataaaataaactgaatcatattttccagtatatagtaccacaaaaggtcatggtttttgtaccattaaatggttttcaggcattttaattgcttcttgctaaatcttatgtgagacatataagcatattcaaagtaaatattttggtacttctaggccaggcgcagtggctcacgcccataatcccagcactttgggaggctgagacaggcggttcacctgaggttgggagttcgagaccagcctgaccaacatggagaaaccccgtttctactaaaaatataaaatcagacgggtgtggtggcatatgcctgtaatcccagctactcaggaggctgaggcaggagaattgcttgaacctgggagtcagaggttgcagtgagccgagatcacaccattgcactccagcctgggcaacaacagtgaaactctgtctcaaaaaaaaaaaaagaaaaacaaaatatattgaccaggcctggtagtgcacacccgtagtcccagctattcaggaggctgtagtgggaggatgacttgagcctggaaggtcaaagctgcagtgagctgtgatcacatcactaccctctagcagcctgggtaagagagcaagaccctgccaaaaaataaaaataaaaacaaaataaaaagataaattaatatatttcaatggaaattgatttatgaatataagacagccaagatgatatgagggactcataactgattaacattgaagaaaaataggcaaaaattaaaattcagcttgttttagaaggaaaaaaatattgggagtttatcaaatatttaaaagaaacacatttgcaaactaatggccagtacttagtctcatatccttcctttctttcttccctctacttttcctccaaactgaacttcatatatttcctacaacaaacaacctatgtgattcctgctctgtgcctttgcacaggctcttacccctttctggaattcccaactccctcaactgtctaatgagtacctacttctccttcaaaagccagcttaagagctttctctcctctgaagcctgatccaccccaggggagttaaccacttactacttggtgctcttatagtacttagcattcatcagtattacagtttttatcatgttccatttcacgtacttgtctgtttgattctccttgacaactaagactgcagttgttagtactttgaaaccaccacttcttagcacagtgtttatagaagaattatgtaactagaaatgcagtaacaccaatagcattttaatttaaattttacagtttagctatctgttatagcccatacaaaatctgtcagaaaaatgtgttaaatctctctcaaaatccatcatatgtattcttgtgtttattatatatatacatatgtataatacatacatatatatacacacacacactatagtcatatagtcatatagtttctaggtggccatacctctcagtttgcttgagatgccttttgtagatcaattaaggtctgttgaccattttatgaatctttgtctctcagaagtaacgcagttttggccgggcacggtggcttacgcctgtaatcccagcactttgggaggccgaggcaggcagatcatctgaggtcaggagttcaagaccagcttggccaatgtgatgaaaccctgtctctactaaaaaatacaaaaattagccagctatggtggtgtacacatgtaatcccagctgctcgaaaggctgaggcaggagaaccacttgaacccaggaggcagaggttgcagcgagccaagattatgttactgcactccagcctaggtgacagagccagaccccatctcaggaaaaaaaaaaaaaaatgtatcccggtttggataacaaattacatgtttctcctaataattttctaaacattaccaatagtaaattaaattctctgtgaagccaaatattctgactatagttgctaacacaggataatatttcattgttcaagggctataaaaacaaccttttgatttttgctattaactgttgtagtgaataatgtggtgcttcacccagatttcctttataagggattcccttttcagctggaaataccagctgtgatggctcacatctcttttcctcactgggaacagtcctcagttgcaggaacctgcctcatccaaagttacagagctcctgggatgatatgccatcaatgattgacagttgcaggaattctaagggtccattcccccgtttcaatatgagacaattctgaaaggccatcccagctccaacactccccataggacagctaagatttccattgtaagttggcttctctgccaatctgcctttctttatatgtttccttatatgtttattttctgaaagactgtcccaacaaaacttttttgtactcaaatttactttcaagtctgttctagtgtatatgatctaagacaacaatcactcttcattctaccatcagctcccacctaggaactctactaggctcaggacccttatatttcgtccaagttagaactaatacttcatgccaggattcttgattcttactatattcctgtcatttctaccatttgacctagttttattttatgtaacaaacaactctgagtaaagtttaatgttaaaaaaccatagcaggaacttctaacatatgaggaatgcctaaacactagggagtaaaggaacccacttcttgggaaaggatcagttggaacaatccacaaagtgaatgactgacctgccccacaggtattagaaatcatggctgcctctgctggaaggcaaatgacaaagggctctcaggctttaagctctctggccaagaggatgtaacctttagggactttcacctctgtattgctctctgcttttcacctctgtattgattgctctctgcaagacttaagttttgacactttggaatattctccattactttatagttacttttattttacaaaaattatttcattctcctcctgtgctctggctctatctgattagtttcccttttattaaaaaagataaaaatggctgcctactttttattatttcagcttttcttactagttccgcaatcacatagcttgcatttctgtaggattctcacaattaatttttattattaagagagattagtacattagagcacaaagaagagatatatgagaatagtctgtttcctcaatagaggaacccagatgcctccttttccccaatgagcactgcacaagctcctcttaaaccccaaagtggatattctatgccagatctacgtgacaccaaacttaacttgtcaagaaggatttggaatcattatttaacagtcatctatggaattaaggaacatttagtagaggaataagactaggaacccagagcagctcagaaaaataatagctgaaacaataaagttatttccaaaacaattcacatatgcaaatacctgtgtaatacttagtccttaatttaggcacagaaaagaaatcagagaaaaaaaaagcattttgccaacttaaccagatccccactatttattatttctctcaactcccagcttgttgaatcatcagctcctatattccagcttcaatatctaaatccagcctctttcattgggatgattcctttatatcttcttggactttgactttatgctctaatcaatctgaccttggttgatatctctgtttttggcatatccactcttgcacagacctatataggatactatttatttcttttaagttatccagatatctgtaaactgaaaaacattatctctaaccaaatcaaccactcaaaaatcagttaccactacataataatgaaaacggttaagaatataaaaatgtaaagcatctagtacagtacacttgaggtgataatgacaattctcatatgcagtccatgccaaaaaaaaaaaaaaagaaaggaagggagggaggaagggcaagaaggaagggatggagggaaagggagggagggagggagggagggagggaaagaaggaaaaacataggctgaaaactgcctttacatttttagaattttaattctaacctgtctcttgtattcaaaaagccattgcatattgttcctcccaactgttttaccatatcatcataggaaataaaaataaattaattaattaaggctggaattatttccaaaatgcattttcaggagtgagatggaggtctatacaaaaggaaaaatcccataacatctcttttcgtgtaggctttatatgaattttcagaatttcccaagacatggaatgcattaaactcaagacacacaataaaacaggtttctgaataacaaagccagtccatttgattctttattcactcagcaaatacgtaatgagaaccaacaatgtgcttccacataaaacaccaagagaagaaacaagtgggtggatgagaggtccagaaatgcaaattagttcctgcatggagctcagatctgacttgtttactctagcagcattatctctcactcagttctaataatcccctatagtcatgtatcacctgaatattaactttactaataattatatgtcacctatctaacacatccaacccaactacaacaatatgatttcaacccagtcccagaaaaatatccatgcttggtgttatcttagaactcaaacatgatggctgcctacctacaattctattttcaccaattacagaaagatcaccatgtaaaaataattgatttcctgaagatcattcctttttcacagggcctcgttgctctgccccatttataaaaaaattccttaattatgttatacatcagagaagatgaactaggtctaaccagtcatagagatataacaaaatcagcagaaatatcttagaaatatatatatccctaagttttaaaagacaaaagctatattttttctgatcctaaatgtttcctggagtgtatttttaatgaataaaaatcctgttctagaatagggctggatgtggatccaaatgcagagattaagataaaaaagaatttatttctggatatttacattgatttccagaagagatttaatgctttgcaaaataagaccttttataacaggcagtccattgtataaatgtagtagatgcttgaaactcatttcagttaatgtcagagaggctgtttctccattacatggcatatacaacatgcaatcatttcattcactctttcatccaaaaatacaattcagctttttctaaattctatgcattgtgcctgaggcttgggataaaactaaacaaaacagacatgtgatctgcctgcacagagcttaaagtgtatgagggatgctgtctataatggattcgaaatgaaaggattgataatgattccaccaaagagactagggaagactagtattgatataatgttgtgagtctcccagagatgtccacattcaaattcccagaacctatgaatatgttacctgacatggcaagagggattttgcagatgtaattaaggttaagggccttcagatgggaggattatcctggataatctgggtggctcccactaatcacatgagtcctaaaaagaagagaatctttccaaggtgtggtcagagaaagagatgtgaggttggaagcagggtcagagaaacatgacgttgctggcttagaagatggaggcagagggccatgagccaaggaatgagggtgacctctagaaactggaaaaggcaaaaataatggactcttccctagagactccagaaaataatgcattcctccaacaatttgatttttactccagtgaggcccaggtcagacttttgattacagagctgaaagacagaaatttgtgtggtttaagacactaagtgtgtggtaatttgttacagcagcaatagaaaactaaccaaacatatatacatatgtatccactcatataaatttaacaggacagtatatattagggcaaacatacataatcaatagtgttaagtggttgtctgttttgtccgttatagacccatctcatctcatttcttgctaatttcttcttaatgtgacaagacattgaacttattgaacgttgagattccattttaaaaaatgatcaagacttgctgatctgtttaaggaactgaatttatttagactcagaggagtcatatggttgtgtggactgagcctgagacaaacataagctgcattcatttctcattgcggaactgctctggctggacgcaacagatttgcaaaatttaagccaatctctgaagtccccttcacctaaaagactcacaggttttgatgaattaatcactttcagttttcatgcttatcatcaagcatttgctccatcagcacagctcaattacaaaagctactgactgatctgaaaaacaactgggtccaccaaaggagacacagtattccttaaaatagaaagatgaggacttaagtattagagccatcccaagtctttgagcaaacggtgagcaaggtttgagttcagctagttccagaaaaatgcattccctttcattaaaactgatgcaacagctataaagaagcattatttgtgatagaaacctggagtgacagtaaacctggggatgagatacaataatacactccacagttttccaggttggttcctgctacttaattacacttaattacaatattcattagttcagtccaatttgctcagtttaagaaaaccataaaatcaccattattttgatgtgatatgtgtttattatacacaggggcagcttcagggacctgctactgcacataggatcccaattttagacaggggtcccaggcttgggttttcatgctctgctaccacagtcttgaattttttaacaattttacctgtgaatctgtgtagtccaatgcagcaatgaagcacatgtcttggctcatatgcagtcctgcctccgagtgacttcctgggataggtcctcagccacctgttctcccacccagtgattactgccaccctttattccttgtgggggccttggcacaccctggggtgggtcagggtcatttggtggggccacagatgcctgtgagggtctgcagtcactttataagtacctctatactctagaaatctaacattaaatagcaaataaaaataacctttcataggtcatagtctctcgtgacctatatgtcacgagacatatagtcactttataagtacctctttatatagtcactttataagtacctctttatatagtcactttataagtacctctatactctagaaatctaacattaaatagcaaacaaaaataacctttcataggtcacgagagactgtgtaagaaagctacagttcctttctcctgctttttgaacaagaagcctcacattttcattttgtattaggccccacaaattacgtggccaaccttacctatgtatgtgggtaagtgtgcacatgtatatatatctgaatttgtacctataaagaataaaataactttctattttagataaattgaacttacaattttataatttctaggaaaaataaatgtatatataactttactatattttatctgtaaagaggaaaataataattgtaacagtttgcatatcatgaaagaaggcatttcaataaaatattatcttctaagttttttatgactgatgaattaccttgaaaaatctttaagaatatattatatgctaaaaatggggatattctagcttcaggcattctaggacatgtcatgtctaggacatgacaatactaaaattttcttattaaagaaatctaccttacaactttgatttatcgacaggtgagagatttctggtcaggaaccaaagtcatcaaatattaagagtatgaagatacatcaaatgtgttgaagggtcttcaaaatgcaccaaataattttagtgcatttcaattattcacataattgaacaatctcaaatatcttaaattcatacctgaaaagtcataccctttgtaactaatcattctcaaaacacacctacatgaatcttgaattcttctatttataataatgcagatgaacaaaatattgctattataactttcattttgtttagctctattatttaaggaatcttcataatcaatatataattgaaaatatattcaagatttttctcttcactttataaatattaccaagatttgaggggaacaatagttacagacattccatagatgaagagatatgtatttcatatatatgtataaatacagtgaaacaaaatggactttgaaacaaatatttttgccctaaatttagacatttacaatatttctgatagctaaaacttcaaaaaaaaaaaaaaaaaaaactagacactgtcacatttgaaaaagattaagagctgccaaaactacgtgggtgcctgtaatcccagcactttgggaggccaaggtgggagggtcacttgagcccagtagtttgacaccagtctgggcattatggcaaaaccccatctctacaaaaactacaaaaattagctgggcatggtaacacacctgtagtccaagctacttgggaggctgaggtagaaggatcatatgagcccaggagttcgaggctgccattagctgtgattgcccaactgcacttgagcctgggcaacagatcaagaccctgtctatctccataaaacaacaacaacaaaaaaacataacaacctgcatgggctctttacacgccttcaaacatagctcatgatccctgtaatatcactgttattggatactaacttctaatggcctttcattattcactaacttgatcctgagcaatctgcccctctctttatcttctttatatttcttaaattgatgtgcaactctagtttcctttctccaatcctgattcccttcttcaactaatagtgagatacttccacaaacaaaacaatcacctgtaaatacccttctggttctgatctcatccctagaaattcccagggttgttgttccctgtaaataaccaagcagaactcacttagaaaatcaacctatgtaaaatcacatactcatttgtaatttaccctattttgtatacggaaagtatctcagcctatattcaaagtacaagggaagaggggctagggatgggaaggcaaaccagtcacctacgttgttcatgtactctgaaagcagatcctgaagagcctggcgaatggcgttgcattctgcgataatccgctctcggtgtaagtccctcgtacatgaagaatccgccagcagagcagccccactgataatggcttcaaggcgtttctctagtgatggtcgtatttcctcctcagttactgtgagtggattcaggacaattaaattctaagagaagaacacatttgtatggttagagctccatggcatttcacttttatgaaaaacaaatgttattttgtttttgcatttagaattcagatgtgataataaagagaactgtgttttactgcctcggctggttcacacataatgctatgtagtgattattattctgataaataatgaaagtgatgcaattatgagcttttgttctagcctcagacagacctggattcaaatcttacatttctccctcatgcaggtgtcatacacttgctgagcctcaacctcttgatctataaaagcagaatattaatgttgcgtgtgttgtaaaactgttgtaagaatgatataaatgcttaatacactgactggagcatattaactgttatttacaatagtaacttttatagactgcactgtttatacaatattttcatgtatctcatcctgacagcaccatgaggaagtaggcagcaaagtattaataactacacatttcagctgatgatgagtgaggctgaaaggctgtcttacccaaggtcatagagcaaataaacagtgacgttcagacaagtatccatgtctttcaataccagatttaatattattttcattatgcctcactttaaatcataaactttagttaactttaacactaacatatcaaagtaaattctgaattttaattatttaatttaaaacaaaactgcttcttcctgttgatctattataacttccagctatttccagctattagaacctgacacggtatttttaaggtttccattagacatatcttcaggtaatagaagtcgagataatctacagcctcttaagaaaagatggaaggtatatgctgctctaagggtcttttattaaaatactccaagagaggaagtctttccaagattaggcataatgtgagaattgaagaaagagatagtgtagaataaaagctctctgaagaacccttaacatgaaatgcaatcacataatgatcttcagagtgtgaaattctgagtgtgaatctacacacaaacacactgtgaagatattataagatcttcctagtatataatcttatgtataagattatagatatgtatatgtattttatataggtagaggtgtttaagtatgtaaataagtatatgtgtgtgtgtttatatataaaatcttatacttatcattgtgttacattacattctgataaatatttggggattgaaagtagccaggatacaattttaaaagccacaactgcagagtcaagctaggaagaaaaaattattatagaaaaagatatagttttaaaacattttttttaaaaaaacagcactgtgtaatgttcccttactataaaatgtgaggggttttgagtgagtttcttaatcctgagtcatgagtgaactcccattcacaattgctacaaagagaataaaatacctaggaatccaacttacaagggatgtgaaggacctcttcaaggagaactacaaaccactgctcaatgaaataaaagaggatacaaacaaatggaagaactttccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcagcaagtcaatcctaagccaaaagaataaagctggaggcatcacgctacctgactttaaactacaccacaaggctacagtaaccaaaacagcatggtactggtaccaaaacagagatatagaccaatggaacagaacagaggcctcagaaataaagccaatctacaaccatctgatctttgacaaacctgagaaaaacaagcaatggggaaaggattccctatttaataaatggtgctgggaaaacgggctagccatatgtagaaagctgaaactggatcccttccttacaccttatacaaaaattaattcaagaaggattaaagacttacatgttagacctaaaaccataaaaaccctagaagaaaacctaggcaataccattcaggacataggcatgggcaaggacttcatgtctaaaacaccaaaagcaatggcaacaaaagtcaaaattgacaaatgggatctaattaaactaaagagcttctgcacagcaaaagaaactaccatcagagtgaacaggcaacctacagaatgggagaaaatttttgcaatctactcatgtaacaaagggctaatatccagaatctacaatgaactccaacacatttacaagaaaaaaacaaacaaccccatcaacaactgggcaaaggatatgaacagacacttctcaaaagaagacatttatgcagccaaaagacacatgaaaaaatgctcatcatcactggccatcagagaaatgcaaatcaaaaccacaatgagatgccatctcacaccagttagaatggcgatcattaaaaattcaagaaacaacaggtgctggagaggatatggagaaacaggaacacttttacactgttggtggaactgtaaactagttcaaccatcatggaagtcagtgtggtgattcctcagggatctagaactacaaataccatttgacccagccatcccattactgggtatatacccaaaggattataaaacatgctgctataaaaacacatgcacatgtatgtttattgcggcactattcacaatagcaaagacgtggaaccaacccaaatgtccaacaattgtagactggattaagaaaatgtggcacatatacaccatggaatactatgcagccataaaaaatgatgagttcatgtcctttgtagggacatggatgaagctggaaaccatcattgtcagcaaactatcgcaaggacaaaaaaccaaacaccgcatgctctcactcataggtgggaattgaacaatgagaacacatggacacaggaaggggaacatcacacactggggcctgttgtggggtgggaggaggggggagggatagcattaggagatatacctaatgttaaatgacgagttaatgggtgcagcacaccaacatggcacatgtatacatatgtaactaacctgcatgttgtacacatataccctaaaacttaaagtataattaaaaaataaataaataaaaaataaaatgtgagggtactccaaaaagttcacgtaaaaagtggagttaaaatataaaaataaaaaatgtaaactttatttctcaacgtaagctccatcaagttcaagaaatttatgcaagtgatgataccagctatttagtctacctctaaagaactgaaggttctgggaattcaactatgtcaatgcagtcttttttacattattaactgaagaaaaataggtgccctttacaatttttttaagattaggaaacaaaaaggagtcagaaggagccaaatcgggactgtaacatggaagcctaataatttcctatgcaaatcttgcaaaattgcccttgtttaataagaggaatgagcacaagtattattgtgatggagaaggactctctggtgaagctttcctaagcatttttctgctaacgctttggccaactttcttaaaacactcttataataagtagttatcattctttggcctcccagcaagttaacagacaaaatgtcttgagaatcccaaacactattaccatgacctttgctcttgactggtccaattttgcttcgactcgattacttccaactcttggtagccattgctttgactgtgctgtgccttagggatcgtagtggtaaagccatgttccatctccttttacatttctttggagagatgcttcaggatcttgatatcaattgtttaaaaaatttctattgaaagctctgctcttatctgcagcttctcccggagcaacatttttgacactcatcaagtagaaagttggctcaactttaatattttagtcagaactgtataagctgaagcaattgagatgtctatggtgttggctattgtttgtgctgttaattgtcagtccttttcaattaagacatgaacaagattaatttttttcccacaaattgatgtggatgttctgccaccttgagcttcatctttgacatcatctcatcccttactaaaatgagttacccacttgtaaactgctgatttctttgaggcattgtccctataaaccttttataaagcatcaatgattttaccattcttttgcccagtcttcaccacatatttgatgtttgttcttgcttcatttttatcagaattcacattgctgatagaggttcttcaaactgatgttttatctttctcagtgcctcaaaataaatcccattctgacatgttacaacaagttagtatgagtttattttggtggaaaaaatgttgaaatccatgcatagttttttataatacacattcttcatgaactttttgaaggccccttatataatgtaaaatgtaaactagaatatagatctgatataaaattggttaaatatcttaaaagcatgcaggagaattcttcctttcctgactgttttcttcctatttttctttttttcttttctttttttgttttttagatggagtctcactctgttgccaggcttgagtgcagtggcgcgatctcggctcactgcaacctctacccccaaattcaagcgactctcttgcctcagcctcccaagtagctgggactacaggtacacgtcaccacatccagctaatttttatatttttagtagagagagggtttcaccatgttggccaggatggtctcgatctcttgaccacatgatccgcctgcctcggcctcccaaagtgctgggattacaggtgtgagccatcacggccggcctttttttcctttttttctatgcctctattgagtctctccatttttctgtcttacatgggcaaaaaaatttttaaaaacatgaaaggaaattaactttacaaaaagcaaatttaacatttctttttctttacccagtagatattatttttgatgaaaccataatccctacaatggggctggccatcagttaaggcttcattcatctaagtcttcctccttatttcatttgccacttttaccacatctttctttggcccactcatttagtacaaactttccactacaatgtttcataacaaaaattaaaccatttaggccaggtgcagtggctcacacctgtaatcccagcattttgggaggttgaggtgggcggatcacaaggttaggagttcaagaccagcctggccaacatggtgaaacactgtctctactaaaaatacaaaaattagctaggcatggtggcatgtgtctgtaatcccagctacttgggagattgaggcaggagaattgcttgaaccgggacccaggaggcagaagttgcagtgagccgagatcacaccagtgtactccagcctagactacagagcaagactccgtctcacaaaaaaaaaaaaaaaaaaattaaaccatttaaaacctttttggaaatgtacttccagtgtggcatcattaagaaaagactatgcaggcaatagaattgctctttaattgctctaatgtaattagaagatgtgatagaaacagtgaatatgtctccagcattgtgacaataggaaaaaactgattacatttcaaatctgtttgctgtaagtactgcaagaaaaaactgccgtgatttttggcagttctggcttttttgccatgttctagctgtgatttcatgttagtaaatagcctatattgtagaattaagttcactctagcttctgctctacaggttcattcctcaaactatctcagcatttggaattttacatgcttgacttttaagacttccgattcttcaagctcatctgaactcaaaccgttgtctgttctgacatctgacacctataggcaggtctcttgattttgcctgaaacaactgtcctactattccaacctactaaagttttcactaaccttgtcactgaatcaataaaaaggcaagaattttttaaagtaaatcaaatgtcctgtgaaatggcactggatttgtttaagaccaactgaaataagtttttacctcttccgatgcacaatagctatgttaaaacagcatttcagtgtgtttcatggcattaatcccatgaaagacaatcaataggatattgttttttcaggatgccactccattgaaatagaaaatatttttccttttttaaggttccactcaatgtatacttacctccttaataatttgattgctgacagaacattattttttaaatataattaagagtcccaactccatattcttctattatattattttgtttaaaagagtaagtatagctagaaatttagaacccaggtcttagaagcagatagcctgggtttgaatcctggcgcatagctataaacaaatatatttgtattgatatcatcctctatatttttatctctctctggagagcttataatttatttgattaataaatttattccttatttttcttcctaccacttcttttcaaaattaaagactttaagtaacttacccaagatcactcagctagtaagtagcagagggaagagtctgtccaaatctgtctacttccagttccatgctataactaccatgcaatgctgcttttgttatcttatttaaccattaccaaccattttgtggggtattatcatcattaatttatacatgtgaaaaccgagagtgagcaagattaagtaagttgtctaataatccccttaaaagagaagatataggattcaaatccaattttatgtaagtaccaaatccatacactttctaccactctggggaaactgagatgagaccacctggcaaacttcttcattcacctgagtctcattatgtttttccactcatttcttctcctccttgtcttcaaggaagacatagtctttctctctcatcattttctttctctctctttatctctctctctttctttctctctctcttatctcccctttgtttctttcttttttgaaaaaaatttgaggaatgtctcactctgtcacccaggctgagtgcagttgtgcaatgatggctcactgcagccttgacctccccaactcaggtgatcttcccaactcagcctccgcagtaactggaatcacaggtgtgtgccaccccacccagctagtttttgtaatttttgtagagatggggtttcaccatgttgcccaggctggtctcaaactcctgagttcaggcaatccacctgccttgacctcccacagtgctggaattataggtgtaagccactgtgcccagtgttcccctttattttcaaggctatcttctcctcatcacaaaccccaagtactcttcaacttttccttccttacattctgagtctcttaaagagcctactctgtgccaggtactgtgctaggaattggtaatagaatggtgagcatccctgccctcctcacagggctcacatctcagaacttaacactattaaccaagaaaatcacaaaaatacgtaactacaatgtggatgtgttgtataaataaaaagagtagttagttaagcacagattgaccagacgtaagtctggacaattaaatgcagaatcaaaatggttaaaggcaaagtagggctaagcacagtggctcacgcctgtaatcccagcactttgggaggcacagatgagccaattgcttgagcccaggagttcaacatcagcctgggcaacatagtgaaacccgtttctacaaaaaatataaaagttagctgggcaaggtggcacatccctgtattcccagctacttgggaggctgaggtaggaggatcatttgagcctggcaaaccagtcattcacagaattcttagggagggatttagatccatagaacatggaattgaaagctacaggtaatcttgatgacaaagatgtagagaaaaggggaatccttgtatgctgctggtagaaatataaattgatacagctatcatgaaaaacagctggaggttccttaaaaaattgaaaatagaactatcatataatcagcaatcccactactgtgtatatatccaagggaaatgaaatcagtatatcaaagagatatatgtactctcatgttcactgcaccattattcataatagccaagatatggaatcaccctaaatgtctaccaatggccaaatggataaagaaaatgtagtatatatgcaatggaatactattcagcctttaaaaagaaaacaatctgcagggtgcaacgagtcatgcctataattgcaacattttgggaggctgaggtgggtggctggtggctggtttgagtccaggagttcaagaccagcctgggcaacatggcaaaatctcatctctacaaaacatacaaaaattagccaggcgtggtggcgcatgcctgtagttccagctactcgggagactgaggtgggagaattgcttgagcccaagaagtcgaggttgtggtgagctgtgagcatgctgctacactccagcctgggtgacagagcgagaccctgtcaaacaaacaaacaaacaacaacaacaacaaaaaaaaaaacagaaaattctgtcatttgcagcaagatggataagcctagaagacattatgttatgtgaaataagccatgcacagaaatacaaataccacatgatctcacttgtatgtaaaatccaaaagaatctaactcggacacagagtggagtggtggttaccaggggctagggggcagggacaggattcaggagatgctggtcaaaagattcaaaattttactttgacaggaggaataaatacaagaaatctattgcataacttggtaactatagttaataataatgtactgtgtacttgaaaattgctgagagtagatattaagtgttcttaccacaaaaaaataagtatgtgaggtagtgcatatgttagtttcatttagccactgcataatgtgtatgtatttcaaaacatcatgttatacaccacaaatatacataatttttattcactaatttaaaaaattttaaatgaactgctaaaaaacagtctggatgtgatcttatccagattttatgttatcaagtcttcctgaacaggcatcagcattataattatacagctagaagcagaaagactgaaacttgaaaacaagtcaaagagaagacaggtactttacatctgagtaaacaaaaaaactgcatcaaaggtagggaagggatctgtgaaaccaggagaatacatatttcattcatctataggagttttaaaaaatctgacactatgacggaatgattaaaattaaaataaattgcaaatatcaatattttaaaatacaaaagatgtataccacccacagaatggaagtatgagaaccaattcaaatagtgatgtggggaatgtcttatattaaatcatttaatggagaatatgtagtttacgtaggcattgctgatcatttttctttttggttgtagcctaaaggctatcttccagaaaataacttataaggattattttaatcaatatgacttacagtgaaagaaaactctatggcctctagaaacagaaataattgctacattttgagaagactgagatcatggctctacatgtatttgagtgaacaatgtgggatgaatctatatataatagcttgaaaaattgccagaatatatgataaaataaaaaacagaagtggcaggatgatatatataatgatatcatatatatttttaaaacgagcacacaacaacactttgtattttctctgagtgcatatgtgtatatgagagcctaggaaaaggtctaaaggaaacataccaataccatagcaattattattttggggggaggatgagacaagaacccaaactggggtagtaaagttttaattttttaataactaggcttcatttcatattacttataaaaatacaaagtaattaaaaattcaaattcttaaattttaaaaaagataattatggaccaaacgtttattactcttttagattcaagtattaatcaactaattattttggaatcaaatagacaaaatgctttctttgtttaccagaatgaatataatattatttttaaattaatcagttgcaagaatttcaattttattatgttaggtttacactgtttaaactattacaaatatgtttggctaatatatgtcttttaaaaaataaagacatcaagagagtgaaaaaacaagacacagactgggagacaatatttgtaaaaggcatatccgataaacgatattatccaaaacatatgaaggattcttaaaactcaactataaataaatagcctcatttttaaaaataggccaatgaccttaacagataattcacttaaacatatatacagatagaaaataagcatatgaaaataagcataagtcataagggagatgcaaagtaaaacagtaatgagataccactacacatctattagaatggccaaattccaggacactgacaacaccaaatgctggcaagaatgtggagtaataaaaactctaattcactgctgataggaatgcaaagtgataaagccactttgaaaaacagtttggcggtttcttacaaaattaaacatattgtcccactctcaccatttccacttaatatattcctggaagtcctagccagagcaattaagcaagaagaagaaataaaaggcatacaaatcaggaaaaaaagaagtaaaattttctctgtttgcagattatataatattatgtatagaaaacccaaagactcaaccaaaaacctattataactagtaaacaaatccaataaagttgcaggatacaaaaccaaagtacaaaaatcagttgcatttctgtatgctaacaacaaactatctgaaaaagaaagaaaacaatgcaatgtatattagcatcaaaaatataaaccacttagaaacaaatttaaccacagatttgaaagatctgtggttacattaaaaattacaaggcattgatgaaaaaaattgaagacacaaacaaatgaaaaagtaccctgatgttcatggattaaaataattagtactgttaaatgtctatattacccaaagtgatctatagagtcaaaacaatctatgtcaaaattctaacagtattcttcaaagaaatagaaaaaacaatcctaacattcatataaaaccacaaaagaccacaaatagccaaagcaatcttaagaacaaaactggagggatcacacttcctgatttcaaagtacattacaaagctatagcaatcaaaacagtatagtactagcataaaaacatacacaaacaccatttgaatagaattaagagcccaggaataaacccacacatatacagtcaactaatattctgtaaaagcacaatggggaaagaatagtctcttcaataaatggtgctgggaaaactgaatatttacagacaaaaataaaataaaattcgacccttatctacaccactcacaaaaattaacttgaaatggataaaagacataactgtaatgcctgaaactgtaaaactcctagaagaaaacatagggtaaaagattcttgacattggtctcaacaatgtctttttagatgacaccaaaagcacatgcaacaaaagcaaaaagatttaagtgggactacttataaaaatcttcttcttctgcaaaaaatcttctgcaaagcaaagcaaacaaccaaaaacatgaaaaggcaacacacagaaagaatgggagaaaatatttgtagaccatgtattcaataaggagttaatatctaaaatatagtaggaagtcataccactcaataacaatataataataataatccaattaaaaataagtaaaggcgctgaatatacatttctgaaaaagaaaacatacaaaaggccaatagtgcattaaaagatcttcaatagcactgatcatcaagggaaatgcaactcaaaaccacagtgagatattacctcacacctgttaggatggatattattaaaaagacaagagataatatttgagacgatgtggagaaaagggaacttttgcacactgctggtgggaatgtaaattgatacagtcataatgaaaaaaagtggggagattcctcaaaaattaaaaatacaactaccaaaagatctagcaattccacttctgaatttatatctgaaggaattaagtagcttgaaaagacatctgcactcccacattcattccatcattatcacaatagccaaaacatggcaactacctaagcatctgcagatgaatgaatgaataaagaaatggtcatatatatgtatatatacaaccacttacaatagaatagtattcagctataagaaatgaagaaaatcttgccatttgtggatgaacctggagggcattttgctaagtgaaataagccaaacacagaaagacaaatacaatatgataccacttatatgtaaaatcaaactgttttgattttacataaatcataaaaacagagtgaagcagcagttgccacagatgagagggtgtgggaaatggggagatgttgaccagtgggggcaaactttcagttataagataaataagttctggggatctaatgtacaacatagatggtaattggtatgttaattaatatgattggggtaatcattacacaatgcacatgtatatcaaatcatcacattgtgtacctttaatatataccttctttgtcaattgaatatttaaaattgttttaattcaaattttaaaaactaaacataattttcctaaaccttttaagtcggagtacctgtgcaggtttgttatataggtaaacttgtgtcatgagggtttgttttacagattattttgtcaccaggtattaagcctaatactcattcattattttcctgaacctctccctcctcccaccctccaccctctattaggcaccagtgcctgttgtttccctttatgtgttctcatcatttagctcccacttataaatgagagaatgcagtatttggttttctgttactgctccagtttgcttagaataatggcctccagctccatccatgttcctgcaaaggacataatctcactctttttatggctgcatagtattccatgatatatatgtatgagattttctttatccagcctatcattggtgggcatttagtttgattctatgtctttgctattgtgaatagtgccgcaatgaacatatgtgtgcatgtgtctttatgacagaacaatttatattcctttgggtcaaaatgaatttctgttttttaggtattgaggaattgacacactactttccacaatggttgaactaatttaggctcccactagctgtgtataagtgttccctttgctccacaacctcgccaacatctgttatttttttactttttaatactagcctttctgactggtgtgagatatctcattgtggttttgatttgcatttctctaagatcagtgatgctgagcttttttaaaactatgtttgttggctacatgtatgccttcttttgaaatgtgtctgttcatgtcctttgcccactttttaatggggttgtttgaaaaacaaactaaacatactttacaatataacccagcaattgcacttcttggtatttgcccaaagtagtcaaaaacatgtccacacaaaaaccttcacatggatgtttatagcagctttattcataattgccaaaacttggacgcaaccaagaggtcctttagtaggtaaatggataaactgtggtacatccagacaatggaatattactcagcactaaaaagaaatgagataccaaaccacaaaaagacatagaggaaacttaaatgcatattactacatgaaagaatccaatatgaaaatgctgcatcctatgtaattccaactacagtatatgacattctgaaaagggaaaaactatggagacagtaagaagtcagtggttgccagtagttagcaaggagggatggaggaacaggcagagaacagaggatttttaaagcagtaaaaatactctacatgatactaatggtggatgaattttattatacatttttccaagcccacagaacgtacaacaccaagagtgaactctaatataaactagggattgtgggtgataacaacgtgtcagtttagttcatcaattgtaacatttgggggatattgataatggggaggccatccatgtgtaggagcaggggatcagaacacaatgaggggaatctctgtaagtttctctcaattttgctgtgaatctaaaactgctctaaaataaagtcttaaaaataagaaaaaaattagtattacagaaaagtcttctagtctttaatactaaaaggctgaaagccttttatttaatactaatattccctataaggaatctgtactccatgaaaggttgctgattttatatcttaggatgggaagaatcaaaatgtgtctggaatatctggtggccactaaccaaaatcacttaaaattagcagggatgatagcaaaagaacaaaggagtccagtccatttaaaggggctcctactatttaattcctgataaattgagtattatttagacatattgagtctggggagccattaattcataatgctactcaaaaggtaaattatgaaaatgtttttactaatgaaataaatatggatacttatctttaagaaaattagaagaaaataaagacatatgatctaaaatagcagggctctcttattcagtggagctctggagtcagaaaaactgaacatgaattttggccccctactcacattgggaaagtggtttaagctgctgaagcctttattccatccctggtagaatgaggaaaataaaatctacacctaccatacaggactttacttaatgtagctttataacatgttttaatatcgggggcggggggcgggtaggctccacctcagtggtctccttgctaatgttattttttgcatttaaatgcactaccatctatacctgatgaataaagccatagacccatatgaaggaagcagcttttcctaaacagaacactccaatataccatacagatgtgtatcgttccaccaatatttattaatcatccaatatatttcagattctgaacaaggctgtgaccatgccttaccaggacatgtagaacttatacacagtcttaaacaagctgaagcacaaaatcaatattttggttggaaaaagttttctgtattttaataacatgatggaataaatgctattcatcattcacatactctatattctctgatgggattgacctgatttacactgaaaatactaaaaatcttacacctattctccaaagtgaaattgcctatcaaatgagatgcagctacaattataatcaagtaccaacattcttcacaaaaacacatgctatgcttcacgttgagagcagcagaaataataagcacacagcataagtaatgtttctcaagcaactatattatcaatcttcagaatgagtgataaaaatggaatgaaatttttccttatgattaccaatagaaaatgctattgagagagctcatagactcccttttgtctagtatatttcctgttttaatgcatttctacttaatctaaagaatagaagctttagatataaaaaaaattttaagaaggcaaaatgtgaacaataaactaaattagcaagatgatcaatacaaattatttatagtactttggtacattagtgtaatctacacatacaaatctaaatacatacttagctatagtaagtcaaagagtacataacttgcattttgttgtgtatcaattagcacaacagaaaaaaagaaaatattttagagatactcaatatacttatcaattaaatataatacatacagactcctttaaaaatcttgtaagtaatgaacatattacatttaaatggccctaatactgtaatgatggttaaaccagaacagtgataaaaatttcactcatctgatttcactcatttcacctaaggtagtaacgtcttctcctaggcatatttctgtcagttaagcaaaccagcctatgcacagcaccacacatcatgaattctttcagttttttatctttttatatcaataatatgataaactttgaaggattctcctactttcacaatctctgtataaaagaatagtaacataagcacctccaggaatctgttgattttgttgtgatattgaatattatattgaattaatcttaccataatattatagactgaggcaatatatattaatgaaagagtccttgtgtgattatctgtttggaaatatgtgtttacatgtttgtgttttacatggtctgtatttaaaatgtgtaaaaaatcctaaaaatatagacgcaatggtgattaacttattctgtctacattgaacttagagaaaatacagatgatttttatacacaataagattgtcattaaaactaaagtatatgccccaatatttttaagtatattaaatcttaatttctcagtaacatcatgtgtgtcccaccttctatgtccatgaggcttatgattccaagcctaaatgacaacaaatctgcaaaatttaaacaaacatttgaatagttcctgtcatttccgaggtttatgtcaattgttattcctgtggagttctcccagaaaacaattcatcgacaaagaagaaaagaaaaggtacacagggggcaagtggaaaaaataagtaatcccaattgtgctctatttctgtttgattctacctttcacttctgtctataatgatgtcctttgggagaaatagcaggttaagtacaagccctggattcatgggtgaattgtgcatagtagagcattaaaaaaaagtagctgatatggtgcagtcttaccttgcaactgtaaaattctcaaagtcatatctgctgtagaattccttaacaatgatgagtgtgaaaatgactgctgggtggtgacagtttctcaataacagcatccttcagatgttcttgatgtggtccctgaggtcttccccatattctctagagcactgctgtttaaggattgtgggtattctgaacattttgaaattacaaccaactaaagatgttcttggtatgaaaagagttaaaaatctgctcttttcctggagtttaatatccagttaaatagaaattaactcaaatgtttctaagtcattttccagttaactagggcttaagaaaaaaaaattgctgtagtcactgtgtttaaaattttactttaggacgtattagcctataagtgccacaaaatcatcattttggagtctacataaagctacattgtcttggtaagaaattgcaaagaaactgtattgactctaaagtacactctggagtactgcccaaaagagcaatctatgttgatgaaaattttctgtatctacaatggtcaacacagtagctactcaacatctgaaatttggatagtacaagtaagaaactgaatttttagtttatttaattatgattaatttaattttaaattgaaaagccacatgtgagtagtggctactatattgaacagcacagctcttaaagttgattttcactgtattttccatatgagattatgtcatgatatgttgtgatatcctttaggtatctaggtggttgatggttgattgattgtgattaaaagcactatttccctaagcaagtgggtatctttggagaaagcactggtggaggataaaagtttaagctgttgccagtcacgaaggtcttactttatcaggtccttttccctaacaactagttgagaatgagttagactaaaaaagaggcagctccagagaatatgagtcacagtgtggaaggacaagaagcaagtcttatgtggctaggatatagagatactgagcatcagtgggaagacagggaaaagatactctgagaaaaaagaattctgagaaggaaaatggaaaggacaatcaaaggcaacattcatctatttcacagtttaattcattctgctctgttttatatccttctctttttattaatgaaggatgttgctggtgctgttctcatagggtgtcgatgcaagactgaaaatgtcagtccctggcttaatatcctttccaaattgagaagacctgtagaaaaaatcaactgttcgtgcattttacactgtttggatctttttgctttgctagttatgtaatgacatacacaaaagttggtcagaaaaatgttaaaccaacatcattccttctgctatgctttgatatttatagtctttaaagtttttaccaaagagccttattttttcccttggtgctttatcaatatgatttacatttttcatcctattaaggaacaagaacatgtgcaatataaggaggagggggagatggaggaggagaaaggaaggagagaaagaggagggagatgtaaaaaaaataaggtaaagggggaagggaaagagaaaaggggatggaaggagagttgagaaggggactgacaggatagaagaggaggaactgggaaaagagagaaagtgacaaaaaaagaaagtgaaagtaaagaaacagtttgctaaacactcttgtgtcattcacactgcaagtaataaaaccaatacgcttctgtgtttcatgattcaagagaacatttaagtgataaagggataactgtggaggtacctgacaactttgccaaataaaaatccagctttcatcactatagaaaattttaaatggctacaagttttttttgtttttcctttttgttgttgttgttgttgtttttccagatggagtttcgctctgttgcccaggctggaatgcagtggcgcattcttggctctctgcaacctccgcctcccgagttcaagcgattcttcttcctgagcctcccaagtagctgggactacaggcgcatgccaccacgcctggctaattttttgtatttttagtagagacagggtttcaccgtgttagccaggatggtctcaatctcctgacctcatattccacccacctcggcctcccaaagtgctgggattacagacgtgaaggtttttgtatttttataaagtgcaggtgttcagcatgtcccttcctgaactttacaatattcacatagctttggcaaatgggatgcaaaacaacattcagaatgaaattaatgttgaaagagtagtatcatctacataactagactatttttcaagtagatattgacgttatgcagtgggatgtgctattaaagagcataaactatatcctttaaatttaacaatacataattccatcaagaaaaatcccatcactgaacaccgctccagacttttcttatcaggatattataaaacactagttaactactacgaataccaagcaaaagtatggtaagaatactttgccccttttctttgcagacaggaaaaagcaattgaatatgaaggccaaaatctctgagaaggagtgctttatctagagagacaagcaggggcacatatcacaatagcgaacaggagagatatattgggtcctgatgaaaactaatataggaagaaattggctgaattttttctgtaccctgtatgagaaatgattaaatttaaagggtttttaaattaacttacttgtgaccttgcctgctattccatatttgaagatctggtggggggaaagtatgtagaaacttcaaaatatgctcaggaatgcatgaataaaaaaatagaaattcttactattgataaaaagagaagagaatccaacttctcaatttaaggggacttttaaaataaagaaaggcagtttaatactccctaaagaaggcataaaattcctatagaaccaagattcttggttgatactgcctctgcatcagcaccaaaaattatccctctaaacatcggtggttccaaggaggctccttggtaaattgtagcctgcctgaatgaggtaaagtgatcccatctccaaatcaacccataccaggaaggccaggaataggagtctgtatcaagtcaaaattctttaatgccttcccatgctcaagccatgacctgcaaagatgcccacaagtcatataccaggtagacaatactgctcagcctactgccctttcctcattaactccctaaagcccaaaagacagtcacgcatgcacttttctttccgtttcacaaaaacaactgtaatgtgaacaccatacacattataccttgttacaaatattttaagccctatatttaagttagaaatattaagacttagaaattcctaagtattagaaaatatcaactaaaacagactattctcactatcttcagtttgatgtgtctcagtatgtgtttcctcctgttttttcatcaaagggtcaattgaccccaacggatgctctctctgtctctgggtcactcatctgtttggctgtatctatttattacattgcttcatccatcaccggagttcctactctgcattgggcctccctccctgtccataagactgactcaacactcacatgactaagatagtaatgtgaggaaaaaaatattgtcagactcattctaggcattgaagaagcaagccactatgcctgttagagacagcatggtttccacgtgaaacaaataggattagtctacctcctataatgcaactacctttttcaaaactcatggatattgtcaggctgcttaacaaatataacctccagcagctgcagagcagatccatgcatctgtacagtacatgtttgcacatactccttttccatctgcaggacatgacatatgccaattgattggcttatagtaggcttggagaggagtcagagtattggcaggcaccttatgtctattcttttttttttattatttttttattattatactttaagttttagggtacatgtgctttccattttttccttttactctgaagcttttagacattgctcttttggatcctgcctaccaaattattcatttaacttcaagtgttcatttgtggctaacgaagctgagatttttgttaacatataacttgcatttagtccaaactgattagatgtcaataatcaacctaaattatcaggctttactttaattgcaattatatcctccatttcacatgtttaaaggtgagttcttatcaggtgatgggaactaagcagagtccaagtcaacctgaaagaaaccaaaagattcatccacgatcagctacgtgatttggaaggctcagtgcaatgtggaagtataaggtaccttgttcaaaatatattcagaattttaatatagcaacctcaggtaattaaaccaaatatgagatccttccatctgtgagacacacccatgaagagagccctggatttgtcaaagaaaacataagacatttttgccatttcttttaaatgttaatcacgcttatgataaaaactaatatgttggcaatattttcttcaaagtcaatagtatcttcatcaaaaatttctttttagaatttacaaagacttctttttccttttcgattggtctcagaaaacaagctttgaggttctattcataacataaagttcaattcagtttcaaaaaataattgcccgatacccttcttgcctttccaaatcttactgtaaatacaaaagtatgaaaataaagcctgtaaattatagatccatggctagatttggaaaaccctaaatcttaaacttagcagtgaacacctgacagtaacaaaagccataagcgctcactctaggaacagcatggccactgaacaatgttctccataataaagccataatcaacaccctacaaagcaaaatactatactatgatccacactactaaccatattttatcaaactgtatcttaaaacaaggaactctacaacttactaccctccatctcttgataaaagtaaaaacagattcctctaaattaaagctggaattcgcaagaccaaactaataaaaactaataaaaattatgttttactaatttttaatgtaagaattaataattctcataggctacttctcttttcttgatttcaccttactctgagaacatgtctaaaataaacatcattccattttgaacgaagtgctttatccaacagaccgatcatgctagacagaaagtttgcaccaggtggtagaaaaaaaagaaaactgtaatatcactttacatagtaaatgtaaccttccaaaacaaatttttattatattattatgatggtacctacagccatataaaaagggaactctggacatatctgctttaaaaaaaagctagataatcttctgaacttggaataattttaaccaacattctttaaggaatacttatggaaataattaattgcttattttagtttacataccatgtatacttgtgttaaaatgatttacctcctaaaactaactccaaaaaaaggtatttgaatactcagaagcttgtatctctttctttttggctgtctcccttgttccatttcctatcttacttctcccaattcagtttatcctctgatatggtttgactgtgtccccacccaaatctcaccttgaattgtaataatccccatgtgtcaaggacagggccaagtgaagataaatgaatcatgggggcagtttcccccatactgttctcctggtagtgaataagtctcacgagatctgatggttttataaaagggagttcccgtgaacacgctctcttgcctggcaccatgtaagaagtaactttgctcctcattcgccttccaccatgattgtgaggcctccctagccatgtggaactgtgaatcaattaaacctctttcctctataaattatccagtctcaggtatgtctttattaacagtgtgagaacagactaatacgccctcctactgaagatatgatgtcaccattcttccaagcatagatccattggatatctaagctatcttgggccacttccagtcactacaactgtcagttcttttttcatacctatccctctcctttccattccaactcctttacattgggtttttattacactttacctgaaatattataaaaatatcttgatttttcttgcttccattaaaccatgcaaaataatctacacatcattactgattaatcttccacaatacctgtttgattgtcccttccatgacaaaatattcctcattaacaaagtccaaatttcttagcttggcattcaatatggttcctcaaaatctggtttccaagccagattatcttctcacctgttgcagatactgtaatacggtattaatgagcttgggctggaaattcccatttcattactacagaaaaggtgtagtgatgttacctgcaggagtaattgagggagttccaagtcttgtgactgctggaatatggctggtaatacagaaaaggagtgatattagccctctctttaaaagaagaaaatatgaacttaggaattcaacttcctaagaaggaaatgggcttttattagaaggaagtgataaagcaaatctcttagacctaaaagtatttttttcccagatatgtactatgaaatgtcttgattcctgctgatatggtttggatacgcacgtccccaccccaaatctcatgtcaaaatgtaaccactaatgttggaggaggggcttggcgggaggtgattagatcatggaggcagagttctcatgaatggtttagcaccatctccccttggtactgtagagtgagtgagttttcatgagatctgcttgtttgaaagtgtatggcacctccccccctctctcttcctcctgctccagccatgtaagacatacctatttccccttcaccttccaccacgattgaaagtttcctgaggctgcccagaagctctcgtgcttcctgtacagcctgcagaactgtaagccaattaaacctgttttctttataaatttcccagtcgcaggtattcatagcagtgcaagaacagactaatacagctactaataagaaagctgaatttatgggatctaaaacaaagtatgttgatctactgattaatcaaactgacatgacagtccggaaacgacccaatgggttcttcctgcccactgcacaaagccaattcactaagaccacagcattgcaataaagattttaatagacacaaggtcagctatgccatgtgagagatggagttattaccaaattaatctccttgaaaattcagaggctagggtttttcaaggatagtttggtgggacaaggagtcagtttgggtggggccacatgacagatgggcaggggtagactgtcctcagaaatgtaaaaacctgaaaagatatctcaaaaggccaatcttaggctcgctctgtaatagtgatgttatctgcaggagtaattgcgggagttgcaaatcttgtgacctccagaataatggctggtaattgtttatgtctacaccttagcagaattcaggatcctcatctcttcgtaacctggtggtcttttattagctttacaaaggcagtttagtttgggggaagggttattaacatttaaactataaactaaatttctcccaaagttagcttggccctggcccagaataattaagggcagtttggaggttaaaggcaagatgggggttggttatatcagatctcttttatgtcataattttctcatgttttattttttgcaaagtcggtttcagtcccaagtaagaccaactttaattctgttctgctattcatccttaatggtgtgttcctgtatgaaggttttctggcagataaggggcctcttactagtaaataattttatttagttcttatttacccaccaaaattgcaaactctcatatatttataggcatcagagttttgtaaacccccttttagataactgtgaaaagtcattaaacattctatcaaaatctcccatccttcaaggcctagctcaatttcctttccataaagacttccctgtttgcttcttgctaggttacaggaggcttgagaacagagtgaagtgtggattcaacaaacatttatagaacaggtactgtgctaacaatttacccctcagttatactcacacttgtatatacagaacaatctctggactaaaacaccaaaaaatggtttaaaatacttgtttctgaggaaaaggtaaggataaatacagatcttaaaagaagcaaaatataattttcctagggaaaaaagggagagacacgttaccatttactttagaaaacttgtcatggtgagtctttctctgccctttgaaacgtatgtaaatcttcttaaaagtgaaataagcttctcgccagcttttcaacccaaggatgaaaagaatcttgggagaatgtctttctcaagaacctggaaaccatctcttttaaatataatcatcaaagaacgtagtgtccctatctcccagtttctgtgggaaggcaggagcctaactttggtgggtgcctggctccaagttacaaacttgtcttctgtcaaaaagatataaaaagttcctttggataaaggcaattagtgaacagagacagttattcaaattaccaggtgagtttaggatgaactatgtatgtaaatggtactgtcaagtcctcttacttgaggaatagttatcatttatcttgagaacatgtatctaatgggttgtgtctcctaagctatataaaacattgagatttctttatgtctctgcatttctttagctgattgcctgtggtatatatcacattctggtttaatgcttatcaattataaaattgttttcctttgtgaagggtatcctgggttggcaggatatattgttttaaattatatttccccaaaactcactggagattactgtatcatttaaatatgtaaatgtgcaaatgttttaacttctcaataaaatgaaaggaaccaattaagaaactaaagaataaggagggaaattgtggaagaagaagggaaaggaagaaaagagggagggaggaagaaaaacaaagaacaggctattagcaaaaactcaacaaaaagcacttccacttagggaagaaaagaccttcaaaaaaaaaaaaattaagagtttccaacaggactctagaatcaggcttctagagcctgcacctgattctagaatctagattctagaatctagaatcaggactctagaattcagtctctactgaacatattgtctgcgaagtaattaaaggggagaacaatcaagccaatatcccataaaaactaaaaccccttctcaaaacaactcacgcctgtaatcccagcactttgggaggctgaggcagatggattacttgaggtcaggcgttcgagaccagctaagccaacatggtgaaaccccgtctctactaaaaatacgaaaattagctgggcgtggtggcaggcgcctgtaataccagctactcaggaggatgaggcaggagaatcactggaactcgggaggcggaggttgcagtgagccgagatcgcaccattgcactccagcctgggtgacaagagtgagagttcatctcataacaaaacaaaacaaaaattgtaatgcataaaaataacagatacaattttaaatggaaatcaattccattgacagatataattttttagtcattatattaacatgaaataataagatctagcagtcagcctaataactctcataattcagacatagtgataagcatacatgacataatgtggtatgaaaatatctgtaatttctataggtgacaaagtcttaggtatcttatgcactgtggtttgtatttaataatattaataactaaagtgataaatttcagatagaactttataaaataaagaactatttatttttctcatccaagtccacagacaccctgaattctacatatgaatccccatgaactgtagcttaagaacctctgtgggaattgtaacagaactcaggatgagttctgctaccagaaaaactaggcaagtctaccacaagagacaagaagcttcttctccaagaagataaactatttgctttccatgttctaaagggccacctacatctccatgttgccctccctccagtatagcgacttgacctagcattcctagaatcagaaccttacaatcttacaaacctgcaagattacccgaatactcagtctaactgaaaaatatacagcagctaataatactgtataatctagattaatggtttggaacatttagtgtgcttaaggatcacctgggaaggctcgtctttgaaaatgattcatgacctcatcatcagagtatgtctaaatttgggaacagaaatcttcacttttaactagcacccaaagtgattcttgtgcaagtggttaatcaccaaacatttgagaaacatcaacagaattagagtccccaaactcaacaaacagaagaacttaaggaaacataattagtataattaatattctaaaagagattcaaatgtttatcatagctataagaacagccaggccaggcgcggtggctcatgcctgtaatcctagcacttttggaggctgaggtgggtggatcacgaggtcaggagtccaagaccagcctggccaagatggtgaaaccacgtctctactaaaaacacacacacaaaaaaaattagctgggcctggtggcaggcgcctgtaatctcagctactcgggaagctgaggcagagacttgcttgaacccaggaggcagaggttgcagtgagccgagatcgtgccactgcactccagcctgggtgacagagcaagactctgtctcaaaaaaaaaaaaaaaaatagccacagaaaacaccactggtattcttggaaatttaaaatggtattgcaaaaataaaaactagacagttgaagacttaaagagcggaatgaaaatagctaacatcaaaatcagtgaccagaaaagaaagccaaaaattctcacagaatgaaaaggatatgcaaagtatgagacaaaaattaaaagccacaagactcatccagacagaccaacattcatcttaataagagttttagaagagaaaagaaaatgtgtctctgcctagaaaagcgtctggaaaatatataccaagtccttaattgcagttatcactggcaataagaattgaattgaggtgaagtgaaaagagacattaacttttttcttaatttccataattgtataattattttacaagaataaattcatgtattccttatgaaattaattaatctagacatgaataaaattattgtcaaagatacaccaggaaaatgctaataaaaaggaagccaagaatatcaatattaataccagacaaattgaatcagagtagacactattaaaataaagaggaacattttataataataaaaggtaccttccaccaggaagtcataggagtcaagaaaacttctaaatctaataatataagggtattgttattttttgttgttgttgttgttgttgttaagacagagtctcactctgtcaccaggctggagtccagtggcacgattttggctcactgcaacctctgcctcctgagttccagagattatcttgcctcagcttcccaagtagctggttttacaggcacacgccaccgtgtccagctaatttttgtatttttagtagagacggggtttcactatgttggccaggctggtctcgacctcctaacctcaggtgatccacccgccttggcctcacaaagtgctgggattataagcatgagccaccgcacgggcctaatataagtttttaaatgtatggaacaaaataccactagaaatacaaggagaaaatggtattttgctgtaatgtgaaagacttcaactaacctctctcaaacaggtgaaacagaaaacagaagtaagaatgaagacactttatttattacaattacgaacttttaaaacttcctcccaaagagagaatacacaattttttcaaatatgtataaatacaactttcaaaacatgaattaagccacaaaaaatttcagtgttcccccaaaaaaattccaaacattttccaaaataaaacctatattttctgaccaaaattcagtaaaactagaaattaattttaaaggatgacaaaaataaacaaaaaacaattttaaaacaccaaaaaccaattttaacatttttaaaacacacttctagtagtataaggcaaagaaaaaaaaactaagttaaaactaacacctattttttaaaatacagataaaagtactgcttattaaacataggtgttcagaggaaaactgacaccatgaatgagtttacaaaagaaaaaaaccaagtaagaaaaacagaaaaagagagactaaaaattaactcaataaatatattcaagatattataaaagatcagcaaattaacctaagaaattagaaaatataagttaataaaaataaaagcaggccaggcacggtggctcaagcctgtaatcccagcactttgggagagcaaagcaggcagatcacaaggtcgggagatcgacaccatcctggctaacatggtaaaaccctgtctctactaaaaatacaaaaaattagccaggcatgatggcatgcacctgtagtcccagctactctggaggctgaggcaggagaattgcttgaacctgggaggcagagattgcagtgagctgagattgtgtcactgcactccaggccaggtgacagactgagactccatctcaaaataaaaataaaaataaaagcagaatctagtaaataattaaatagtagtcttaattgctaaaaagaaaattctttacagagaagaaaataaaaattcagatttttaaaattcaaactaaaaaaaagaagacacatgttcctaatgtcattcatctattgcctcttttttgtacacatctgtggaatacaacctgatgctttgatatatgtatgcactgaggaatgactgaatcaagctaattaacatgtccatcatcccacatacttttttgtggtgactcttttattgaggttttctttgcagcctttgctccatttttgtggatccattttggatccatttttccatagctatttgaaagatatgcgtcctctgttgcatgtgaagttctatacatgaaatcaactttccatactgcatatgggggggggctcaataaaaaataataaataaaaataaaaactgttctattttgaggtcctctataaatttcaatcagtagtcagtgtgaattatccactcctattacacaatcccttcatcagctctcatatttatttttccttcatgccttttctcattttgcagtgctcacaagtatggtccctagttaacgctaaactaaccctaaaactaaacatcatcaaggaatcggcatccaagaaagcccgacctgtgtcatgtgagtgaggatctaaaggaagagttgtgctagcttttattgcttgatttatggtattcttatctcctgaatatgcaatttttaggattggaggctttttatttttacttattttctagctcccattaagcacatgacaatgtggaaatagagaacaagtacctaataaatactgatgattaactgatggtcatgagactcatgatacaaacattttataagaatttgtttttaaaaacttgctgtggattcattttggttttttcaagttttggagaaaaaaaaaaaaacattactataactggctgccagagttttctccaagcttgacatcgggtccatataacagcaaaccttgaacacgatctataatgccatgtacatcatggggtctaagagtcccaagaagccaagagcaaacaaggtctaatactcattactatccatgtgttttatttaatcatcaagataaaggagatgttgtccttcttttattgggtaaatatttattagatgcattaaaacctcacactaggttctgaaatatcaacaattcattgctttttcaataaatatgtttaaagcaattactatgtacctggcaacttgctaggcggtgacaatataaatatgaataaggcattattcctctactcatataattcatccaatagcaaagacagatgcataaacaaataaatgtattaaactcaagacctaattgtattccaacagtctccatcatttgtcacaagagcattatttggaaagagtaattgttgggagggctcacgaaatatgtgttcaagttataactcttctaattcctgtttatttgactttgtacaagttacacaacctcacagaagagtagtttgctcctctataaagtacacaataactcctgacctatgtgctctatgaagcaatttgatactattaataaaatgtgcagataaacaccctaaatagtacaaatgtaagatgctagtaccttaaatttgtattaagccagtacctagcacaagggttcacacagacattaattacacagaaaatagatttaataaatatttgttaaatataaacagtacattgttgtagcacttattctcagatttaccacccattttaacacactttattcaatttcattattaactacctcaaacataagagaatgtatgaataaagaataataatataacacacattcatctaccaacccagcttctgaaaaacaatatgctcagtagctttaaagctcctgatgtgtgtatgcaacctctttctccccactcctccactcctcaatattgcataaatcattctcttccttctctttatatcttaccagacatgtctgtaacactagaaatgtgttgtttagttttgcttgtgtgagcctttatataaaagtaaaaatgctgtatgaattcttatacggcttgctcttttatggtaaagctttttgttttggtatcattcatattgacatgtattactataatttactcatttttattcattatggcctcatgtctaagtttaaagggagtgtttttaattactcaaatttaactatgaagtttactgtagaattttacagaaaccctttatcaagaaaactcacttctgttcctagctttctagaagttttaaataaattatattgaatttttcaaatgttttctgtatctactgagattattatatagtttttctcttctaacttgttaatgaggtgaataccatcagtaaatgttctaatgttgaactaacattacattcctggaataaattcaactttgtcataatgacttttttatctagtgctaaacagtttattcacattttgtttgcaatttttgcatctaatttcataaattagattggcatgtgaatttccttacttatctgacctgtgtagcatcgtttcacacttgcttcaccaatttcatataatggattgagagctactttgtttgtttgtttgtttgctattctcaggacactgctgtagaaatacatttacatattcctggaagggtttatagtattctatcaaactatctgagcctcctatttgctttcagtaaaaactgttaactactaattctatttaattatttcattcagattgtctatacttgagtcaattttgttaatttatattttcttaggaatttttccatttcatccaaattttcatttttatcagtataaatttgtttataatattcttttagtgttttagtatttataatatttagtatttagtcataaccctgtagttatgactcctcttctgactttcactcttacatgctgttttttgtctgctttcagtattcttaatttatctcaccagcagtttgtcaattttattggtctttacaaataatacacttttggctttgttgaacttctctactgtatctttgtttgtgatttaattaatttctattcttatctttattaattttttccttctgggttttttatattgtctgtttcaaactccaagtggaaacttagctccttaacatccagctttcttctttcctaatataagcatgtataggtgagaaatttccttctatgtactccctttagctatatcgctcaagttttgttgttattatacattatcattatttctcagttataagtattttttactttcaattataatttattcatgacccagtagttatacagatatggttttcaaaaaagattccaaatagtagggtaatttcacttatttacctaaatacatttctaggtggcctgtataatactagtgctttgaaaatcatgactcagtatgctgtcaatttttgttaattttccatgtgtcctcgaaaagaatgtgttacaacctcctggtgaatttatcctatcagtagatagtaactgtcattagcatttttactagtattgatatagctataccagctttcttcagttagaatttgttggatatcgttttatcctttgactttcaaactatcttgattcttaagtgttagatgtgtttttataaacagcatatagctagatttcgttttatattctaagctgtcagtcttttgtctttggagagtttaggtttcctttttacatttattatgattccaagattatttggatttattttattatgttttctactgtgtgtacatccttctttttccacagtgttttttcctccatttttttcttcttttggacaaactgagtttcttattttctcattgcatttctccttttccatatttggcaattatacagtctatgactacacatttttagtagttactatagacattttaacatgcttattaagataaatgcctaatataagtcaatatttttatccttccccaaaaaatatataaagaccctagaacatttaactatgattctatccatcctaattatacactgtgtttccagacacaatcattctacaattttaattatacaaagtatacatagttattaatcatttataaaaagtaatatgtaagcagtaataaatccttatgtttaccatttcctctgcttacaaattcttgcatttgcacccttaagataggataatttttttatttttctttaacaatttcttcagtgaaaagttgttgacaataaactattcatgtttgggactgggtaaaaatatatttatcttttttcttgaaaaacagctgtatcatgtattgaactcaaggttaacagttattttctctgagaatgatttactatcttgtaacattcatgtttaagaactcggctatcattcacagataatcagtcatcattcataggtaactcttttttttcctattttcttttaaaaatattcttttggtctttggcgttcttcagtttcactatgatacgtgtaaatataggtttctttaaagacaccttgcttgggatttactgggcttcttagctatagagaatggtgacttccatcagttctaggaaattctcattatctgttttatacttctctctcttctgaattgtatattataatattttagaacttgtcatggcatgtatcttaactgcttttcaaaaaatactttttacttctgtgtctttctgtgggaaactcaaagtaacctcttcaaatatctttcagatcaccaattctctaacctaatcacctgttttgcctaaccattgaatttttcatcattatatttttcattttagatagctctgcctggtcaattttgacagtcttttgtttcttcaacatattcattagggaataatgtatattaaaatacttttttcagtaccttataatttcaatatctacagtgtttgcagacctgattctgtagtttgttcattctatgaagttactcaagatggcttatttgtgtgtcttgtgaaaaccatcttccttggaaccgtatgagaattttttgaaagctgtgtataaagtgcagaaagaatctgagtttccttctggcagatctctggaggtattgccaggataaggcaattttaaactagatttttggatggggttttagaggctacacagataatatgaatgctgacccaaagtccagataaggacaggcctatggctagaaaattccaacatggattctgttccttttttctgagcttcccagagccaaggctatgctagtcaaaagttctcccaacatctcctgctattcgggttagtgttattttcatttctccaacaaggtggtcaaattttaaagattcccagtaacatgcaaatgtatcttacgggactttccagttggcaggatacagaatttatcttttgtcttcagttcacagtctttcaagattcaagctccaggccataattgaaaagcagctaccccatcccccagcataatgctggtgttggctcactagtttggattttgtgctttttgtatcagcctcaaataatttccataattcagttatcagattatttatgtatataaaaatattttcttcatctcttttagttcttatagttcactatatatctagaaaccaaaccattttttaaaatcatattaatgtgcttctagataacagtgatatctatttcttctttagcttctaaatgctaatctgactaacagagatcctgttttctcctaacaggtgaaaatgtaagaacatgaggagtatcttccccaaaattattacccttagtaaaagacagagtatcttggaagtaacagggaactctgactaaggctggacagctgctgagagaagagaatatatataaagttttttctctttgtgctgccttaccacagaaaggattctgagcagtgtatcacttacatgtgcttctggtagtttccatcactataaattcatggcctggttaaaagttaaagtagagccatatacccccaaatacatccactttcagtcggaggaaggagaaaaaaataagggtaaggaaaaaatgcttttcactgcaaaatcacaaaatggcatgccgtattattgcattcattcattcatgcattcattgatatttacctagcacttactacatttagggcattattctaggtgctggagatataacagtaaacaatgactgtatgaatgatgatacatgaatatgtaaaaaagttaaaaaaagtgaatatgacagctctctaaaaataagaaaatatacatacatatcatttgttatcatctttattgcatgggaattcagattagttcttgtgtaccacaatgacaacagctgctttttccctcctcacaggagacaatatgtcttaatggacttggaattttcaaagcaatttttattggtgaagtttcttgcttcataacattttcaaaattctcttaatctacaattcagcacttctcagctctcattcagccacaaatacagaagaaaacccctataattcacactggcctttccaataaatcaattgatttagccagtatagtgttccaattcaacttctattttctccactcataaatttcaggtttcatactcacacccagccaagggccagaatgaaaaatttaacaaaagcttcagcatggttgttgagtaagcactctgatacattccacactataaacatttaatgagacttactcccaacagagtatttactacatcaatttacttcatagtattatatttgcaggagcaaaatagagcaaaggttattttggatcctttaccaatacagcttcctgtaaataatgaaaagtgcaaccatttaatttaccaaatcattaaaaaaggttaaatgctcaataaattctgctttatctagttcagtcagccacagcagctatttgtaacttggatataaaaaatatagaaaacttaggcattttttactagtttgtgcatctgtacctttgactagaactaaatttcaaaggttgttcagacagtttagaatcctcattaggatctcagagaaatatcttttggaccccttcccgcctcatgaagaacaactgagtctgcctttcttaagagaacactgttgccctgcctatgcccactcccactgaagttacacacataacacgcacactttctcctcctctccaaccactgccattttgtgcctgtggcagtcactttcaactaaaaagagaaaagagaagaggtctcagaaggaggaacaatttggaaatgtcttcttctttaatcctaaaatacagaatgcattgtctgagataaactggagctcttatgggagcattctctgacacaattgtgttttagtactgtgaaaaatgtgctatacaggttgagcgttgctaatctaaaaatctgaaatccaaaatgctccaaaatctaaaactttctgaatgccaatgtgatggcactagggaaaaattcagcatctaacttcatgtgacaggtcgcagttaaaatgcagtcaaaacatcatttcatgcacaaaatttttaaaatgttgtataaaattaccttcaggctatgtgtatagggtatatatgaaatataaatgaatttcatgtttacacatcaatcccattcccaagataattcattaggtatatgcaaatattccaaaatccaaaaaattccaaaatccaaaccacttctggtcccaagcatttcagataagggatgctcaacccgtatgatcctatctatctactctaacaaatttcaatgtatcacactcggcactccccagatacagactacagatggtccctgacttgatttaacaatggttcaacttataattttttccagctttatcatggtgcaaaagtaatacatattcagtgtgtatatagagtgtttcaggcccctaaaggtcatacccttcccagggtagagtaacctgcatccagtgactgaaagagacatacaggcctggccatttctgcctgacaaggtacactctggagggcaatgctctcaccagagctccctgctgattggcctaggctttgcgggtctagctgtcaggtagacttcttcctctatccagtcccgctccttccctctttccttcccaaatgtaacaccttgttttccaaactccattctgtgtgtgattctggaggacccagcctacaacactagccatgactccttcctttcattcatgtcccacatccattctatcaaaattcagttgactctatttacaaaatttagcactgatgtccaccaacaccactctagtctaaactaaaacatgaggtggttcatgtaaagtgtataaatggaacctgggttactacaatagcctccagcctggtttttcagttcctctcattgttctccttcagtctatgttccttatgcaactatcatagtccttttaagacacgagtcgcagcatgtcacacctttgcttaaaacctttcagtgtattcccatttaacttggagtaaaagccaaagtccttaaaggcatacacactcctaaatggttggttctccaaccttagctcctgctactcatcactttgctgtcttcacctagacaccctggtttttatgttgtcacttaaacacagggcacataccttcaagcctttgctctagatcttcatctgcccgattcctgaactctttcaaggctttggcattatctcaccttctcagtgtaacatctatacaattttgttctctacagtgtttattggttttattttttgcctataatcacctgctaaaatgtaaaaatttgtcaagggaagtgatcagatatgtcccaagcacatagaacagtaatgccaataagtatttgtggagtgaataaatcttatgcttcataagtagatctacataaaacaaagtcatcatttcgatctaattaacaatcccacttcaaattcattggattccttggcagagatgtacaggagtcagaagtttactaacagagtactttcctgttaatcaattctttggaagactcaagaaggtgatagagactaatctggattttttattttctcatgctctaaacgccaacatgtggatcttcttctgttttattattattattactgtattaggacatcagatcacactttatctttctcccgacttacctccagctcatcaagggcacttcccagggttgctgcctgaggttctggtggggttgtcatattctggatcccttgtgaagcatttgaaattacattgagagcattctgaatttcttcacaaactgtgtccttgcttgctttgagggaagcaacatcagaatgctccaaacaagctgaacaaattgaatgcaagaggggagagttctccttcagtgaagctcgggctcctgcaatttcatctctctgatttggagattttaagtcctgagaaggtaaataaaaagagtggtatcttacaatgggttatgggagaaagacttaaattaaaaagcttctttttttgtaagtataaatgaaaagataatagacatgaagaagtcagctataagttataatcaagggcatctattatttctacattctttcagtttctgttaaaaattctgcagtataaacaatgacacagttaataagtaaaggtccccgtagagcagatgtgtaaagatccattactattcagtcaagtccttgtcagtcaaatccttataagtagctaaaatactctggcattcacattattaagtgcattacatgggagcttgaattacaaggatgctgattacctcattccatagatgttgataattgcatttaacctctccgttaaaattagaccaattgagttaagaacactaatgaaacctcccaccattcagctatttttctttttcagaaatactaataaattaatcctatatcattctttctttgatatttattcaacaattagttactgagcacttagcatattctagcccttgtgctggactccagtgtacagatatgaaaaaatcctacaaggaccttgttcttctttcttttggggggaaagggcctacagacaaacaatgaactagatgaacaaatatacgagatgatttcaggtgacaataaatgctatgaagaaaacacaaaagtgaagtgtcatagagattgacttgaaaggaaaagctgctttaggctgaatggtccgagaaggtatttcttcagagatgacaatttgcagtaaatgtaaatgaatagcattacatcagagagaagagaggaaagagaatgccctgtctaagtgataggcgatcagaactagctcaatatacaagaaaaaaatctggcaagccctaccttaaccaagtgatgaaatttaacataatcagtgatatcacatggatatcatgtaccccttgatatactgtgacaggaaaagtatgccatttctgtggtattccctccaggaacccataattccagtctaatcatgagaaaagcaacaaacaaaatgagattggtgaacatcctaaatgacacctgggcagtattcctcaagaccattaacatcatggaaaacaggagatggactgacaagctgtcacagaacagagaagattggggagacataactaaatgcagtgtggtactgaggattagatcctggaacagaaaaaacattcatgaaaaactgctgaaatccaaataaccattattaatagttaatagcaatgcatcagtatccatttctttgtagtggcaaatgtaagatacagcattaacaatggagaaaactggaaaaaaggtaaatgggaactctctgtaccacctttgcaacttttctgtaaatctaaaattactcccaaataaaagcttaagttaaaaaaaactaattcaagggacatttacaatagttcattcacttcatatacaacatttcatataatctttataaaaactcatgagagatgtgattattcccattttaaaactcaaaacactaaggtttcaagagactaagtttcttagccaagtggcagagctagatggtggtatttcttgtattgtaacccacgtcagtataacttccaagcccttatcctaaaaactatgtgacattatttcctacataggaaaaatttttttcttttttctttttttatgacagagtcgcgctctgtcgccgaggctggagtacagtggcgcgatctaggctcactgcaagctccgcctcctgggtttatgcagttctcctgcctcggcctcctgagtagctgagactacaggcacccaccaccacacccagctaattttttgtatttttaatagggacggggtttcatcatgctagccaggatggtctcgatcttctgaccttgtgatccgcccgcctcggcctcccaaagtggaaaaatttcttatttgctacacagaatgaggacttgtatttgtataatatcatgtagcttataaagtgcttctatacagtatcttactgatcatgacaatagtctttgagggaatgaggctgctattattagtcctattttaactaaacaggtgtttggtgcaaggagatagaaactagtaaaggaacagagatctaaacctaagtctactgattgctaaccttatgccttttcacaagactctgctactctgggaataatgttgcatgaggttaataaatggcttgtgctactatatttttagttccttcccttctgaaaataaacactgtctgctacttcactcaggctttggagagattaacttcgttacaaaatgtagggaggacagttagaagtagctatcaacccactgttcatagtcactaatcacccaagaaaagacactatggttttcttggcttgctacgatttcccccttgtatatgtggtctgggttttagttttagttctgtcattagcactgtgagctaggtaactcatctctttcggtgtctgtctttctatctgtaaaaatgggataatgatacttctgccgaccctctcacaagattgagtacatagcacatcagaaatggaatataagtggaaaatagagaaaaggtgtagaaagaatacggaattgttttattccttacatctgtcaaacttggtgtactgtttctgtactgataatcttagtgatttttgtatttcccacaacgttgtacaagctctacctacagtcatcagtgtaacttagaggataaatagtttaatgtttagaaaggatgcacagctcctcagatgagtaataattaaaagtataaatatttagaaaaaggtaaggcaaattctctgatattactgtacaatcacaacttaatacataattctctctgaagtgacctatacattatgcttctttatttagaaggacagtgtcaaggtttagtttgtttctgaaaggtgaaaaacttgaacatagattataatcaagaagctaaagttaaaattatttcttttgctctaatggtagcaatgtgtaatctgatggtaaattgtagtaactttaatgccatggggactttgaaatgttaaaaatacaaatgtattttgaatttggagcctatgctttgtcatctctgcccaaggcaattacagaatccatgagcccaaatagcaagtccttgacgcctgcgaaaaaggactagatcagtgaacataacaaatataacgttacagcagtggacaggggcaaaggggcaggtggcagagtttatgtaaggaaaactgacaaggcatgaccatttctcccaaaggacatcaagcatgataaacttaatgtagtaaataggcacacagataaaagagaaattaatgactgtcacctcctaaatgtatgttgtggtagtggtgtttgtagttgttttattttaactgatgataccataggttcaaaggttcttgtttgtccatttaccctaaaattttacataaagtcaaaataggcattaaacagtaaagttaatcagggatttctttggatggagaagtataaagaattcagctcctcaaggattgatacttatttataatctttttttaaatgctccagaagaaagctcacaggagatttccaagttaagaagacattaaatgtttccagctgacgaagaaacacacagatgggatttaaaaagaccttaaagtctgtgcaagtgggtagagaagtaacatatgagttttaaccctggcaagagaacaaaatatatttaggaatattattttaaaaaatacaagtggagggctttaagctatcagttaattaattcaaccattccttcaacctgtactatgttgagcctctcctatgctgagcctcgactttgcatcaaggcagtgtgctaaatgttggaaatgcaaagataaagatcaggaggggagacaaataaacacatttacatgggaactaaaatagagttacccacagcatagaggacagtctctcagtttgaagggattaaataaaatttctcagagaatgtgaatcttttttccagctttattgaggtacaattaacaaataaaaattgtgtagattcaaggtgtactatatgatgctttcatatacatatacattgtgtaatgattactacaatcatattaatcaatatatccatcaccacacagttaccctttgcgtttgtgtgtatgtgctgtgagaacatgtaagatctattctcttagcaaatttcaagtaagcaatacattattattaactgtcttcaccatgctgtgagttaggtccctagaacttactcatcttataattgaaagtgtataccctttgaccaatatgtccccgtttcccccacatgccaacccctggcaactatggtaaaactgcttctatgagtttgacttgtttagattccacatataaatacaatcatacaatatttatctttctgtgccgggcttatttgacttagcataatgtccttcaggttcatccaagttgtcataagtggtgggatttcagagaaggtgaatcttaaacagtgagtagaagttatccctatgagggaggacccacagaccctttgaaggaagcggactgctcctgcaaaatctgggagacaccacaaatactgtgagtgccccaactgcggaagtgggaaagggagagcctcctctcctgaatacacaaccccactggggcaaatgaaggtctgtttgcgggagaagtttctgaccttacctggagctgagtcaatttaaagagccaagcaaaaaaaaatatagagaggaagcagcagaaagtccctaggagctcgctgggtccccagtcaggccattcctgcctggcatcacagggatccactgggagggcagccagagaagcaggggttgggggagggggaagcaccacagggagaaggaaaattccagctgaacttcgtaacaatttgaacagggtgagaagcctcatggccagaacttgagggagggtgtgaatccagcatgcagactccacagcgtgggggaagaaccaggccgttttcatttgaaggtggcaggcaggtagcctggggcaagttctcaagcccagcttgcccaccacctggaaacagacttggggctgtttgggggcacggtgggagtgagaccagccctttggtttgcctgggagctgggtgaggcctgtgatggccagctttcccccacttccctgacaacctggatgactcaggagaggcagccataatcttcttaggtgcacaactccattgacctgggaatctcactcccaccccctacagcagccacagcaagacccacccaaggacagtctcagctcagacacgcctagctctgtccctatttgatggtccttccctatccaccctggtagctgaagacaaagggcatataatcttggtagttctaggacctgcacgctgccagttcctctccatactaccacagctgatgctctctacaaaaccccatctcctggcaggaggccaaccagcacaaaaatagagcattaaaccaccaaagctaagaaccctcacggagtccactgcaccccgctgccacctccaccagaacaggaactggtatccacagctgagagagccatatatggttcacatcacaggactctgtgcagataacccacagtaccaacccagagcagggtagacttgctgggtggctagacccagaagagagacaacagtcattgcagttcggctcacaggaagccacacccataggaaaagcgggagagtactacatcaagggaacaccccttgggacaaaagaatctgaaaaacagccttcagccctagaccttccctctaacagagcctacacaaataagaaggaaccagaaaaaaaaatctggtaatatgacaaaacaaggctctttagcacccccaaaaagcacactacctcaccagcaatggatccaaaccaagaagaaatccctgttttacctgaaaaagaattcaggaggttagttattaagctaatcagggagggaccagagaaaggtgaaacctaatgcaaggaaatccaaaaaacaatacaagaagtgaagggagaaatattcaaggagatagatagcttaaagaaaaaacaaccacaaattcaggaaacattggacacactttagtaatgcaagaagctctggaaagtctcaggaatagaactgaacaagtagaagaaagaaatccagagctcaaagacaggtcttcaaattaacccaatccaacaaagacaaagaaaaaagaataagaaaatatgaacaaagcctccaagaagtctaggattatgttaaacgaccaaacctaagaataattgatgttctggaggaaggggagaatcctaaaaccttggaaaacatatttaggggaataatcaaggaaaacttccccagccttgctagagacctagacatccaattacaagaaacacaaagaacacctggaaaattcagcctgaacagatcgtctcctagacacattgtcatcaggttatccgaagttaagatgaaggaaagaatcttaagagctgtgagacagaagcaccaggtaacctacaaaggaaaacctgtcatattaacagcagatttctcaccagaaaccctacaagtaagaagcaattgggaccctatcttcagccttgtcaaacaaaacaattatcagccaagaattttgtatccagtgaaactaagcatcatatatgaaggaaagatacagtctttttcagacaaacaaatgctaagagaatttaccattaccaagccaccactacaacaactgctaataagaagctctaaaccttgaaacaaatcctagaaacacatcaaaacagaacctctttaaagcagaaatcatacaggacctataaaacaaaactacaagttaaaaagcaaaaacaaaaaaccaaagtacatagacaacaaagagcatgatgaatgcaatggtacctcacatctcaatactaacacagaatgtaaatggcttaaatgctcgacttaaaagatacagaaccacagaatgcagaagaactcaccaaccaaccatctgctgccttcagaagactcacctaacatgtaaagactcacataaacttaaaggggtggaaaaaggtatttcatgcaaatggacaccaaaagcaagcaaaggtagctttttttttcttttttttttttttgagatggagttttgctcttgttgcccaggatggagtgcaatggcgcaatctcagctcaccacaacctctgcctcccagtttcaagcgattctcctgcctcagcctcccaagtagctaggattacatgcctgcaccaccatgcccggctaattttgtatttttagtagagccagggtttctccatgttggtcaggttggtcttgaactcccaacctcaggtgatctgcccgccttggcctcccaaagtgctgggattaaaggcctgagccaccatgcctggccaaaggggtagctattcttatatcagacaaaacaaacttaaagcaacagcagccaaaagagacaaagagggacattatataatgataaaaggccttgtccaacaggacaatatcacaatcctaaacatatatgcaacactggagctcccaaatttataaaacaattactaatagatctacgcaatgagatagcaacacaataatagtgggggacttcaatactctactgacagcactagacaagtcatcaagacaaaaagtcaacaaaggaacaattgatttaaattataccttggaacaaatgaacttaacagatatatacagaacatttcatccaacaaccacaaaatacacattttattcaacagcacatggaactttctccaagacagactatatgataggccataaaatgagcctcaataaatttaagaaaattgaaattatatcaagcactctctcagaccacagtgggaaaaaaactggaaatcaactccaaaaggaaccttcaaaaccatgcaaacacatggaaattaaataacgtgctcctgaattagcattgggtcaaaaatgaaatcaagatggaaatttaaaaattcttcgaactgaacaaaaacctctgggatacagcaaaggcggtgctaagaggaaagttcacagccctaaacacctacaccaaaaagactgaaaaagcacaaactgacactctacggctatacctcaaggaactagagaaacaagaacaaaccaaacccaaacccagcagaagaaaggaaataaccaagatcagagcagaactaaatgaaatcgaaacaaaatgaaaacagatgataaatgaaacaaaaagttagtttttttgaaaagataaataaaattggttagcaagactaaccaagaaaagacaagcgaaaatccaaataacctcattaagaaacaggagataggccaagcacagtggctcacgccggtaatcccagcactttgggagactgaggcgggcagattacaaggtcaggagtttgagaccagtttggccaacatggtaaaaccccatctctaccaaaaatacaaaaattagcagggcgtggtggcaggcacctgtaatcccagctacttgggaggctgaggcaggagaatcgcttgaaaccggaaggtggaagttgcagtgggctgagatcgtgccactgcactccagcctgggcaacaagagtgaaactccatctcaaaaaaaaaatagaaagaaacaggagatattacaactgataccactgaaatacaaaagatcattcaaggctactgtgaacacctttatgcagataaactagaaacctagaaaagatggataaattcctggaaaaatacaaccctcctagcttaaatcggtaagaattagataccctgaacagaccaataacaagcagcgagattgaaatagtaattaataaattaccaacaaaaaaatccaggaccagatggactcacagcagaattcttccagacattcaaagaattagtaccaacccttttgacactattccacaagatagagaaagaaggaaccctccctaattcactctatgaagccagcatcaccctagcaccagaaccaggaaaggacataaacaaaaaagaaaattatggaccgagatccctgatgaatatagatgctaaaatccttaacaaaatactggctaactgaaaccaaaaacatatcaaaaagataatccaccatgctcaagtgggtttcataccagggatgcagggatggtttaacatatgcaagtcaataaatgtgatacaccacataaacagaattaaaaacaaaaatcacatgatcatctcaatagatgcagaaaaagcatttgacaaaatccaggatccatttataattaaaatatcaggaaaatcggcatacaagggacatacctcaatggaataaaagccatctatgataaacccacagtcaacattatactgaatggggaaaagttgaaagcattccctctgagaactggaacaagacaaggatggccattctcaccactcctctgcaacatagtactggaagtcctagccagagcaatcagacaagagaaagaaataaagggcatccaaattggtaaagaggaagtcaagctgtcactatttactgatgatatgatcgtttaccttgaaaaccctaaatactcctccagaaaggtcctagaacgatacaagaattcagcaaattttccagataaaagattaatatacacaaatcagtagctcttctatacaccaacagtgaccaagtggagaatcaaatcaagaactcaacaccttttacaattgctgcaaaaaataaaataaaataaaatacctaggaatatacctaacaaaggagtcgaaagacctctacaaggaaaactacaaaacactgctgaaagaaatcacagacaaaacaaatggaaacacatcccatgctcatggatgggtagaatcaatattgtgaaaataaccatgctgccaaaagcaatctacaaatttaatgcaatccccatcaaaatactaccatcattcttcacaggattagaaaaagcaattctaaaattcatatggaaccaaaaaagaacctgcatagccaaagcaagactaagcaaaaagaacaaatctggaggtatcacaccacctgatttcaaactatactataaggccatagacatgaaaacagagtggtactggtataaaaataggcacatagaccaatggaacagaatagagaacccagaaataaacccaaatacttaaagccaactcatctttcacaaagcaaacaaaaacacaaagtgaggaaaggacacccttttcaacaaatggtgctgggataactgactagccacatgcaggagaatgaaactgaatcctcatctctcaccttatacaaaaatcaactcaagatggattaaggacttaaatctaagacctgaaattataaaaactctatacgataacattggcttaggcaaagatttcatcaccaagaacccaaaagcaaatacaaagataaacagttgggacttaattaaactaaagagcttttgcatggcaaaaggaacagtgagcagaataaacagacaatccacagaatgggagaaaatcttcacaatccgtaatctgacaaaggactaatatccagaatctacaatgaactcaaacaaatcaataagaaaaaaacaaaaatcccatcaaaaagtgggctaaggacatgaatagacaatgctcaaaagaagatatacagagaagccaagatagctgaataggaacagctcggtctacagctcccagcttgagcgacgcagaagacaggtgatttctgcatttccatctgaggtacagggttcatctcactagggaataccagacactgggcgcaggtcagtgtgtgcacacaccgtgcgcgagccgaagcagggtgaggcattgcctcactcgggaagcgcagggggtcagggagttccctttcctagtcaaagagaggggtgacagaccgcacctggaagatcgggtcactcccacccgaatactgcgcttttccgacgggcttaaaaaacggcgcaccaggagactgtgtcccgcacctggctgggagggtcctacgcccaccgagtctcgctgattgctagcacagcagtctgagatcaaactgcaaggcggcagcgaggctgggggaggggcgcccgccattgcccaggcctgcttaggtaaacaaagcagctgggaagctcaaactgggtggagcccaccacagctcaaggaggcctgcctgcctctgtaggctccacctctgggggcagcgcacagacaaacagaaagacagcagtaacctctgcagacttaaatgtccctgtctgacagctttgaagagagcagtggttctcccagcacgcagctggagatctgagaaccagcagactgcctcctcaagtgggtccctcacccttgaccccagagcagcctaactgggaggcaacccctagcaggggcagactgacacctcacagggccgggtactccaacagacctgcagctgagggtcctgtctgttagaaggaaaactaacaaacagaaaggacatccacaccaaaaacccatctgtacatgaccatcatcaaagaccagaagtagataaaaccacaaagatgtggaaaaaacagagcagaaaaattggaaactctaaaaagcagagcacctctcctcctccaaaggaacacagttcctcaccagcaacagaacaaagctggacggagaatgagagaagaaggcttcagacgatcaacttactccgagctacaggaggacattcaaaccaaaggcaaagaagttgaaaactttgaaaaaaatttagaagaatgtataaccacaagaaccaatacagagaagtgcttaaaggagttgatggagctgaaaaccaaggctcaagaactacgtgaagaatgcagaagcctcaggagccgatgcgatcaactggaagaaagggtatcagcaatggaagatgaaatgaatgaaatgaagtgagaagggaagtttagacaaaaaagaataaaaagaaacgagcaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagacactcctcgagaagagcaactccaagacacataattgtcagattcaccaaagttaaaatgaaggaaaaaatgttaagggcagccagagacaaagcttgggttaccctcaaagggaagcccatcagactaacagcggatctctcagcagaaactctacaagccagaagagagtgggggccaatattcaacattcttaaagaaaagaattttcaacccagaatttcatatccagccaaactaagcttcataagtgaaggagaaataaaatactttacagagaagcaaatcctgagagattttgtcaccaccagacctgccctaaaagagctcctgaaggaagcactaaacatggaaggaacaactggtaccagccactgcaaaatcatgccaaaatgtaaagaccatcgagactaggaaaaaactgcatcaactaacgagcaaaataaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataacggtaaagggatcaattcaacaagaagagctaactatcctaaatatatatgcacccaatacaggagcacccagattcgtaaagcaagtcctgagtgacctacaaagagacttagactcccacacaataataatgcgagactttaacaccccactgtcaacattagacagatcaatgagacagaaagtcaacaaagatatccaggaattgaactcagctccgcaccaagcggacctaatagacatctacagaactctccaccccaaatcgacagaatatacatttttttcagcaccacaccacacctattccaaaattgaccacatacttggaagtaaagctctcctcagcaaatgtaaaagaacagaaattataacaaactatctctcagaccacagtgcaagcaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagacacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcatcactgatcccacagaaatagaaactaccatcagagaatactacaaacacctctacgctaataaactagaaaatctagaagaaacggataaattcctcgacacatacaccctcccaagactaaaccaggaagaagttgaatctctgaataggaccaataacaggagctgaaattgtggcaataatcaatagcttaccaaccaaaaagagtccaggaccagctggattcacagccgaattctacaagaggtacaaggaggaactggtaccattccttctgaaactattccaatcaatagaaaaagagggaatcctccctaactcattttatgaggccagcatcatcctgataccaaagccgggcagagacacaaccaaaagagagaattttagaccaatatccttgatgaacattgatgcaaaaatcctgaataaaatactgggaaaccaaatccagcagcacatcaaaaagcttatccaccatgatcaagtgggcttcatccctgggatgcaaagctggttcaatatacgcaaatcaataaatgtaatccagcatttaaacagaagcaaagacaaaaaccacatgattatctcaacagatgcagaaaaggcctttgacaaaattcaacaaccttcatgctaaaaactctcaataaattaggtattgatggggcgtatttcaaaataataagcactatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaagaaaagaggaagtcaaattgtccctgtttgcagatgacatgattgtatatctagaaaaccccattgtctcagcccagaatctccttaagctgataagcaacttcagcaaaatctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctactaatgactttcttcacagaattggaaaaaactattttaaagttcaaatggaaccaaaaaagagcccgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagaaccctcagaaataatgccacatatctacaactatctgatctttgacaaacctgagaaaaacaaacaatggggaaagtattccctatttaataaatgctgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtttaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaatctactcatctgacaaagggctaatatccagaatctacaatgaactcaaacacatttacaagaaaaaaacaaccccatcaaaaagtgggcgaaggacatgaacagactcttctcaaaagaagacatttatgcagccaaaaaacacatgaaaaaatgctcaccatcactggccatcagagaaatgcaaatcaaaaccacaatgagatatcatctcacaccagttagaatggcagtcattaaaaagtcaggaaacaacaggtgctggagaggatgtggagaaataggaacacttttacactgttggtgggactgtaaactagttcaaccattgtggaagtcactgtggcgattcctcagggatctagaactagaaataccatttgacccagccatcccattactgggtatatacccaaaggactataaatcatgctgctataaagacacatgcacaggtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagcaaactatcgcaagaagaaaaaacaaaacaccgcatattctcactcataggtgggaattgaacaatgagaacacatggacacaggaaggggaacatcacactctggggactgttgtggggtggggggggtggggagggatagcattgggagatatacctaatgctagatgacaagttagtgggtgtggcgcgccaacatggcacatgtatacatatgtaactaacctgcacattgtgcacatgtaccctaaaccttaaagtataataataataaataaaaaataaaaaaataaaaaaagaagatatacaaatggccaacaaacatatgaaaaaatgcacatcactaatgatcagggaaatgcaaatcaaaactacaaggcaataccaccttactcctgcaagaatagccataatcaaaaaataaataaaaaacagtagatgttggcatggatgcagtgatcagggaacatttctacactgctgatgggaatgtaaactagtacagccactatggaaaacagggtggatcttacttaaagagctaaaggtagaactaccatttgatccagcaatcccactactaggtatctaccccagaggaaaagaagtcattacatgaaaaagatacttacacacatatgtttacagcaggacaattcacaattggaaaattgtggaaccaacccaaatgcccatcaatcaatgagtggataaagaaactatggtgtatgtatatatatatatatatatatatatatatatatatatatatatatatacacacacaatggaatactactcagtcataaaaagaaatgaattaatagcatttgcagcgacctggatgagattggatactattattctaagtgaagtaactcaggaatggaaaaccaaacatcatgtgttctcactgatatgtgggagctaagctatgaggacacaaaggcataagaatgatataatggactttggggacttggggtggggaggtgtggaattgggggaagggataaaagactataaatatggcgcagtgtataccgctcagatgatgggtgcaccaaaattttacaagtcaccaccaaagaacttactctagtaaccaaataccacctattccccaataacttatggaaatttttttaaaaaattaaaattaaaaaattcaaacattgcctaagtataatagaaaaaaaaagaagctatccctatgagcaatgcagaacaaaagagcatgtggaaaggtctgaagcatgaaaaggcgaggaaggtgcaggtcactgcaggtgatatgacaaatacaggaaacctaagcatgaatggtgatgaatccagcagaaaaaggtaggcaagagacatttcacgtgctctgctaaagaactctgaaagcaacaagctcagatgtgtatttacaaagattgctctggcaatgggtttttgagtggattggagagaatgaaattgcagtcagagagaccaggcaataacccaggtctgggaaagagacaataagtgcctgaacactattgctaggctatagtgggagagatccaggaaatttttaggaggtacaaatggtaggattttggtatatctagatgggagtagggaagagaagatatttgaaagcatctagagaattgtttcagcaatcgtggaagtggtgatgcattcaccacaatgagaatacagagagaagaatgtacttggaagaaaaaggtgaacacattttgtaatctgccaaatgtaatatatcagcacaagatccaaatgaaaatacaatacacatgaatctagacttcagaggagagtctgggccagaaatagagatatgtgaaacaccagctcacagttgggagctaaagccatgtgtgtgaaggctacaggacctgcatccagggtgaatattacaataaggagaagaatctaggagtcatcgtaaattgttccttgagtatatcaacccagtaattttatgtgctagcccaaaaggccaaatatatatttatattagcaagaagggtatcagcaaatactaaactaaaaaaaaaaaaattcaattaaaaatatttttaaataggccagaaaacgcatgcaggctacagagttagaatctaaactactgtgggtaatcatggtcatcataccttaagataacaaatgatttttctttaaaagcaattttgaacagaatgacttctgtttctggaaagcttaaaaatatgaggtctgttcaccttggaaaggggaaatttttattggaaaacgcatgataaaaacatctgtaaatcatgaacgaacttgataacttgttaatgggcttctttacttaaatctggagatactaggtcatagaagtagctttttagatttgagtaaaataaattatatctgttcatacttctgtcttcactacttcattataattctcttgaatgcaagtactatggcttacttattttatacctcattatctagtagtatacagcacatattaggagtttaatacatttttgttaaggaaacagacaaatgaataagaattaagccagaggaagtcaatatgctcaaaaggagatagaaactccagatatgattactccaagaaataaaacatggggaaaatataccttaatccagagagtttgaataaatttatgcatggcaatgccacagaaagctgaagagcaaaattaaactataactatcttcacattaaatggtagtgaggccgttggtacgactactttggaaaatgatttgatagtatttactgaagctgagtatatgcatgccctgttacccagctatttcattcctaggagaggatacacacatatggaaatatgttcctatgtccatctaaagacacaggcaaaaatgttccataccagcactgtctgtaatagtcccgacctggacacaacccagagtaatgaaaaagaaaaaaagacagctacacgtgataaaaaaaaaaaaaaagcaagacataaaagagtatgtatggtttaattccatctatgtgaagttcatactcaggcaaaagtaacctatcattttaaaaatcaaaatagtggttattctttggggggtgattagagactaaacagggaggaggaatctttcagtttctggtaattttctatttcttgtcctgggtgctagttacaccaatgtgtttagtttggaaaaattcattgaactgtttatttcacactatgcatttttctgaatgtatgttatactttaattaaaaaagcttcacataaaatcaaggaaatgaaaaacaaaaagtaaagccaatatctacagtgtgagccttcttttggcaaaggacactggtataaactagctatggactggctatgttgtcatattacccatgtcattaagggaagaatgagaaaattagatattctgtccatctgtaagaatcctgtatccactttgagggctcatatttttaaaaaagaaaaaaaagtctgaaatataaaaataagaagagaaagctcctgtagcctgaccatcagaaaaagcaaacctaagaggttttcacagcaactgattccatgaaccgttggacaaacctgcatttctgagaatcaaagaaaacttccttacgaagctacattcctgcccacatggaatagctcagcatatactctgctcaacaaagcagagctacatacaaattactgagtttctcttccaggtgtttaaatgaggtttctgaagctgacaaaaccactctggtaagggaaggaaagggagcttataaaaagaggttttgtttgtttgagattaagatgtgcagcagaaaagcccatgtatactttgctatttggattccattatgggttggcttctgtctccagtcttctctctgccaagatgctgcataccaattgcttcactggtcattgggcagcttcatgttctattaggaaacaaaataacacaaacacctgctaatttaatgttcttggccaacttaaattaggaaatggaaacttagtcttaactgagctgaaggatataagatggtgaaacaacagtaggcttcaggtaaaagaaagttttgagaagaaaaattaaaattaaaaaaatgcaagattttacaataaaagcatcattaaggagcagagagaggcctttactacttttctatccttatttcccatttgtcatttcatagaaataggacagattcaataaaagagaaaataaaagaattcttcaaattcaaataggaaactgagaaaccatatcataatagtattaagatatctcccaaggtgtgcattctgggccattaatgcataccttgggtaactgaaatacaccaaggtgaatattaactccaaagaaacctatgaggaaaacattatcacttaattctaatgcggactactgtgtcagtcaagaaaatgtaggggggtgtgtgtgcacatgtgtgtgtgtgtaaagttcaaaaatgcactatgttcatttcctgttcatctgaagcaaatacaatatgtattacatttgtctattgtttgcttagaatttatatctcaaaataaatggtatctgaagccatctgccgcatgattaaaaagtaaaaggaatacacagaaaaacaaaaaagttatgggctattttagcaaaattcagtggctgtacttaatgcatcctttccattggtgcatatgtttcatcatttaatctatcaagaagagtcaaatatccataggtcagggccaggggtgatggctcatgcctacaatcccagcactttggaaggccgaggcaggtggatcacctgaggtcaggagttcaagaccagcctggccaacatggtgaaaccccatctctactaaaaaaatacaaaaattagttgggcatggtggtgtgcaccagtaatcccagctactcgggaggctgaggcataagaatcacttgaaccttggagacagaggttgcagtgagccaagatcatgccactgccctctagcctaggtgacagagtgagactgtttcaaaaaaaaaaaaatccataggtcagaaaatttttcctctaaagcataattaacaattataaaagtaaagttgaattttttaatttagtcaaaaatcaataaatatttttatccttgcaattccttcctatttaagttttcttgtgagaaacagaccacttgtttcctgaacattatggtgcatctcaaagagcaaacagaatcacttagatcaaatagggtccaaagcccagggatgttgacccaacttcctagttaataattcattacatttgtgtagtgatttattctgttcaacatatttccagccattcttccacaaggagttctatgagaaatcataaaaagcggtatcccttgttgtcaaaagaagaaatggacatttgtcaaaaggcacacacatattaataaaaagtggtgatggtgatttttttcagaaagccaacatttaccaagcagctatgatgcttcctatattcaagtactctctaatcactttctcatttaatggccccactaggaataggatccaagactggctcctgtctcaacactctttctactcgacactatttctatttgttgtcagtagctcccacatctgctcttaaagcctgtcaaaaaactctcctttaactctgcccatctgcggtgacccaatagagaatatatatttcaggcatatcttcctgacaaagaactgttgtaactaatacaactaagttagaaacattttcctgaattcagttttagaacaaggctgatacaaaaacctcaggtcaaaactacaagattaaaaattaaagtgtggtccataaggtcatttagaatgctcaaaaatataagtcagatatgtggagaaagaatgaaactaataagtataatcttgaatatttcaatctaactttgataaaggaaacattctaaatatggcatatttgtagactaatggttgattttcccacaggaaaaaagtgttttgctttttagtttaattcaaatagcttgaaatgcctgctataaggtgtgactttaaagctaagactacaaactcaaatgtttaagcaggaagcgtgaatagggcagatgaaagtaaatagggagtggtgaggccttggcacactatactgtatctgccccgatttaaacacattcagatccaattgaccaaaccaaaagaatccctgaatctaatatactagcacagatgtttctgtgagccttattaattcagtcaccatgctgtgcattcatgcaatatatgtgcctgaccttggaagacctcggaaagataggaaatgcatgtctccgggcctgatgagcctacaataagccaaaaggactgaatgaggagcaactccaaggcaggaagtctgcctcattttaatggaaatagcataagctttgaggttagaatcccagtgcaaaaacactccaatagcaggagatttcaggcagaataattaacctcacttcagctacaaaatgtgaacaattcctaccttttagggtattaatgaagttaaatgatttaatgtcaaagacttttccagcattttcttatttgatgtctctccatgcaacaaactattagccatattccctctttacaatatttctcccctgttttcttagatgacagcaacctaaatttaaactgagaggtgtttacctctcctctaagttccagctgcatatctcaagttgagtctcaaacatgtccgaagttgagcccattgtgtttcctacactcccactccccatgtttctctccagcattccatctgcatggccctaatattcagctgatcaaaaagaaacgtgaggaatatccgtgacttttccaacccccccaacccccaccattaggtaaggtctattattacactcattaactatttctccaatatacacccttgctctgttcctcactagtagcactagtctagaggagaaataattagggataaaattaaggaagtgcacgtgaacacaagggagatgagagactacagaaatatttagtaagacagaactttttgaccaatcttttctctgtcataccatcagaggaaactctttaaaacttaaatctggtcatcactcctccaatgtaaaattttctaatgatggttaatccacaaataagaaaactcatattttttgttatagacaagcatgcttctctggcttctctctctagtcttacttcctactactcctgtcacggtcactcttttctccagatacatagaatccatgaggttccactggtgcctttgcatgagctatgttccagtctcccctgcacctcctaggaaatgactattcatcttttaagtcatcgtggattcttacattctatcacacacagacttcactcatgtgccccctttatatggcactagtctagcagatattttaaactattactctttgctgtaactatttgttgacacgtctgtgtctctcaccaaatcatgagttcctcctgaggccaaaatgatgtcttcattcctccatccactaggccttgcataggaactagctgagagtaaccaatgaattgataacacctctcaccactttaaagtaatgagaaaaccttgagggtcactgccataaaataatttacttttccatgaaataaaaattgcacttttgtaaaaggaaatcacaactgcaaaaaagctcagatatgctcagtctagaatggaaatgttttttaatcttccctgactaggctaagtagatttgtttatgaactagtcttcaaagttttctggtctaagcctcttttaaaaaaccagtgatgatggtttttaatcacttataagaaggtgtgtctttcagaacctattgctttgactctcaggatgttctaaaatatacctaatttctaacacattccccaacagaaacaagactgagaagaatgcagataaagatgtctcacacttgacatgcttttcagaaagttaaattagtgctccctatgttaaccaataactagattcatctgatcgaggaaaacagaggtaacttaggttgataatcttgctaaatttcaggtattctgaaaaactgatttcaacaagtatttatatagtggaattgtgcttagagctgtgagaaaatagaaataccaagtaaaatcaagtacccagctctgcagtcctctgttcttcagaaattgttagataatgatatgctaaaataataaatttggctaaaattagtgaaatagataataattaccataggaattataaggaaagcatgaaaagcttaagaaatgcttcagagagaggaagatgcacatttctaaatgtaccacgtaaaagctagtccagaaaaccggtatgaaagtcagttggcttgctagtaggcatctcagacattctgtatcaaaatttgagctcctgatagtgcccctcagcccactattcttacggtatttaacagttcagttaacagcaattcttctaattgccagtgccaaacactttgttgtcatctttaagcttctccccttctctcatatcccacatccagtctgtcagaaaatcccatcagttttaccttcatttatgaaaaatgtgacctcttattacctctacaacttaccatgtcactgcttggctcagaccatcctatgtatctctgtgaccccactcccagtactctccttgcttaccctgaccagctccatggacctccttgctgcttatccaagaagccaggcacatccctacattaggccttcccacggccggcatgctcttctagatccatgactccctaacttctttcaagtctttcctcaaaaataaacttttcagtgagacctcccctggtcaccctgtctaaaagttcaatcaacaattccaacctcaatatgccatatttcccttccttgctttattttctctgtactatttgtcactaatatatactacatttatttatcatgtttgttttctgtcttctccagtggaacgtaagctccatgaaggtacataagaggtgataaatatttacttcatgaatgaatgaacagcaacccaaatcaagaattttcaattaatttgacatattttactgatcacacatgcaaaaagttatcctatcatatggcaataaaataccagagaattggccaggtgctagtggctcacgcctgtaatcccagtgctttgggaggccgaggcgggcggatcacgaagtcaagagattgagaccatcctggccaacattgtgaaaccccgtctctactaaaaatacaaaaattagctgggcatggtggcatgtacctgtagtcccagctactcaagaggctgaggcagaatttcttgaacctgggaagtggaggttgcagtgagccgagattgcaccactgcactccagcctgggtgacagtgcgagactctgtctccaaaaaaaaaaaaaaaaaaaccagagaattatctagttacaacagggaagacagataaagggcatacaaatagcataaacttcctgctcccttttggctctcattctagaggcaaatattagaacattcacctgcatatcttaggatttggttttgtattctacttaggtcatctttcatgtttgcgagaattcatatagaaagcttctgaacccaaaacacaatggctgctgttgaaaggtcaactgcgtatgactgccaattagatggcaagttgtatttaaaatccagatccctaattaataacgattttgccttactcaagaactgtacgcagagcatgaatcatctatatgcagagtattcactgtttagttgttgccaatttaaatattcatgtctctaggaatggcttcaatccaccctggtgcataaaataaattagcattcttgcactctagagagaagtatgtgtttagcaccaaatggaatcagcagatgactaaatactctttttttcctctcttgtttctatcataaatacaacagatgcaagatgctggaatgtggacaaccccagaaggttggtgtttgcctctaatgcagaaataaaccattcaaaaattcattccatatagcataccagagttagcaagagcccttgggttcctttattgccatcaagttgactttatgactaaacatatcacagcgacccccatagtacaaatgaagcataaggctacctttgctactaaacatcacggaatatcttataaatttacagcaatgataactgattcagagttactacagttcaacagtaaattttgagcattacccaaattcatgggacacttaaaggtatgagacatggatctttaaatgataagttactggagtacaactgttcctatattaaatagggaaaaattcctttctaggaagactcagctctcttcaatcacacctcttttacaagcagaatgcgcaaggaaaatggcaggacctcaacagttgtctaattgtccggcttatgttcctcaaggttctctagcttttgctatctcaatgtgagtggtactttcattctcatttttattcactatttgatgtgtaaggaatgcatactcagagacagtcaatttcagtaaaaaatacataaataaatcttcaaccacagctaaaatcataattaatagtgaaaaactgaatgccttcctccttaaaataaaaaactaaacaaggatgtcccctttcactagttctatccaacattgcactagttctagtcaaataatttaagaaagccaaagaaataaaaggcatacagattagaaaaggagaaataaaactacctctctttgcagatgccataatcttatgtgttaaaaatcctaaggagtacactccccgctgaaaacagtagagctaataaataagattgatacagttcgcaaaaggcaagatcaataggcaaaaatcagttgtacttatagacacttgctgtgaaaaatctcaaactgaaattaagaaaacaattccacttaaaatagcatcaaaacataaaaaacttagtaaaaaaatttaacaagagaaatacaagatgagtatattgaaaactacaaaacatcattgaaatgaattaggcaagacataaataaatttaaagacgttccatgtcatggattagaaaacagtatttttatgatgacattattccccaatttgaactataaatttaatgtaatttctatcaaaattccaactgtgtttttgcagatcctaaatgcaaaaatgaattttgtaatcctaaaattcatatgaaaatgtaagggactcagaatagccaaaattatcttgaaacaaagagcaatgttggaagaattcccctcatttgatcattacacattatatgcttgtatcaaaataccacctgaaccccaaaaatatgtacaactattatacaaacatatcaattaaacattaataattcttttaaaaagaattcccagtttcaaaacctactacaaaactataagacagtgtgttacaatcataaagacagacatatagatcaatgtaatagacatcagagtccaaaattaaatatttctatttattgtcaattgattttcaacaagggtatcatgacaattcaatacagaaaggatactcttttcaggcctcgtgcagtggctcacgcctgtaatcccaacactttgggaagctcacggcaggtggatcacttgagtccaggagttcaaaaccagcctgggcaacatggcaaaaccgtatcttaattaaaaatacaaagattagctgggtgtggtggcacgtgcctgtagtcctaactacttggggatgaaggtgggtgtggtatgcggcaggaggaccacctaagcttctgggtgttgaaactgcagtgagccctgattgtgtcactgcactccagcataggcaagagtgagaccctgtgtcaaagaaaaaaagaacaatcttttcaacaaatggtgctagggcaactggattcttttttcgtgttttttgtttttgtttttgttttgtttgtttgttttgagacaggatctcgcttagtcactaggctggagtgcaggtggcacaattttggctcactgtagcctggacctcctgggctcaggtgattctcccacctcagccccccaaagagctgggactacaggcatacaccaccacacttggctggtttttgcttttgtttttattttggtagagagacggggtttcaccatgcttcctaggctggtcgcaaactcctgggctcaagcgatctgccagcctcagcctcctgaaagtgctggaattacaggcatgagccaccacacctgagcaacaattggatatatacatgcaaaagaaaaaagctggactcctacctcacaccatacagaaaattaacaaaatggatcacagaccatttatgcctgtctcaacctatttatgcctagtgttccattattggaatgctaaggatgtgggagttatttatatcctactgctcaaggtcattgccaaggtctgattgcaaaaattcaaaaaattgcaacctcaggcataaatgggttttaatataagagctaaaactataaaacacttagaagaaaacataggagtaaatctttgtgattttggtttagatggcaatttattagatatgacaacaaaagcacaaacagcaaaagaaaagatagataaatcacatttcatgaaaactaaaaaattttgcttatcaaagagtactataaagtaaaaagacaatatacagaataatagaaaatttttgcaaattatatatatgatgtgtcatatatctggaatatataaagagctataaaaactcaataataaaacaattactcattaaaaaatgggcaaagagtctgcatagacattactccaaagacaatacagtcatcccacagtaccacagggtgttggttccaggaccctcatggaaaccaaaatctatgatcttcaagttcttaacataaaatggcataatatttacatacatcacatcctatcatacgctttaaatcatctctagattatagtaaatcctcatttaacatttttgattggttcttgggaactgtgactttaagcaaaacaatgtaacaaaatcaatttactataggctaattgatataaacaagggttaactttctaccgtatgtattaccgagcttgtaaataaagaccaaaacatttctaatattaaacattgaaataaatgtgagccacacatacatttaagaaagactaaggtaagtatttacccaattattatcattaaaggtggcaggtgacagagcctatcatggcagctccaggtgcaaggcaggaaccaaccctggacaggataccattccattgtacacagggctcagtcacacacatacccacactcattcatactgtgacaatttagattcaccagtttacctaacatgcacatctttaggatgtgggagaaaactggagacccagaaaaaacccacacagacatgggtagaacacgcatacttcacacagttagtggtcccagctaggtaccaacattggatgaaacaacattattggaggacctgctgtacttacaatacttaatacagtgtaaatgccatgtaaatagttgttatactgtatttttaatttgtattatctctattgttgcatttttattttttattcagattcagttgacccttgaacagcatgggtttgagctgcacaggtccacttacacagatttttttcaaccaaacatggatccaaaagacaggatttgtgggatatgaaatctaagtatacagagggccaacttttttttttttgagatggagtctcactctgtcacccaggctggagggcagtggcacggtctcagctcactgccacctccacctcccaggttcacgtcattctcctgcctcagcctcctgagtagctgggactacaggtgcctgccaccacgtctggctaattttttgtatttttagtagaaatggggtttcactgtgttagccaggatggtctcaatctcttgacctcatgatctgctcacctcggcctcccaaagtgctgggattacaggcatgagccaccgcgcccggccacagagggccaactttttatacacatgggttccgcagggcagatttcaagactcgagtacctgggtatacctgagggtcctggaactcatccctcatgtatacagagggatgcctgtatatttcagccactgttggttgaatctgtgaatgtggaaccagcgcatatggagggccatctctatacaaatagatcacatatgcatgaaagatattcaacatagtagccatcagagaaatgcaaataaaaccacagtgagttatcacttcacgcccactaagatggctatgataaaaatgcccataatcaataacacttgttggcaaggatgtggaggaaataaaactttcactcatttctaggctgactgtaaaatggtacagccactttggaaaatagcctggcagttcctcaaaatgttagtcatacatagaattatcataccacccagtaattcctctcttcagtatgaaatcaagagaaatgaaaacatatgtccacataaaaacttgtacatgaatgtttatggcagcattcttcataataaccaaaaagtagaaacaacctcaatgtccatcaactgatgaacaggtaagcaaaatagagtatatccacaaaacaaaatattatttgtcaatgaaaggggatatagtactgatacatgcaacaacgtggatgaatcttgaaaacattatgctaagtaaaagaagccaatcacaaaaggccacatggtatgagttagtttctatgaaatgtctctagaataggcaaatctatagagacaaaaagcagattagtggttatctgggggttgggggcaggagtgactgctaatgggtacagggttgcttttggaggtaaggaaaatgctctaaaattaggttatatattgattgtcatacatctctgtaactatactaaaaactattgaattgtataatttaaatagggaatgttatgatatgtgaattatgccttaatagagtggttagaaataaagacaaagacatacccatacatatgtcatcagaaagaggagtgaagaggcagcctgtcctaatagtaaaactcagacttgaaggatgctaatactttggcagctcagaaccaatgaggaagaagaggaagtcaagatcaagggacgggggttggaaaactgctggtttaaagcacttaaagaggccaggtcacgtttgtcaacagaaaataatctcaatataaattacagatagagccccttctagaatttgccatcgtatggtcaggtcacaacagtaaggaattcaagatttgaggaagagagggaggggcagtattaacgtaaacacagagagacatggtatccagcatcaggaaactattttccacaagatcatcactagtggcctcagatgtttagaaagagaatcaagacctgaggaggtggtggctcacacctgtaatcccagcactttgggaggccaaggcaggtgaatcacttgaggtcaggtgtttgagaccagcctggccaacacggtgaaactctgtctctaccaagaaacacaaaaattaaccgggcatggtggtgtgtgcccgaagtcccagctacttgggaggctgaggtgggagaatcgtttgaacccaggaggtggaggttgcagtgagcagagattgtgccactgccctctaacttgggcaacagagcaacagagtgaaacactgtctcaaaaaaaaaaaaaaaaaagacctaaggactaaggagtaaggtagctattacgtggagaattagaagctcatctactgtctgaggttgaaggaggcagtacagtcatcccccttatctgcaaaagatatgctccaagaccctcagtggatgcctaaaaccctggataataacaaaccctatatgtactgttttttcctatacatacatacctatgataaattttaatttataaattaggcacagtagaaatcagcaacaataactaataacaaaatagaacaagtataacaatgcactgtaataaaacttatgtgaatgtgttctctaactctttctgtctcaaaataccttatcatactgtactcacccttcttcttgtaatgatttgagtttatacgatgcccacaggatgacatgaagtgaggtgaattacataggcattgtgacataccgttaggctactattgccgtgtattcctgaatcatgtgtaaccatcccttacttgaaataaatggcttggtgtcacttgtttcaggagactccttgctgaaattctcaaataaactcaatgttttctggtgcaacatgctgtcaatcagaacacattttctgtttatgtctttcaccaacaaatttaatgcattttccatctaattaatcacttattatgcactgtatctgtaaagtttgcagtttgaggtatgacaaccaaactagaatttctttctccttcttcacaatttaatggatagaagattcattcttaccatagagcaacctcagcatacaattatttttttccttactaattcaagaaatttcaattttgcacttaaaggaataactttatgggttctctttggcatatcccaaccaccagcatcactactcttgtgctttggggccatgttaagcaaaataaggattacttacacacaaatgctgcaatactgtgatagtcaacctgataaccgagagggctactaagtgactaacgggcaagtagtatacagcatagatgtgctagaggaaaagatcattcacatctcagcaggactgagcaagagagcacaagatttcaaaatgttatgcagaacaatgtttaattcaaaactcacaaattatttatttctagatttttcatttaatattttcagatcacagttgactgtgggtaactgaaacctcagataaagggaaattactatatttttagaccatgcaagtagaaagatacaaggaaaatgtggagagttaaatagggctacaaggggttaatctatagttcaaagactaggatgtgggagatgagcgagatgatttaaatgttctctctctctctttccctctcctacacttaagtcaagtcctgggaatggcataagtatataatggaggccatcaggggattcaactgttgggagtagagaatgcagagtcaggaggtaaccggcaatgccaataccatgggagattgtagctgttccctgcagtttcctccaatgcagcaacaccaaaggaaatcataaatgaaaaacgatggtgatgatgaaccatgactggcagaacaaagcacaataccaaggccaaattctgggttttatgggcccaggaggcccagaaggtaatgcaatatgagggccactcaaatacccatagttccttcctgactggctattcagactcaggatccagtataccaggaatgaactacgaaaaatatgtactgtgtgtccactatataaacggcagtattctaggtgctttcccttccttctatgattcatgcatagagagagagattatttaaactgcaatacagttttcctttcttaccaatttattttcaactatatgctctaaatatttacaagttcctctgttgtccttttcaggatttaccatcttgctacctttcatatggaaaatactggcagaaaaaagaagacattcaaagttgggctcataaaagaaatgccccaaagtggcccccgagactcactttagttcaaactatgcagtgacttataaattaattagaaacatgaacaaattgcagctaagaaaagccccctaaaaaaagaaaagaggaagaagtaagagagagggataaataaaaactaacatgtatcaagtgtctgctatatagatggtaaggttcaaggtattttcccttccctgtgaagtgggaatcattatcaccattcttattgacaataacagaaacacagaaggatcataactcatccaaggtaataggattgctactacagatggcactggaacctaggtctttctgatctaaatctatactctgagcccaatgtaatgctacttctattaacaggtctctcaagctcactattctaatatcatcatgtacaacaaaataacattttagtcaacgacaaaccacatatacaatggtggtcctgtaagatcgtaatgtcgtatatttttaccttttctatgtttagatatgcttaagtaaataaacaccattgtgttacaatcccctgtagtatttagtaagtaacatgctgtacaggtttgtagcctagtagcaacaggctgtatcatgtaacgtaggtgggtagtaggctataccttctaggtttgtataagtacactctatgctgttttacaatgaaatcgcctaatgatgcatttctcacaagtatctacattggtaaatgatgcatgactgtttatcaaatgaaaggcctaaattttgaagtgtcactctaaaatttttgtgtgattgtttctatgctataaaaccacaataatttctggccgggcatggtggctcacgactgtaatcccagcactttgggaggctgaggcaggtggatcacctgagatcaggagttcaagaccagcctgaccaacagggagaaaccatgtctctactaaaaatacaaaattagccaggcatggcggtgtgcacctgtaatcccagctactcagggggctgaggcaggagaatcacttgaaccagggaggcagaggttgcagtgagctgagataatgccattgcactccagcctgggcaacaagagcaaaactccatctcaaaaataaataaataaataaataaattaattaattaatttaaaaaactacaataatttctaaaatctattacaactccaaaattctctaattgtatcttagtcaaataatatgcagaaggaaaattacacaacttaagattccaacaatcctgagacctatgtttcttctatgtattacataagcacagacgctaattggctctgtgtatagtgcttattactggtgcttactgctatacccgctttatagctattaaatactttaatccttctaataaccctatgaagcaaattattgtcttcattttataaagaaactgacatgcaaacatattaactgttcaagttaaaacactgataagcagtgaaggtgagatttaatccaaagtattttagctccagagcccatgtgtgtaactgctaggctgtcggactttccagtaagaactgaaaaccttctcctagaggttcacagtgttttagttttgtatacattttctcatttgatcccattatattgtgctcattacataaattaataatctaagaaaacaatggcttatttaatgtcattcagctatcaaccagcagaaaacactcttctaattcttgcaatacaccatgagatttttttcttagtgaattcttaccactgaaaaccagcaccaccagagaaataatcacttaaatataatagatatagagtatatataacagataaaagagacaataagaacagcagcaaaaaaaaaaggatttctctcctttaaaattcttagacccttaaattatattattttctctatcaccaaactggactagattacactaagacctttgaagcttagagatttaagacaattagctaaaccattaggaaaatattatttgccacacctttctcttgccttgctctttctttaatttggcataaatgcattttttctaactgcattgattgttcaccaaactaggaagcttgctcttgatgctagtgaagcaatgtcttattatcttgattgtataccaagattatgcttcagtctgaattgtttacttaataatttcactgccttaccgaatgccttcttttgatctgtcttgatgtccaaaaatattagggcattaaatttattttcattattaaaagaacaatatagactataaaaaccacatcgcttcagctcctttttgcataatatgatgggacacatgaatttgatcattaccagatggtttatctgaaagattacccaataaaaatgactgctttttccctaaagtctctttatccttacattcgattaaatgacataagatgggatgatctagattttcttagagtgaattatctgggaatttaacattgctttgaaaagtctctgagtgatgttagacatttatttcccaccaggaaggataaacagaacacaacataaaatattcaccctaagctttaattaaaatcatttaagatcaaaaagggaggtagcacagcaatacagggaggaaaactgcaaaaacttcagtatcatggacattaaaaatacccagtggtactttttttagtgaaatttttagaacaaaatcaatttaaatagttaagaaaaagtttagttaaataaaaaaaattaaaattgcaaaatgcaaactctgtttatgaatgtcttcctttaaataaaaaaatgcatctttgctaagattttatgcttatagaaacacttgcttactcataattcaaacatttcacgagtttccagctataaacatgtttataattttagaattctgatagcagataatcattttataactataaaacaatatcaaacaatagttatctaaatagtttcttgaatcatcatgtgatgtttacacagctgggcatttaagaccaatgtgtgagagataattgcatagctataattccgagcctgttgttttaagaacaagcaggctcttggggagataaagacagggtttgtgattttctaactcaaaaagtaatctggagaataaagtatgtaaagactcctagagtgcaatgctgaaagcacaaatttcagtttaaactaggaaaggcaaaagctaatgttttcattgccacattaattttctcacattatacctgagcagtgttcttgtttctaattatattcctacatgaatgccttattacatataatgtgggaaatattacagtgtgatatcttgtgtttcttggcttgtgcttcttttatatttataactttaatgttctacttagtgagattttgtatataataattatgctccagtacactgactctgctccacaaaacgcaagtacaaagttctcttaaacagcgggtggactagtgtttcgtgcatgtttttttggtcttgttttgtcttgcgtcatttttgttttggtttttttgacaagttggataagaaaaaccaaattttttctttaattaaaaacaataatggaaaataatattacagataatataaaatagaataaagaattgaggttttgtgtaaatttttgtgaatatatctgaaaggttttctgaaaaacatgaagtgttcaggtgtgacttccagaagctgaaaagcaatagctgtttagactctccttacatcatcacaaagtttaacaaaactgacttcttgcccaagagttcatgaaatcatttatactcccaacatttattaagggcctaatgtgtgtgtcagacaatctgccagtcacctgggtttcagattaacaaggataagtcctttccttgttccttctacatatgcaatccctcttcaaaaatctgcatttccttgctcatttcaacaatggttatcctttgtttgtttgtttgtttgtttgagatggagtctcactctgttgcccaggctggagagcagtggcttgattttggttcattgcaacctccgcctcccaggttccagcaattctcctgcctcagcctcccgagtagctgggactacaggtgcacaccaccacacctggctaatttttgtaattttagtagagatggagtttcaccatattggtcaggctggtcttgaattcctgacctcaggtaatccactcgccatgacctcccaaagtgctgcgattacaggtgtgagccacagtgcccggccacaatgatttttcttaaaagtacttgtcataatacccaaattttcttaaagtaacaatttatagttttccaaaagcgaacacctagagaactttcatggcactttgtttagccgacaactttgaaaattttattttattgtagtaagaacacaaaataagatctatctttcaactgtgattttttttacccttaagtgatgtctgctttattctatccctttccatgaaaactgaagccccaaaggttgaatgaatcttaaaaattagtcactttctcagtgtaaaaacattcattgtatcaatatgtaatttaaatatgctatttttcaagccaagtattgtttcagaattaaaggtgttcaaatattccctcaagaatatgtttgtccttcgtaccagagggcattggttctaggatccccactgataccagaattctcagatgctcaagtctcttatataaaatagcatagtatttgtagcaaacctacacacctcctctcatatcctttaaatcatctctagattacacataatacctaatataatgtaactactatgtaaataattgttgtactatattttttctttttattatttttattgttgcgttgtgctctttttccccacatattttcaacccacagttgattgaatctgcagataggaaaccagtggattcagagggacaactatattctccaaaacataatcttaaatgctcacattttagcttttaactacttactactacaacacaagttcccagtctgcagaacctaaacccattctgcggagtgaaacccaagataatcactctttaagtgtatctcttagttgtctctccatatttttatagattggagacatatctttacaacatcttttttatcagccttaaagctctgaacataaatctaaaacatcaaatctcaacactgaccctgaagttatataatgcaaaaacaaacaataaaaaaaaaagcatttagcattaaaagagctgaatacaatcttggctcacctactccccagtaagttaacaagacctgagctaatcatttacgcagaagcttggatcactttacagagtgaataatacttatcacaaggagagtttggaaagatgataataagataatatgcatgtgagagcacttacactgtaaaatatacgtccctgaggttgctgcctgctgcctacttcatgactatttttgcgccactttatgttcccgcttccttgcttctaactcccatgaccctctatgtttttgcctaattggcaaacatattctcagtttctcagctgcaggataccaggtgaccttgctctctgattctgcctcttttctactattagtcaaatgaagtagcttcataagtagcacaggcagtttcctgtaaagtgtaattgggatagtgttggaagggcccctttcccaaacacacctcctctactgttctgcctagggcatgtagtttcatcatcaaaatataattatcataccatatatactatatgttagtataatccattaccttggattaaagcacaatttcttcagcagtcctttactagatgccagtaccctaaagaataaactaatcaagtaacatgtatttgctcagcttattttatatacattagcgctgcgctaaataacaaatgaacccaataacggcatcgtttcctaaataagagccatcatctggagggagtgggaccacagaggttaggtgtttctcattcagcatgataatggagaaggaaagagtgggcaagaacctagcttctgaggaacagaaactcagaagatgctacactcggaagaggacccaaagtagccacagtgcagaatggaagtcttatgtatgaaaaggattcaaaacactatgacatttgctgttcctttataattagccttctctttgtaagtagtcctaatgaagaaatttggcaacaaatataaaatagtttctccacaaaataattttagggactcccttaaacacagaaaaaaatgtagtagctgttatttaagtgcccaggaagtctcctcactccaaaatatctctcacattcaacacctagaaattcattcttctatagatccaaaccattaggcaagaagtgtcctaccaataatgccgtccttgaaatgcaagcattgcaggtataaataacattgaatcataacatgctacgtgactttcactgttttgttttgtttttttgttttttttttgtttttttgaggtggagtttcactcttgttgcccagcctggagtgcagtggctcaatctcggctcactgcaacctctgcctcctgggttcaagcgattctctcgcctcagcctcctgagtagctgggattacaggcatgtgccaccacacccggctaatttttttatttttagtagagatggggtttctccatgttggtcaggctggcctcgaactcctgacctcaggtgatccacccaccttggcctcccaaagtgctaggattacaggcgtgagccaccacgcccagcgactttcactgctaaatccatttctttgacaaaagaaagtgaagttatcaagtgctctgatagaaagcctcagtggtcattcatgtggtcagcctgtctataagtcatcttggggactggtttttaataagcagagggtttcctgtgctccaaaatttgcttagggctgaccctgacaactctatttatttatttatgcatacaaacacagtttaaattagcaaacagatgagttaaaataatgagattaccaaatgaacacaaaaggtatcctgaatcttcccaaacccaattcaaagccaagccttaaaatcaagagggacagaagtgctcagcaaaccacctgcaatttaactgagttcaaggagttaaaaggtcttaaaattaaccatgaaatgtgaaaaatatatgaatggtcttcaaaaacaacatttgggaaactttatgtcagaaataccaacactgtggttgccaagagtgaggcattttgcgatgactaacaaattaaggcatcttaatgtgaaaactgattatataatgcataatcaagcagagtaaggaggaaacagaggtatgctttctcattaattctggcttagaactacattgcgtaacatcaccagatttatgaatatagagcaactttaaaaatccacggatgttccctgaatcaaatcatttttatagctcaaagaggctgtcatttcaaatacacacatttattcaaaatatttttattgtctctatttactataaaatctcaaaactatagtagtcaggatggtcagcaaggggtaattggtccagaaaaacaattcagaaaagagaaatcagagaaaaatggctcattttcagtgatgctgcctctagttcatgttggggatttttttctttatgtatgtagctacacagggttctgctatacaaataagttggatatgttttttaaaatcaactaatactaacacaaatgtagcactgactatgtgttgagaactgttctatgtatactatctcatttaaatataatactcaatacactttaatgatgcatggtataatattgtacaataatattaaatataaattgctcaatctcattcaatatttcaatgatctgatactttttagactaaaaataaatgggaaaagagaaagagagaagagaaaaggcataattattattataagccacaagttttcacgtataataggatgaatactatattggcattcaagtaatttagttcccacaataaataataagatacatcatccaacctattatctgctatatcataaaaataattttatatgcaggatcaaaaggggtgattttcttgacttttctgtgactattttcaaaagtcatgaagcagaacatccacgcaagaggataaactggctctgcagctgacccctggaggtactaatgcagagtttgaaaggggaggaaagcttattactagtgaccatgagattccccaacttatattagtcagaaatagcaccccaggatggaatactaaatcataagggtatcctacaaaggcagtctagaatgtgagaggtctaggatctgtggatgtcagagaagtctgtattttcacaaatcataaaaaccgaaaccgctttaaacagtttttttaaaaaacagctcatactccctctgtgatttcacaaaaggctgtccgtggatctttggcggggaaaaatccctgctagagacaaaaaggggaacaaattaaacaacaatataaaacccaaattgatttaaaacttgtcaggaaaaaaattatttcacaaaagcaaagaaataatgttaaaaatgagaatgcaaaataacacaaaggggaagtgaaaaatagcaccgctaatcagcaaaggcaagagttccaataaattacggctcattctgaaatgacagactccagggtgttttcaatcagtcttcagtgagaaaatatttaaaaaggaagaactgtataagttcaagtaattaacatcttacttgtataggaactagttagtagggagaaggggataaaacttgatgccataacacagcacttggagaaaactaagtctctacaggttagcaggtccagatggcaagaaacccaaggtaatataacaagcagtggtggagtatttattcaaactagtcaatcatcactgcaaggccctggtacctttcttttacaaatgagttcttgtttcagccatcaacttcatcatccccagaagcccaaaacaacactccagtttataacctgattgaattgcagtgatttcagacctagtactattgtgatctgggatctttttattacggcatcataaacatcactttcaacaactttcctgtatgtctttgccccgttctgagagatataagtcagaggtggagaaaaggctacaaatgcgttgatttgtggcatgaagaattgtgcagaatcttttcctttgatatgacagtccaaggggtatattaacaagggcagatggttgccatcatttgttacaagcacctattcattataaaaaaggaaaaacaactcatccctcaagaaaggatttaaagtgataccagaagacctcgatcttccactctccagcctccctgcttcatcttggtaaggatgttgttcctaacccttccttctatgccagggaaaggatatgcaaactaaaaaagaagaagtaccagatgtgaaattctataaaatgccaactgattcacaccctacactctgaggatttacacacacttccacttctggcaggaccaagggtaatgagaattctgctgtcgctggtgaagaagtagcaaatcacagccaaaaaggacacctacccctgggaacgagaacttcaattccaataaatgaggcaatgctgatgagataaaatttacatttaagtcacaaagctactggaactgaattgtaataaaaaaaagtgtcagacaataaagcagtttgataacgtcagcttttttactgttgtgtgtgtatctgaaagaaagtttctttaaaaaaaaaagggtaacatttgaactagcattgaagttatattattttacaatattttatattaaggaaatatcaaaaatgaataatatactatagtttattaaggacacatgatgggttagggacttgacatgttttatctcatttagtatacttgatccagatagacccatttttaagcagcagcagctcagaaagggtgagtaactagtccaaagccctggcggtaggaaggaccagaagtgggattcaaactaaagcctgccagactcctaagtcattgttgtttgtgcctcagattccctttgcaaaattcactattaaattttttcaaagttataataataactattaagggcttactatgttccaggtatactgtctcactatatctccaaacagctatatgaggtactatttcacctatttacagttaggaaactaagactcaaaggaggtaagtaacatgcccagttagaaagtaggataaacatgattcacattcaaatcactgcctccaaagcctcagcacatttccaaaattcataagagctacaaaattggaacagacattaaatgcctggtctttggggaattcctctattctgcaaattttagatttagattcccacctgtctagcttcatcttttatgtgtttgttttctcctctcttcttctcattatagataccataacttcctagattcatgaaatgttagagatagaggttcaccctccgaaaaattgacctactgaggactaaaagtaacttaataacaaagtacaatatacatcccaaattgctcaacagttggataaactttccactgcatgatgccgtaattcaccatttccaaaataagtaaatatgaaggcatcgagaaaagactatgaaaaatccaattctagtgttttgaaggtaacaattagatataatgacttcgtatcaagggtaaatttttgaaatcagtcactactttaataggattttcttatgctataaaaacatcaaaatatgcaacctagctttgaaagctctctaagttgtgttcccaacctggcaaaccctgtacaccagctcatctgttctacttgccatacctagtataagtccttgtctgtcctatttctggaactgtgacaactttctccacatttccatcttttaaaataatcaaactcaaccattcatccttatagcttctatcacaaagtcccagccatgatcagttgaaggctcatattccgttactttgaaattctatcaacagatttatgatgacttgattatactttttttatatcttctctttccccaagacttccctaaaatggtgaaagagcaatagacacatacaaaacaaataaaaggcctaactgaatgagattttcagcatatttgcaaggagggtgctaacaaaagatggataacttacttagcagggaggggaagctataactttaaaaggggaataaagataagagagttgattcacttcacagaacccttaaggaggtttggggtttaaagtctgtttctatggggtacaaaatgcccacacacacctccctcctactccctgcactagatacaagcaccaagagaataccgcattttccatgggataaatttaactggagtagctcaacactcagagacatcaggtactgtgaagagcaaggaaaaaaagtggattaattaaacatccatgtgttgagttaagagatgcctcctcctcagcctctatctcttcatgtgcaaaaacctggaaaccaggcatcttccacacacataaggaatcaaagattacttccttggaaaaactgacctgccgcagagaaaaatatctttattctcagcttgaggttctccagcaaagtgctaggtcctaacaccccggagattccaaaatgaaacagatcaatcgacaaggcctagaaacagatctgcaaatcagccttttaatgcttcattcaaacctagactgacacccaagaaacaccaaacatttcatgaaagatttcaataaaaagagagaccaaaataaacagagaaaaaaattaaaactggaagaagctgatatacgctagaaagagaaaaaagtcatcaaaaaattttatcagtatcctcagaaaggtaaatgattaagattacaatcttaaaataaggacaggatactacagaaaatgaaaaagcaaaagacaagaaagaacactaaacaattcaacttacacttcatcttatgcatgcagtgaactgtatttttgttcaaaaaaaatatatatgttctacccctctcagaggggaggctatcctcccctgtcccctccatggctggctatttgctattgatttcctttgggcaatgaaatgtgtttgaatgtgatgtttcaccgaaaccttagagcgagcatgcggttggcatttttccccctctggcacaagactggcaatattctagatagcagttagaatattgatataatctagaatatgatataatctagactattgatatcatctaatattgaatattagattccagcattttgaatcctcaaaggaagatgatgtggacacatctgtagctgacccacagtgagtaactatcatgataaggaattaactttgtggagatgagtaactcagaaatgaggagttgcttttcaaagggtacaaagtttcagctagataggaagaatacactttaagatctatgtcacagcagggtgactacagtcaaaaacaacatattgcatagttcaaaataactaagagagtaaacttcaaatgtatcaccacaagaaaaaagttaaatagtgaggtaatggatatgttaattaatttgatttaatcattccacactgtatacatacatccaaaacatcaaattctatgctataaatgtaatacaattatgatttatcaattaaaaataatattaactttaatagaattaaacttttgttgttgaaagcttttgaaattctgggcatgcttttttacttcagataatctggtctatcctgacaattacaataggtttgatcacattgacagggctttggattttattttaaaagactgacccaaattagtaggcacatagaaaacgaagaaattaaaacacaaacaattcttaactctggataaaacgaaaagaaatataagaacaaactgtagccattttacactatgtgattcagagtaaaaaatatttacatagtaataatagcataatcacttcatactggctgaaataaaaacacgaaattactgaaaggataggaagaagttctgtgtgtgtgtgtgcatgtaaaagcgatatgaaaattaaattataatcttctttttttgtttttgagatggagtctcgctctgttgcccaggctggagtgcagtggcacgatcttggctcactgcaagctctgcctcccaggttcatgccatcctcctgcctcagcctcccaagtagctgagactacaggtgcctgccaccatgcctggctaatttttttgtattttttagtagagatggggtttcaccgtgttagccaggattgtctcgatcttctgacctcgtgatccacccacctcggcctcccaaaaattataatcttcttcaaaaggaaatctataaagatctaaccttgaaacatcaagaaaaacagtatactgtgtgatatttagaaatatgaatataaatactagaagaaacaattaaaagatttaaaatagttgcctctgaggcatgagaactgggagacaggctggaacatgggacagctattttttattatagcattatttgatttattatatgtactattttggtaaaagtgaaaattaaatgaaaacagtagtttactcttatcttttacaaatactgagttaaatatcagaagaaagagccaagaatttaaaaatagttgtctctggaaaataattgggaagtgaagaggggttaagcacataataatttgataaaatttaaaaaattaaaattttctaagagaaaatgagtaatctgaaataactgaaatttgtgaataagtggaatttggttttggcatagtgggtcaaatcatcagaaaacaaactcatatgagaaataaactactcaatactggtttatctcctggtagaatcaatcatttaacagtggccaagcatggtggctcatgcttgtaaagtcagtattttgggaggcgaaggcaggaggattgattgacgccaggagtttgataccagactaggtaacatagaaagactcccatctctacaaaaataaattaaattaaattaaattaaattaaattaaattaaattaaattaaataaataaataaaaaatcagccgttagcggcggctcatgcctgtagtgccagctacttggccactaaggcaggaggattgcatgagcccaggagttcaaggctgcagggagctatgatcacaccacttcactgggcaacaaagggagacccagcctctgaacaaacaaacaaaaaagctttgggtccctctacggccttttttgtttttcaaaatgagactttttaataaggtcacattgggtgctttaagaacttcaattattataaagcgtaaattacttttaatatgcagttccatacttagactgcacaatgcacatctcagaggcattctcaacaaccattaaacattttgaattcaattttcagttaaaccagtattttattaacaacagattccagttaaatacaacaaatattaaacagctattgtatatgcaaatgacattgccctaggctttgttggggataaaagttaaaatatctcaatctttaattgagtttataatcttccaaggaatataagccatgcaataataactactaaaaataaaaaaaatgtccaaaagagatggttaaaggaaaatccttatcattcagagaaccgtggtcattggaaataggatttgaacatctgaatccagacagagaattatctaagagtaaaatagtatcataaagcatgagagaaggacagtatggcacatgtgagtgcagaaaatcattcattttggctggaacataaggtggattcaggggagtagtaaaaaataaataaagtaaatagtctgggagaagatcatggggctccttgagagtcaagttaacctttttataattcatataacagaaaggttggagtcattaaagattttttatgaacaagtggcttatctagatttattgtttaaaaaattagtccagaaatgtatatgagaaggattaaaagggaaaggatgaaagctatgttttattttatattaatagataataatgagaaaatcttattctctgaataaatagctagacatacattttgaggattattattctcaagcactgtgtacatttcaaatgtgcttcaatattttgtgaacattcaatattttgtgaaggtgttttagagaagtcataagcaagcaacacatgcattgagctctgtaaactctgtttatgttattaatcagaatagctcctgtccatctaaaggaggaatagatgtctttaagaagaaatgaaaaaataaagtaaatgtgaaaatttcccttacttatttccaaacaagtgctcctccaaaaaaatgcaaataattaagtttctgaaatggtgaacatatcagattagtagacatatggcaggagcagcaaatgagcagatcaagttgaagtcctagtattaccaatctgttaatgttgacaggaagactcattttgactgttccttttatatcaataaatgagtggatttcaactactctaaataggaatgctaaaagcagcactgctaaaagtgcatatcaaaccaataattttctgatgctgttttggtatatcctacaaacatttgtaggacaacaactcagaagggaaaaaaatatcttatgcctttgaggtctgtactgaatgctaatgcatttgtatatgatgggtttaatacagaactgagaataaattactttcagcagctgcactctagacctataaatcgctctgagtactacaaaatccatacaaaggaagaacagctggataatttacaccaccagtatttgtcaaaaaaaaaaaaaaaagctgaaaatacagaacctgatttgtccctttttcgagtatacacgtctacaaaaattaaacattatctttctagagaatctattaggataggcacatctattcgcatcttgacatgttgctcttttaaaataaacataattcctcttattttaaaagcactttttaaaaggataaaagcagcaaagaaaaaaacttttccttataaccaaacgcaagcacaaagaaaagtctgttaatgtttattttgtgttccaattgctatgctctggtaaaattctacaaaaggaaacacgttaaccagatgacttgcagagcacagtgataccaaaaatagtacttaagttaatacactaattgcaaagttgcagagattaagttcaccattctagttcttggataaacttttggagagggagtatttaaagtttaatataagggctgtcttaagcttcctaaagaataatacaagcagtaaaaatgtgctccgtataagtgaactccagaaatagaaagctgcagtcactaaaggaatattagcttttgtgtaagcaacaaaattacccttttgcaacttctattaaagtcaatacaagagagtggctaatggctaattttgctcacaaatctaccattgttttgagtttttatatgtgacgctaattcgtaaagaagccatactaccttgataataacaacaaagaaaaattcttaagtccccacatggtaattactgtgatctatatgtagaaatttgacaatatgtcaaaatttgaacctattttcaaatgaacctatatcagtttcagaaatctaagcgttcctaaaacaatgattaacaaaaaccaattggtgttactctccaaatcatgcaatctagtggactgtaattccaatattataaaaatgctgtgataggaatatgcatgagtgaacaaacaggcggctttatctgcctgccaatttcacatccactggaaacaaaaggaataggtgaggttattcttaattgatgcctgtcaatctttcttttcctacactactaatatggttaggctttgcgttcccacccaaatctcattttgaattgtaatcccaataatcctcatgtgtcaagggagagaccaggtggagtaatcgaatcatgggggtggttcccccatgctgttcttgtgatagtgagttcgttctcaggagatctaatggttttataaggggctcttccccactttcgcagcactcaactctgtcctgccgccctgtgaagaagttgcctgcctcccctttgtgttctgccatgattgtaagtttcctgaggcctctccagcaatgtggaactgtgagtcaattaaacctctttcctttacaaattacccagtcccaggtatttcttcatagcaatgtgagaacggactaatacaactacactcttctaatcactttattttaaaatcagatagcttggagcccaaacaaggcctcctctctgtcaattgtccttaatctgaactcagttttagaacactcacaaccacataggatataaactcatttagcaaaatgccagggaaaaaaataataggcatccagtagtagaagtaagcaaagattgacaaagaatccaagccctaaagtgtccataaggttgaagagtttaaaaatgacacactagtttatgtgaagtaagagtcatgcagataactggaggacttatctacttatctgtatttctctcaagttatgctgcttactagttcacagcataaaccaccaaccagatggcttaattgcacagcagacattcttacattgccttaaactaggaatagagggctactagtaaatatacaaaaataaaacaagtaacattgtttatggcccactaaactgtatacatttatgtgattctcttccctatacctctgtcacaactttgtatcttttctggattctctcttaggagttcatggactgaactgagctaactttaaatgcactactatacttaactattctataattctgaagttgccgtaatttctcaagttaaaataccctgtggttccaaactcaacccaacttatttcaagactggtagcacccaatttttttaaatgtccattaaggctgggcacggttgttcatgcttgtaatcctagcactttgggaggctgaggcagatggatcacttgagcctaggagttcaagaccagcctgggcaatatcgagaaaccttgtctctacaaaaaaatacaaaaattagctgggagtggtggtgcatgcctgtagtcccggttacttgggaggctgagatgggaggatcgcttgaacccaatagttggaggctgtagtcagctatcattgtaccactgcactccagcctgagcgatagggtaagaccctgtctcaaaaaataataataaataaataaaatgcccattaaataaaaatcttaagcaaagttaatactttattaattcattgttgtggaaaccaaaccattttagcagaagagaatacaaaataatgttcaaagaatagggaagaaagttttagttctcataatttgcaatgcactaaagcatcttgataattacttgttaaagttcctggcctcaaataatcttataattttgaggacattttctgattgatctctctattattactccatgtaggtgcatgactatcttttgcatggaggtatttttacaaacctctatatcccacaacacaataccactacttgataaataattatttatcactcatctgtcactcatcaaaatctatcatttccacttattttctttaatcatctcagctcacatgggttccctctctcacataaagtcccatactacttattatttgtagcataatgtagtagttacaattacacagttttcatcctagccatcctgtatcagagttctatcatttattactcatgagactatggagaagtcacataaccatcataactcctattcctcatacctaaaatggaaataattatatctatttcccaaggtttttgtgagaaatgactaaaaccatatatgaaagtgcttacaactcaatagaaagcgggaaaagataaaaataaataaaaatacaactcaataataagacaaacaacccaatttaaaaatgggaaaactatgttaacagacacttacaaagaaagacatataaatggccattaatcacatgagaagatactcaaaattatattcattaggggaatgcaaattaaaccaccattagatgccaatacacatctggcaaaagctgaagttccagcaaccagaactcttatacattagtcagtcagagggtaaaatgataaaactccttcaggaaagagtgtgaccatttcttataaaactgaaaatatgtctatcctatgaccaaataatttcattcttatttatttaagagaaataaaagtatgttccacagaaagccttgtgcatggatgtaaatagcacctttatttataataaccaaaacttagaaatgcccaggtgtcaaaaaatagagaaatgtataaacaattgtggtatattactactttcccataaaaagaaacaaactactggtatatataatgacatagataaatattaaaaatgtcacaacaagtgaaagaagacttacacaaaacagaatgcactgtgtgattccattaatgtaaagtaatgagaacaggcaaaactaatgaagggtggaaaaggtgagaatagtggttgtctagtgtgggaggcactcctggctcacaagagggataaaggaacttgaaactatctgaggtgatgggttacaaggatgtttgtattcatcaaaatgcagaatatgtacgcttaagatttaggcatttaaatgaaagttttgccataaatttactataaaacaaaaacattggaaaataactataaattaaaagcagaaaacaaatcaatctattgataagcataaattagagtaaaataattaaactgaacaaagagattctcacaactgttcttagttcagcttcatgctgtttcaagagaaaactatagaaagattcaaacaaaagaaatggaagaagagttacaaagcagatattaaataaaagaatgttgaataagttaagaataaaggaaatactgtttttataccagaccaaaaaagatgtttaggccaataagagttactagtatacaagggtcattggataaagacaataggaatatttactaggaaataattacaattcttgatttccacgacctcaatagcataatcacaaatatttgaaacaataattgactgaattatgaagacattggcaaatttacaatcgccatgagagattataccacatctcttttggtagttaaaaattaaggagatggcctggcgcagtggctcacacctgtaatcatagcactttaggaggctgaggccagcggattgcttgagcccaggaattcaagaccagcctgggcaatacagcaaaactccatttctacaaaaatacaaaaaaattagctgagcacagtggtgtgtgcctgtgtccccagctactcagaggctgagataagaggattccttgagcccaggaggtcaaagccacagtgagccatgatcatgtcatggcactccaggctgagggacagagatagactctgtctcaataaaataaaaattttactgacaaaatatcagtaagaatcagatttgaacaacatgattattatttaatttaatgaacaaatatagaatcattagatatattcaatagaaaatatattctgattaaagcattcatgagacatttacactattgaccacccactaagccagaaagcaaagcaaatctcaatttgaagaatcaagattatacaacccacattttctgaccatcatgataatacattagaagtcagtaaaaatgttccagagaaataatagtagcaacgcatatggtccttgctaagtggtgggcactcttctgagtattttaaatacgttagcacttttaatccttgtaacaactatataaggtaggtactgctattatcatcccagtttcatagatgagcaaattgaggcagaaagagaataaataaggtgctaaataaccacacgtgcacacataagtggtggagctcagctgtggtccttggcagcatggctttggaggtagaactcttagccaaaataacattaggatcaaagaaaatgtctttatgtaaattagataatagatgagaaactttgatcaaactacaacagctacatattacctggaggaaaataaagagccttaaatatttgtgttagaaattatttttaaaaaatgactgacaatgaatgtgctaagcgtataaaaaaccgaagaaattgaaaaaagaataacagtaaaccctaaaagaaagaagaaaatgataaggataaaatcagaaattaatgaaatggaaaaaatcaagattaataaattcaaaagggtacctctaaattcaaaaaaagtggaaccaaactggaattttcccattggtgtttacattgcttaggaggcatgtatcacattataaactgtcctaagaactatcttctgtaattcacatatattcctgagctctctccttttcaggttaaatcaacacaatttctttagccgtctttactgatcctgctttctagcccttcactaatttccatttattatcttctgattttttccacttcttcttagtcttcttaatttatggatcagaaaactagctcagaaccttaataagaatccgaatggcactgagcatagttggaaaatcacttctgggttttacattataaatatttagaatgatcatataaaatgaactgcaatatgtttcaggaaactttaaaaatgttcagataatactaacggggcttcataagaatatcaccaaaatacagacttaccaagactggccattcattgtcactagttgcaaattaaatctgcaaacatcatcctcaaaattttacaattaattttaatggattatggaagaatttaggacagcctatccattataacaaattcctgaaacaatgtttttgtctgattggagagtataaaaattaccttgttgagtttgcctgtttacttttcaaaccaggtattgaaaattgaaatatagtcaccagtcagaagttgttgcagtaggcttcaaataagtttaatatacttattgctgcctttctaaaattctatgcaaagaaagcaatcagatactgaaataagtatttatgggcaaagattctcagtgcagtattgttggtattattaaaattcagaaacaaaccatccaaaagtacagctattgttaaataaattatagtatatccacacaagacaatattatgcatccattgtatttgtattttttaattaattctatggggcaatgtgtgatatataaaatacaaagagaaagtaaactatataaaattatatatggttgatacatttgccgatgaaatgacataatgattgccatttgcttcaaaataatatgtgaggggaatgaagtgggtgtgacagagatgaaacaagatggatcgtgaattgataattactgaagttgggtgttagggacacaaaggttcattacattattttttctacttttgataatgttacaaatattctataataaaggtttaagaagcctatatatacattgtggttctaattataaatctatatatacacatatatatattataatataactagtgttttataacatatgttcatcttgaagaagacatcaccaaaatgttaaggctggcccaaagtggttgatcattccttattcattaatacttttctaatcaaacttctaagtttataggcatcccaggtcttccaagatactactttaaaatgttaccttttttctaattcatgctttcaagtggcaattcatataattaagaagaatatgctgatcatcactctactttattgtttcaaattatcttgaactcttaaactcataatcctacataagatgactatttctaccatggcaatccctgtggttatttgttcaatgcccactgccttctgatgcaactggctcccagtacaccagaaaggtcctttattggctgagcacattgatgggtggttgtatgcagtttgaataaagataggagattattaggtaaaatagagggaaaagaaacctaaagttggataatgataacctagaggaaaggtagtcagaagctggggaaggtgaatgcttcttagtcctgagaagactaaagtgtaaagaatctccttggcagcatggtagtgtcagaggcctttgaaccagagcaacttcatcttaaataggggctgggtaaaataaggctgagacctactaggctgcattcccaggagattaggcattcctagtcacaggatgagatgggaagtcggcacaagatacaggtcacaaagactttgctgataaaacagattggggtaaagaagccggccaaaacctaccaaaatgaagatggcatcaaaagtgacctctggttgtcctcacttttcattaaaggctaattataatgcattagcatgctaaaagacactcccaccagtgtcatgacagtttacaaatgccatagtaatgtcaggaagttacactgtctggtttaaaaagagaaggaaccctcagttctgggaattgcccacccctttcccagaaaacttatgaataatccaccccttgtttggcatataatcaagaaataactataagtattatcaatagagcagtccaagatgctgccctgcctatggactgccattcttttattcctttgctttcccagtaaacttgctttcactgtactttatggactcgccctgaattctttcttgcacaaggtccaagaatcctctcttggggtctggattgggacccctttccaggaacaggagaacaaagatgatttctggagaacgtacaggtataacaaagatttttacagtaatttgttatggaatgtgcaaggtaaaagctttcctttgatgatgaaaagagtcaaactctgtaaaatattttaagagatttattctgaaccaaatatgagtgaccatggcctgtgacacagcccttgggaggtccagagaacatgtgcccaaggtggtcagggtacagcttggttttatatattttggggaggcatgaggcatcaatcaaatacatttaagaaacacattggtttggttcagaaaggcgggacaactcaaagcaggggcttccaggccataggtgaatttaaacattttctggttgaaaattagttgagtttatctgaagactggggatcagtggaagggaaatgttcaggttaagataaaggattgtggagaccaagttttattgtgcagaggactctctcagatagcagacttcagagagagagcagattgtacaatgtttcttatcagacctaaaaacttacctgcctttcagttgactgcctcctggatctagaaagaaaggaaggaaaacgaagggggaaggagattctctgtagaatgtggatttttcccacaagagtctttgcaggtcaatttcaaggtatggcaaggaaatatattttggggtaaaacattttgattttttcccttcttatcctatagtcagattggaaagtaagccacgatacacagggttaaataaaacccatctgatgagaatttatggtttgtagggcatgattccccagaccccttagaaaggaatttgggcaagataaaatcagatctcagtcctcacctccaaaataacattcagcacaatcaccattacttactgatgctttaggcgtgggtaaattttttctggagaatgcaaaggtggtgttgagtcctgagttgtttacctatggagcagtaatcagaaaaactgacatatgggatccatactaaataagtgacatttactgcaccccaaatacatcgagtcagtcataaaacctagagtctaagcaacaccaagccctcaaaagactaaggacacataacaattaacccatcattagtctattagtatacatacattaacaataacattttgaacctggagagagccataaaatcattcatttgtaaaccaaagtgtatctgagacaggtctcaatcaatttggaagtttattttgccagggttaaggacatacccttattaagaaataaacataaaatcaccgaaacagtctgtggtctgtctttctccgaagatgaacttgagggcttcaatatgtaaagggggaaagcgggctggaggggaaggagggagagtatggaaatacacacactgcaagaggaaaggggcagatagggtaatagtcaattaggtatttgtcttgtgcttggtaaattggcactttacataagttaaggtgaacactatgtagctacggggagatatttaaccttttatctgtagctatctgcttaggaacaaaaggaaaggcggctgactcagccttcagcttaactttttccttttggcatggtgaattggggtcccgagtttctactttcctttcacaaaatctaacctcctaaagccacccagctagttccagtcacagccagatataaaatcaaggcttttgactcagtgctctttcaactactccaaactgataaggtttactaggggaggtggaagagaaaaaactgagaaaatgaaagaaacggacagagaaaatttcattcattgataaaaacagatgacatctatcattacttcataaaagataccaaaaatcatatctattacacaattatagaaaaatatattaaataataggccttaccatagaaattgtaggagtccagagaacaataccccaaagtatggtgctttggcatgctgagttcttttaaattaaaggatatcaaaaggcctcataagcagccccagaaccaaggactttttgatctcctgtttctcactccaagcacagagtggaaccctctctctcaaattcctttatctgagctttccaaaaggcacagaattgtcttttgtcccccgccctgaaatttaattatctatggcaggaaagaagactaaggaatgtaaccaaaactggatggactttgtcagaaaatagtgtctgtctctaaagctcattcaaatgccaaagagaaccatttacaagctaatttctgtctcctggtgatgcaggatttttttcctccttagttcgggtaaaatccaggttcttgtctcacaaccaggaaaaattaggcacacagatccattgaaaggtaaggagagcagagttcattgggcaaaaagaaaactctcagcaaacaggtgagggagtcctgccaaccggctcccacttcacagactgaataccaggtcaccacacacaagctgaagacgcccgactcctgcccctgcataaggtgtcaattcctggtgactccaccccattctcccagtgtgcacataggcccccagtgcattgcaggcatgcccaggcaagaagaccctgtgcaggttcccttatctgcctcctgcatttatcactgggaccatttaatttccctaaaaatcatttacaatccctcaaaattgcctatatttcctccatttccctcccccaatgaagagggtatataagcttcaactgtctgtctgtttctttgagtcttatatctgtgggactctcatacccatgtatgtgcacaataataaacttttgtgtctttttctcctgttaatctgtctgtctattgtcagtttattttggcaaaatgtgtcaatcatcaaaacatcagagggaaagtaggcttccccacaaaacacagcaattctacacatttttacgtttgacattttcatcattatcctccctccaccattctgtctttattttttctcctattactgattttaggtcatgatctttacacttttgaaaaaaaaaatgagaggacagtcaaatatttttcacctcaaaaatgatttaatcaaatagcaagatttaactaaataagaccaatagtagcaataaagacctgtttagcattttcaaagttattttctaacaaaaatgttcacttaaacatactctggtcaatagtttatttattgcctgatctatgtaatccactacatttcatcactttgattcagttgcaagtccttttgttttccttctgcagcaccttcactaaatataaaatatatcagcacgctgagtgctctttatttacacttctgagtgactagagaaatttatttgattgcaaagcttaaaaggagcccaataagtcaggaaaaaaatgcacagcactgcttctctactcagactaatttttttctaatatatatgatggtttataatttgcagatatctttaaatatttataattcagcagggactccttattagttaagtttatttggaataaaaattaattttccaagatacttcaatttcatagattgttactgtcctttatgtcatatagcatgaaaaaatgtctaatgggacaatcacttgtattatattattaatcatgaataattgatatgtaatcaattcactttagttctgaatataaatatcccaccagccaaatgaatcaaattcaatttatcttactttttagaggacattttcaatgtaacaagaatgataatgatttctaaggaaaagatccttggattatgcttccataagatgcattcattcattcactgattcttcaaataaatattgactactctctacatagaaaacctcatgataggtccatatgacaacgcagagagagttgccaatcattgtggccaatagaaaactgtgaagtttcattttaatgataataccagtatgtcctattacacaaataatgatttcacattatcatttaaagtaaattaaacagaaaataagactatcataataaatattattttttaacttatactttctattagaagtaattctaccctattccttacgcaacttggtccaaaatttattttaaaattttataactctatattgaatccctactatatgtcagacactgctagtcttgaacatacaaaaatgttcctaagcctagctgtggagagagattcaaaggcactaatataaacaatataacatcatgatgaatgttttcctgtaggtatactcccatgggaacacaaatttgagtaggatgcagagaatgcaattcataggaaaaggcttctcaagggaagtaatatttatccaagcataaataagaaaaggaaaaggagaaggaagcggatcttcatatctaaaaacaattgcttaacccatggtaacctaagtctacttttatgttttcttttctcacattttatgttttgctcttacattatttgatacaaattacatctttaaacattataaagcaataaacgcagttttacaatttatgaaattgtctcaggggtatggagcttttgaggcagctccaaatccattcttcttttttcagtggctgctcagctgtgggtttcacagctaccatggttgtgtgactactgactttcaagattggggctcagaaaacaatgcctcaaaatgaaggccttagcagtagctcaaaagcaaacatttttatttgaccttctcctgcatgcctgtctctcagtcccattctcccgcaaggctagccatgaaaactagaatctctcttccccaaggtgggtcatagaaagcaggaccccttttcccaaaagccagccttagaaacctaaaaatagtctatgtaaaaacaggccataaagaaattatctaatctattttgtttgacattccagagggggccccatcccacacccagaaggaaggactgctgcacagagaggacaagaagaatctagacagacaggacttgctgggtttccccactcagttttttaacactagatcatattgttatagaaggtagttagtgagacacaagcatggtaggagagggtccactgcttcttcaccaggaatgtcaggcaaccatcaggtgatggtaaggtggttgttatacagtcttgctaaaataataattggtcgcagccagtgccaggaaaaggcagtctcccaatagacagataacatctgaaactggtaatcagcagcttcccaataagatctcaggagttgggtgagtgggctcaagcacgcaccctaagaggcaaaatggcagatgaccttcctctaggaacactcagttggtaaggaaaaaacatctcaagtgactatgtgtacaacttcagtaaacacactgtgcattcaacccctccaaagtcctagtaggtcactgtgcatctggatggcccaccgcaaggaagaatcaggatataagagatgcagagatgcagaccccagaagcatgctaatgaaatgtataaaatcctaagtcaaaggtcaaatcacatacttgatctctcaagtcacccacttggccctcttctaaatgtactttacttcctgtcattcctgctctaaaactttttaataaactttcactcctcctccaaaacttgtctgggtctctcactctgccttatgcccctcggtcaaattctttcttcagaggaggcaagaattgaaggttgctgcggacctgtttggactcgccaccactaacaatatccttttgaacaatcatatttctacaggtatgtccatacttcattgaatctcagcctaaaaatggataatgtatctttgtcttcattctgaaggccactgtgtatacacattgaataaatgtgtatgccttttctcctattaatcaatctgcctcacgttagtgatttttcagcaaaccttcagagggctggggtggggaaagtggggaagctctccctttgcccccaaacaaggctactgtgatcctagagagagggagatggaaatagggtaaattaaaacaccacaaaaatcattgttcttgtatcaattctgccatttttcttgttgcaagccttaatttccagagttctgaaaaagttattttgaccatttttgccagtgttctcattgcttttaaggagtgaattttcagatgtccccactctgccatttcaaaagtactcccctggggctatgcttttgaattacatttaggagtgaattgatttaacggagaacaaagaagcatctttaaagtaattgacttttcaatgaagacaaaagaattcatgcaaccaaattagtattattttgttcaaaagcaacatcttagaaagaagtaacactaattccatggtagttcacatacttaaatatattttgaatatttttatctgtacttacagcgagtaagtaaaaaaaaattaatgttttaataatggcaaatgtaccctttgggagaaatttaattgaacaaagtctaattaaaaaggtatttgatcaggctgaatgtatcatcatttttttatctaagccaattgatggctataaagtaatcagggtaatatttgcacttggatcataacctaactacaaaaccctcattccaaaagagtaactttccttaaaatgttataaccaatggagaaaacattggaataagcttatagcattcccagtggacatatttggcttaacaagttctatagtgagtgttaaaaatattgaaaaaagaaaaatagctcagagaagtctaagctatgtgaggaatacaaaatttatcaagcctggagagacataagacttcagtcatcccctcaccccctgggggtggcacctatgcccaggggtaattgtttaaaagcgtttttgctcctgactagctgcctcacccattatcttcatgttcctggaatttgtgacttcttcaagacttactccaaatagatatttactcatttctctgagctatcatgtatatagaaagtacacgttattaaacttctgtttgctgttctcatgttaatgtcttttagacattagaagttttagaagacactgttctcatgttaatgtcttttaaacattagaaattagacatttagaagtcccaactaataactaatgaaaggtagaggagaaaattgtttttcctcctttacagcattgcagagctagctatgggcccctagaaatcatccgtaaacttcacatatttaaaataaggaaatagacggctagagaactgcccaaagtcacttagctagcagagattttacaaaacatcaatgggcatctaagaagtgcctacaatacatcaggcactgggctagacactacccttcacaaaataaaactataagttgggccaatgacattcagtctactgctctttgcacaacttcacactgcataaatgaataaattctcaaatagccatcaaaaatgaaatatccagaggaggcagtctaaagaattacaatgaatttttaaagtaacacttgttttgtaaacaggaaagtacatagaaaggaaaagagaaaatccattctatataaaatagaaaaatatgtttgtactgactcaattatttaaaattaatattgtgtggcctaggaatatgtttttatataattaatgtttgttttttacaaaggttcctacaggcaggaaatgtgtttgatttttgtgtatacttcagatttcatcacaacagcaatataatgcaggactcaatgcaaagtaagaaaaaacaccaggcaatcagttttggttgctttttcactaacaaagcttgttaagaaaagaagagcatttttattttttataaatagaggattttagtgcctattttggaatagcaggtagtattccagctgtttggggctgctttgggctctaggcattttaaaattaatgggctgggccaaacaaagagtgtattttcattccacatcaaatgtgtatgctggtttctagaaatacaatatgtttgtgcaagtgtggcaacatttatccttccaggtagtaaatgaagacatctgccttctcctagagacttagctctccaagtcaatttaaagaaaccagcaaataacccttagtgactcttaccctcacacagaacaagctgatttctcatgacagctatattcaatctatgactaaataatgccattttaaatgaccatgtgtgggaagtaaaactataaagtgaacatgtgctttagagcctggagctcttagttcaaatcccagttctgtcatttactagttgtaggacatttttaaaatctgttaatttctctggatggtcagtttcctcctatgtaaaatggagacaatattacctacctcacagggttaatgtgaagattacattatatagctcatgtaaagcacttagctaaatagctggcacagagttgacacttgatgaatggtgccttttatctgccccctctgcaattacttacttaaagttatctattatttaagcatctttccattcttaccaaacttaaaattggtacccaaaaaaatcacctaatttttctcctgttgtactaagtagcaaaagaaaaacattcaagaaatgggaaggccttcatgatacaagttttcatgtctgtaaaattaactctgcattaactcctgacttaaaattctacaacacagaactacaaaattttaaaagaacagaatattaatctagagttgatataaaaatactagctgtctcaacttaaggcatttcacaagcctgagaattatttctgctttgactttgcagctctactgaaagaaacccttaccctagctgcaaacctggacagattcttgaacacaatttcttggcgcttcctctgaaatccccctagaagcaagagcttctgctgagcgactccatggtgactggaacatgaaaaaacatgctgggcccgagcgcggtggctcgtgcttataatcccagcactttgggaggcggaggcaggtggatcatgaggtcaggagttcgagaccagcctggacaataaggcaaaaccccatctctactaaaaatacaaaaattagccgggcatggtggtacacgcctgtagtcccagctacttgggaagctgaggcagaagaatcacttgaacccaggagacggaggttgcagtgagcccagatcccaccactgcactccagcctgggcaacagagtgagactccatcttgtaaaaaaaaagaaaagaaaaaacattcttacagattgtctttgtgatagccaaacccattccagactagtcaatggttttgccatcactttcgtgcaaatattttctaaatatctttgcatatagtatgatgtattataaagacaatcctctggaactattgtgtatgttcaccataaaaggtactccttatgcacatatttctcacactgactgcatacaaatgacttgaatttatagaaggatttttcttcttgtagccattcatacccagctcacagcccaagccaatgtgcgtcctccaaatgcaatcagatgatgtgaccagccttgaaacgctcatcagacatgttttctaacatatattcttggtccagtctaaacttggatatttggaaacagactacttagaacaccagcatttgatattgtgttcaaagattgcagaaaaacatgtagttataatcactctagtactctccctgattatataattaggggtgtagttttagtcttaaaagagtaccaaatagactttgagtcagtaaaaagaacaacttttactgagagtagaagagcatctttgccatcaaatatgagcttttgcagtcaatttagccccttctctaattgacactgttcataaaagacatttaaaaccatttcatgtattgttaatatgcacagtttcaacaccattacataacccatcaatgtgaagatcagaggtttataatcactgaaattgattagtccaatcctcaaaacaaatagcttactattctgtaaaattttttccctggtgcaagtggaagtagtattgtaaaatgtctttgaaatccaacaggaatacagatttctcctgtaggacacagttttgcaaaaattgctttaatcattaagtaaagttaagcttgatgaaaaatctttctactacacgtctttgagtcccaacaacagaagcacagatgatggctgtgtgaacttctatcagtttgcttcaaaattaaagaaaatcttcttagcatacaaatcccaacaagtagcctagcaccacttttcatttattaccaatgcaaccaatttaaacagaacttattcagtttataagatggatatcttgtcaactgctaatcataatataaacaatgaatttgtactgcatattatctgtgcattttttctcttcaaataagattgcaaccttaacagaaaatgtggaacaaaccagcttccgcaacatagttctttctttaacaataacaacaataaaactatgctaaaactacactgaagctacactacaataaactgcaaaaaatcaaaagatccaagcactaacactgagtcacattgtactctggcacctgtaataagattacctccttgtgacctgctcaaattctggacccaaagaaagttttcagaaagtttttccaaaatcctctgtctgtcacccataaagcttcattcaggtactaaatgataggtaagtttagtagtgtagtcctagctacatgaaaggccagggcaggaggattgcatgaacccaggagttcaaggttatagtgagctatgattgcaccactgcactccatcctggcaagagagcgagatcctgtctctaaataaataaataacagataaatgatttacaaattttttatcaagcactctttagaaaaacttcagcattcacacataatatatgtatttatacattatatacaagttctaatctcagcctttatgttaaataattactaaactttgttttttacttagataaaaagtaattatccgtagaatttctaatatttttcagatgttccactggatcattgtgcatgccttctgggtattcaactttggagagtactgtactatatgagtcaggattattagacagaaaaccaattaaaaaccttagatgtaaaaagagaagagagaggagagaaagaaagcaccagttgcaaatagcctaagttttaaagtacatcaaacatcgttatatgccagagcttcacataaattatcttagtaaatcctcaaaaaaggcattaaaagaggtatcatttttgctcttgtacagatgaggaaactaggatcagggtaattacatccaaggtctaagtgtcaaaacaaatgattgtcagaggacaggaagaaaataaaagggaagccgttaatcaaacatttggccctctcatatcccaaaattctaaagatctcttaccacaaagaaggcaaatctaggaataatcatctaaaacatgttcagtacatgtatttcaaggctctagagacaaagggcaaaacatactaaattattattagtgcttgagaaactaatcaattatcttttgattgcctgtcatttcttaagcaggtaacatggatccaacaaaggaaggatggatgaatggatggatggatggatggacggatggatggatggttgatggatggatttatttatttatttattttaaagacagtgtctcaatctgtctcccatgatggagtggagtggctcactgaagcctcaaactcctgggttcaagggatcttcccacctcagcctcccaactacctaggactgcaggcatataccacatgccaggctaatttaaaaaaaaaaaaacatttgtagagacagggtctcactgtgttgcccaaactggcctcaaattcctggcctcaagtaatcctcctgccttggcctcccaaagtactgggattacagatgtgagctaccatgcctcaccaaagtctttagaatctctattagcagtctttagaactgtggtatccttcatacaatgtataaatgctagcagctccagtgattccctgcttacagtgttaagggatggagtaatacctgctttttttattttattttggtttattggagacctgcacaacttgtgtggcatgtagcaccacaaatcctagtctgttatgtaaagagaatttaaacaaattaatcacaaacattcatgagcacatatgcttatttgcatgactgtcttgtattatagcctaaaagttattcatgtcttaaaggtgtagaaatactgtgtctttcatcaacatagcctgagacaattgagaatttaataagatatgcaaaaccataaaaatcatggctaatatttatgcaacttttctatgtgccaggatgtgttctaagcattttatgtgtattatcactttgaatcttcacaaacacctcataaagtagatgctatatgtgtccccatttccaaccaggaaaactgaggcaacaagaggtaagaaatgtgaccaaggttacatcactagcaggataaccagatctttgactcaaagatgtctgactccagagcttcctccaagaactatgacagacatacagtaagagagttcaaaatacagcaaattgttaacaaatatgtagagcaaatggctaacaatatcaattaagcactctgatatatctccaagactagttctgcaacccctcgcagctatacatcctaaaatattctgcctcttacatgtctcagaaattaaaagaagattctgctaatccatgttcagtctgtcacacataattgatgtgtgggtgatgttgagtttgcttatttgttcaccctttcttatgtaatataataggtgatgttacagatgatagaaaaacataaggttgaaaggatggactccggagtcagatgcacaaggattcacattgctctctggctgtttttggctatataataaattgatccctccaagtctcagtctccccttctataaatggagatattgacacctgcctcattaaatagctgtaaggagaaaatgaaataacatatgtaaaagaaaataatacatgtacaatgcttgggacgtggtgagctcccaaactatgctagctatggtaaataaaaataaccccactaatagtgacacagctggtgttaacagtgtgatctatggtacatggacacagaagagatagttaacctattgagtggctaaaattgtgagcttggtgtgaaagatgaatgatctatcctggtccactgattttctataggtctccacagcacttgctcacccacctctttacaaagcatttctcctctctctagcatttctcattgttatctctaacaagtgatttattttaagttcatcttttctcatttcctgtgacctgttcagaagctcatgtacatctaccattgtgagcacccaaatagtttgttatctcctcacacaatacttcatagtcagctgattcactggggttcgttttactatgtaaccatctaccataaatacctagattgtttaaaaggccacaccgccactcacacacaaaaagaaagctttgcatattactgtaacctcttcacatgatttactagtgttaacacagctttctatgaaaaatgaaagataaaagttgtagagaccaagggaaaactccttcagcctctaaaggttcatggaaaaatcaactcacaaaaggcaaattaattacagaaacggcatacaaatgtatttaatgtgtacatgagagccttcagaatgaaaacccaaagatgcaggggaaattgtccatttatatgcttcagttcaacaaagtatgaacagccatactcaaataagattggacaaaaagtttactacctaatgctaataggttgagtggggaaggtctgtctagactcttcttggcctctctgagcatgcctttcttccttccgggtatggggcaggactctctcttgaatggcgggtgggggtcttaagacctacagtaaaacaatgtcagttagataatttctttatggccagtttttacacagcagggcagagagaaagtttgagtaatatttttaggtgttatggggggctttagggaaaagaagttctagtttctacgacatgccctggggaagagggattctcatttctatggctggatgtaggtgaatggggctgagagacaggagggcaggagaaagtcaaagaagctttcacttctgagaccttcattttgaggtatttttttttccgagtcccaacaaagtaaagtgggaatccagacaattctccacaatttcatgtaaaacaataagcgcaatgattgtaatatactgatctacttctcaaatttaaatgtcaaatgataccacatcattttactttttcagattccataattagtccccctcccatttttatatctataaactcctacttggctattttctttgaactgctacaatgaaaccatactctaagggatagaacaattttatcaacgtttgtaataatgaaaactttgaaagctttagttttacttaataatcagttaataaaaagccataaagctgttaatacattttagattcaagtaaaaatagtaatgactttcaaagagcaacatttctgattggcaatattaaataggaacaaatcattgtggtttgagatgtgtttaatgcagaaagtcctgtgtgctcaccatgtatcacaattaatgttttctggtaactctaatgggctcacagggatttggaagtttggtaactatcagcacttgaaactttttcctctttgtccaatactagataaataaaccattctagtttaggatattgaatcatataaattcctaaagagaattagtagattaagaagagtcaataaagcagaaccatcagaagttctctaaatggaaagaagttataaatactacctatttccttgttaatatcaggttacataaaaaaattattcctgaaaataaagttgctaagcttgatcaagtagactttcttttttataagtagattagacttttcaacctaatgttttgaggaaaacatctccaaaggtcctcttagaaggtagttggaaggagccctagtaaaagaaaaatctataaagcttacagataaaaatcagcttaaattgtgtccatccatgaatgtcaatttctattacagggcagaatttaattaattttgtttcatttaataaatattctcctatggtatacaattccttactagacactatatcagatttctaagtagttcaaagtattaaggattacttatgactggaacatgttatcaatgtacatattaaattttctcctccttctaaattacacattttattttttttattatactttaagttttagggtacacgtgcacaacgtgcaggttagctacatatgtatacatgtgccatgttggtgtgctgcacccattaactcgtcatttaacattaggtatatctcctaatgctatccctccccctccccccaccccacaacaggccccagtgtgtgatgtcccccttcctgtgtccatgtgttctcattgttcaattcccacctatgagtgagagcatgcggtgtttggttttttgtccttgcgatagtttgctgagaatgatggtttccagcttcatccatgtccctacaaaggacatgaactcatcattttttatggctttatagtattccatggtgtatatttgctacattttcttaatccagtctctcactgttggacatttggcttggttccaagtctttgctattgtgaatagtgctgcaataaacatacgataaattacacattttaagtgctctaggttcaattggctctgagcatggtaaacaaactgcagtcactaaagaatctccaaaggcttatctaataccagtcaaagttatagattctatttggaaggctttttcatcctacaaagaggatgaggtcttattcgttgtccccaacacctcgctttttgagtgttcgcacagtgtttggcactcagtggcactcaataactgtttgctgaaaaaaataaatcaatgagtatttagagacccaaatatatataaggaaatctaatactcgagtaaatataccaatagacacaagatataggtggggaaaaagactatgtgttgctacaatttcagggtaattacatacatacaatcattcaagaatttcaaacttaaaatgtattcaactacaccaagttaaccttctcaataatatgttcccttctgttccacaaattattcttaatttgattttttttaaaaatcacactatcaattcaggtaacatttttacaaataaaatgttttgatttttaagaagaagaataatgactacaaagctatgtatattgtcaaatcaaataaatttatcatgcacctgaaacttgcaccaaggaaaggaattctaaaaaagtgactccccagttctcccactgagacaggagttaaaaagatttaagacactgacagttaaatcaatctcagtgatctcttttactgggggaaagtactgatttgatttataaaagtttaatttcaaattaaaacagctgttaatatcctttaccaaccattattttgttatacgtggcaggaaaataagcagatgaggtcatctgcctagactgaggtgttgtgattatttacagccctaatttttgttcagtaattggtaggtacagttctaattcttgctaatgactacgatatattgctcaggcaaattagaggaatagaatgttctgttactttagcagtattggtaaaaagtgacacaataaaaatgagtactcgttgaattaaatgccttcaacaacatcataattcaccccaaagatgctaatactaaaaacacatcctgcccccatgaagtggacttcagtagaatggaatttctgtatttatttagcattggcttctatcactaattaccccttctttaatgtaattttggggcataacgtagtaagtggttcatgatcactaattaaatgcctactatctgtgagaaaacatattttaaattgttctcttgaaataaaaatgaaaatactcaaaagaaaattctttcttaaaggtctcagaaagaaagcaggattttttaaaagttaattcatgacaacagatagatcataaattgtaaaattataaagccatttttactggaatagaagaggattagcagctaaggaaatacagtcacgggcatggtaagatatacaggtactttctaagttgcttcatttgagtcacgtgggaattccaaattgaatcatatgggaagttaggtcagagaacattcttactccaggagtttttcaaggataatagctgagacctgcttatatataggccataatgcagctatttaaagtaaataaagtcttcaattcctaaagtggcagattccataccaagttctaatgtacccagccactcacagctaaagccacaaacaaatgaaatcaataaaatcaggcagtaaagccaacatctggggttgctgttcattgcctaaaagtgtcaatgtgggttttaattagctggagtaagaagaataagagttgaataaaatcaacttaaattagaagacacacacctgtgatgcaaatattttattctgttaaatcttgtttattatactacttatcacatttatctcagatgctgatacaaaatgctatgcaacaggctttgaaaactgtaatgtaccatacacatgcagggccactacctacggatgctcaggatgcgcagttcattgcagtgccacatctaagggagggtccatagtagacactgtagatatcatgaatttttcagggtgatcaaagttaaatgtctcagtctaacaagaatttctgacaaaggtgaagtgtgagtaagcaatgaccctgtaagatattatttttaacccaaaatttatattatctcagcaaagaggtttctggaggaagcaaacacagttgaaattatagcattttttttcttttctctctaaaatattattagatgctcatttaaggcaaacaccacaatgcagtacagcatcatagcctaacagagcattatcgcctacctagctctatggctaagcatttaagaggtcagaccatcattctacaaagctagctgtttctgaattatatacatacagtaaacccagtaaattctgtgggcttgaaatcactaatgccataaaaaggtctgttaattgaaggtgattttatgggtataccatggagatggataaaatattttataagtccaaaaatggcagcgattttagaagcactgtaagaaaaggcaaatcaatatttggactttgcgtctttctttgtgaggacaaagcatggcatcctccaggttgaaaggggtttaatgcaatccagttgtcacttggtagttggatgaccaatgatgctgtatcaagggttcagtgctgggccgggcgtggcagctcacgcctgtaatcccagcactttgggaggccgaggcaggaagaacacctgaggtcaggagttcaagaccagcctggccaatgtggtgaaaccccgtctttactaaaaatacaaaaagtagccaggcatagtggcaggtgcctgtaatcccagctacttgggaggctgaggcaggagaatcgcttcaacccgggaggcagaggttgcagtgagccaagactgcaccattgcactccagcctgggcaacaagaatgaaacgctgtctcaaaaaaaaaaaaaaaaaaaaaaaaaaaagagttcagtgctggtccctgatcctagcaaattaaatagtcagcaacttgttgaagtcagatcagctttgtagaggaaaaacccatattgttgagctttgtatgacctctagtcagtcaccacagccacattgtacgtggactctctgaccaagcaacagggtagctggaaaaagttgactgacattcacagaatgagtcatttgaccacctgaaaactgagtgtcccatttactgtgaatctctttggtaggcattaatgtgagacaggaatatcctcacactccatgacagttccaagaggtgtcctccagatcctctttgtcaccaacttcacaaatattttctttccaactccctgaccagccaatcagtttgctagggaccatccatgaattactgcatattgataccttaggacatctttacttctataggaaattaacaactagatgtagtgctcagagttcagcccactggaaggatttcccttcccactgtctttcacggtcctccctgcataggttacacctatcccctatagctggtttcagtatactatgcaatccatccataaatggaccacatattttccttctctgttaacatatcataggaaattccccacgaagccatagatatggactgaagaagaggcagagaaatagtagaatcaagtaccatgggagtgtaaatcacctgcttgtgcagtttacttggtgggcattctgggtctctcaggctgctcttaatatgccacatctgattactactggaatgctcttaggcacatcctattttaaggttcactggattcgataacaccttgttcattatggacaggtcaggtcacatactttgcatcctgcggtcatgtagggtccagaagcaagccagaaaaactgctttttaaatggaaaatagttgttggcagataagaaatctggccatgattctcctttgaggtttcttccagaaactccaaatagtaattctgtctatcgcatacatttctagtacattgagcctgctgggccataaaattaatgaggcataacagtcattggaatggtaagatgtacaagtactttttaagttggcttcatctgagtcacatgggaatcccaaactgaatcatatcggaagttaagtcaaagatgatttttactccaggagtttttcaaggataacagctgagaccatcttatagataggctgtaatgcagacaggacctaaggacctaatgcagagaccttcctttctcctggattcactcaaactgccagccttagcatttatccagtaaatggtcagcagtagcccatccgaaggtaatatgtattgcattcaaaatccgaagtgtctcaccaagcattgtgcttgatggtggatggggttcaaggttcaggtttaataatctgtttttcactttagaataacctgctttagtgtcactctaatcctagaaacttcactgatgtggttagcccttcaaattttacaggatttatctcccacactccaacatgcatatatctaaagttactatagtacttgcttcttcctgcctgttaggccgaattagcataacgctaacaatttaatagtatatttgatgttctattgggtataaaagaaaccaaagtccctctagattatgagtgatcagctaggtgttacttatggtaaacctgtaaagatatactgttgtccctgccatgtaaatgcaaactacttctgattttttcatatcaatgttaatggaaaataaaacaacttctaaagggctgtgctagttagttcccataaatgttgcacaactggaactatatgtgcaaatagcatcacaacctacttaagtctgcaaaaatatactctcatgctccatgacccacatgttttgcatcagccaaacagtcaaattaaacaaatatgtagtaggaatagtcactcttcatatgttgcattttttttttttagacgaagtcttgctctgttgccaggctggagtgcagtagtgcgatctcctgggttcaagtgattttcctgtctcagcctcccaagtagctgggactacaagcacgcaccaccacacccagctaatttttgtatttttagtagagatggagtttcaccatgttggccaggatggtctcgatctcttgacctcatgatccactcgccttagttatatcttttatggtggtactaatctctgacattccctcaggaatgtgatgttacttttggtttactacctcagctaggtgaaaaatgtcattccaggagcttctgcttggccctttcttatcataatagccttcattacatggatcaagaaaccaacgtgttgattccaccagttactaattatatctattctcattatatattctgagactaagaaatgctgttagatttagaatatgatcaagatctacgtaaatctctactctgacttttaaatactatggtggcatttagagtctctggggatcagaatgaatttaaagccagaatcgaataactcagaagttctgagtattatttccttttctcccgtgtaaagtcaccctggtagaaggctgtaggattctttatattgtgaagatttctctttcccactggctttcagggtcatccccatatggggttttagtgcagcacctatccaattacagctggtctcagtatgccataaagattcatccataaatcaggaccacacagtttcctcctctattattatagaaatatgtttagagatggcttggaaaaaatgcaaaatatacagccattgctacattgcaaggcccttttacaaagagacctgaccttttcctcaattgaaaggacctaatatataaattggcatacatctgaaaacactaagttaaattgtttctgcccacaagacttgacataaggcagaatttttctgcctatatatgtaagacagtacattggaaggctgcacatgtatttcattcttagaactacatcatcagttagctattgctttagattaatggttctcgaagtgtcatgtccaggccagcagcatcagcattacctaggaatttgttagaaataaaaatttttagactccacttcagacctattgaattagaaattctggaggtggggcccagcaacctgggttttagcaagcccccaacataagtctgacacacagtgaggttaaaaaaccgctccccccacaaaaaatacagaaaagaaaatcattcccatagatgcttacaggtcaaaactccatccctgtggcttgttgtaatttcaaacacctcgtttgtaatgattaagggccaccagctggtctccatcactgtcaaaccatcatgaatcctactggatcaggaaactcagttccattatggcataacctacagtcatctccttcctacagaggacagcaaccacagagctatttaacaatgctgttatccccctcaccaatgcatattatagtgctttcatcaaaacagcatcctctggccttcctagggagtacggttaggagttggctgatccattctagcatttccgtttccccaagcctgtgaattccttcctctagagtaggtcaggtaatctcaaacatttctaccttattgactataggtcatcattgagttcaggcttcaattaatatattcatagactattaatgcctctcccaagtgctcagaccaacatattaaaccctaaattccaggtgagtacaccaatgtcaacaatttagcctgatgaacattagcattcactccccatgtatgccaatacagactggtggggtcttgaccttcttgacctctttcagtgtataaactgtttctcctggaccaggccttgtaccttcccatctgggctatgttgagtcaataagaggtggcaaagattggtcctgaggttaatcagcatctgcctgtgagacaggtaagaatttttttatgtacaatattttttatttaagttttaaaataaattttattgtataaatttaaggtatacaacatgatgttatggtatgttttgtagcaaaagtaaaatacttttatacactgagtagccaaatcccttagtgagccaggaggagttagatttagggccagaggctcctcagccatacctggtctgaatctggaagagatgggaaactctttcaagtctgcagtggagagcttcgtttgtccacacatgtccttaattgtatgtgcctagtttttaaattactccttttttctatttaacttcctgagagacataagaagaagccagggactccacaatctttacaattattaaaaaccacaatgagacatctcacctcatacctgttagaatggtttttatcaaaaagatggaagataagtataggagagaatgtggagaaaaggcaacccttgtacactgtggtgggaaggtcaattagtacagccattatagaaaacagcatggagagtcctcaaaaaactaaaaatagagctatcatatcatccagcaatcccactactgggtatgtattcaaaagaaatgaaatcagcatgtcaaagaaatatctgcactcccatgttcatagcagcattattcacaatagccaagatatagaatcaacctaagtgtccatcaacagataaatgaagaaaaagtggtatatatatatataaggaatgcaattttgcctttaaacataagaaaatcctggctgggcatggtggctcacgcctgtaatcccagcactttgggaggccaaggcgggtggatcacgaggtcaggagatggagaccatcctggctaacacggtgaaaccccgtctctactaaaaatacacaaaaattagctgggggtggtggtgggcgcctgtagtcccagctaatcgggaggctgaggcaggagaatggcgtgaacccgggaggcggagcttgcagtgagcggagatcgcgccactgcaccccagcctgggcgacagagcgagactcgtcaagaaagaaaaaagaaagaaagaaagaacgaaagaacgaaagaaagaaagaaagaaagaaagaaagaaagaaagaaagaaagaaagaaagaaagaaagaaagaaagaaagaaagaaagaaagaaagaaagaaaatcctttcatttgcaacaatagggtgaacctggaggacattatgttaggtgaaataagccagggcacagaaagacaaataccaaatgatctcatttatatgtggaatctaaaaaagttgaactcacagaagcagagagtacaatgagagtacgatggtagttacgaggggctggaggaatgggggattggggagatgttggttaaacaattcaaaatttcagttcaataggaagaataagtcaagagatctattgtacaatatggtgactacaattaataagaatgtattgtattatgtaaatcaataagaaaatagattttaagtgttctcaccacaaaaatgataagtatgtgaggtaatgcatgtatcaattcgcttgactgagccattctgcaatgtatacatatttaaaaatgtaatgtttatacaataaatataaacaattgttgtcaattaaaataaaataaaatggtaaataagttatcactgacatacaattaagaaccacagccacttgacctccaataatctatcttccatgtacacttcatccccatgttaccaccagtgataatctgagtaattatgccacctcctgccataaactgcccatgtcccattttcttccgctgtacactttgaatacatgacaaaactaattccggaatttcatttttggttctgttgactaggaacatttttggtaaagtgggaaagagtactaggcagggtgccagcattaaacagatggtataaccaaattagaataattgaaaaaggattgaataaaaggacaatttaataaagctataggcaagggacaaggaaaacataggctctttaaatgtggtctctgaaccagcagcaccaacatcacctgggaacctgtcagaaatgcaaattttggacctcacccgagacctattaaattagaaatcctgggagtgaggcctaaccatctgtattgtaataaactcatccaggtgattctaatgtgcaccaatgtttgagaaccactgacataaggtataatgcagtaaccaagtgctaatagctgtgaagctgttaccaatcctaggtccaaagagacaagagaacagatccgtatttgaaaccagagaaagccatagagacaaccaccttgagagaatcagtgacctttggtcaagagacccaggctaccctaggaaacccaataacaaggggataatataataaataacaaagtctcattttctcccttcttccagttgtcaacctggactcccaagtggccaaattcaaccagaatctagaaggcgagggaaccagataattttgtacattacagccttccaggctgaagaagaaagatgtatctgaaggaacaaatagaggagatccggcatgcaggcctaatttgcttttgttaacacacccaagttttgataaaactccaaaacatgtatttaaggaagctagaaatttaaaatattttgcaatttccatggcaagaatggtttctcaggaatggtcatttactatttaagctaataactagattccaataagaaagttcttttatggttagtgaccaaccccttttcttgttccctataatacagtatattgtagatattaaagaaatgtcagggattgttactattattcattttataatcacctcctttcccctatttagatatttaagtctctccttgtttccatgccgcatctgctaagtgaggatctaacctgtcactgaattctcctaggatttctgttcatatcagaacccttccctcttctgaatgccataatctaagctccattcacccacaagctacaacctactgacttacttaattcctttctcttttataagctatatttctttatttgcatttaatcctatgtaccgttttgggcttactcttgctttcagctagacaaactgctctagcctcctccttgttcttagttctatactacactttaacattcgcattgccttgatgcttgagatgtaaacatatataatgtggagttgggcaaaattaagggtctgcatccccattattgacttttagacagcaccacttcaccgtgcccctatctccatctatttctattatacaatgcttgtatccatctattcagaatttgtctgaatgtgaagtctcagccatccttgtcaaacccatctctccataggcacttcactatataggacaagtacatacacaagaataagaagccttgtttataattatagactgctttaccacacacattctcatcaatgtttcatctttcacgacactgataacttgaattagaaaggattctggacagtcagcagaaacttgttttaaactgagctttgttagaaaataaaagtaagactgaaataaatattatctgattattatgaatgtgtccctcaaatgtgtcctgcaaatttacctcttggctttctctgaaatgaaagaaatctatttacaactatttttggttttttttctactaaataaaataaaaggtgtatcttttgaggtgttggaaggatcagctaaccaatctcacccaatcattacttggtatctgctacgtgtctgacgttatgctagttgctattgactcaaaggaaaaaggaaaattgtcctctgccttcaaagggaaacaaaaaataagcaggtagttatagttattagtatttcatcaaggtacaaagcaggttatgtactctagactctgtgatcagagaaaggctttctggaggagacatcccagaactatgacctaaagagtatagtaagtcaagcagaaggagtgaggataagggaagaggaggaggtacaaagaagaagctatatataaaaaggtataaaggcattagaaaatgtgaggtattaggctgggtgcggtggctcatgcctgtaatcccagcactttgggaggccgaggtgggcggatcacgaagtcaggagatcaagaccatccttgctaacacagtgaaaccccgtctctactaaaaatacaaaaaattagcagggagtggtggggggcgcccgtagtcccagctacgtgggaggctgaggcaggagaatggtgtgaacccgggaggtggagcttgcagtgagccgagatcgcgccactgcactccagcctgggtgacagagcgagactccacgttagtgggtgcagcgcaccagcatggcacatgtatacatatgtaactaacctgcgcaatgtgcacatgtaccctaaaacttagagtataataaaaaaaaaaaattaaaaaaaaaaaaaagagagagagacaatgggaggtattaaagtaaaaagtgaaaagtgaagaggaaaagtctagataggtatgtaggggagaaataaagaagggtcttgtaccctatgctaactatgctaaaatctatagagaatcatggaagaattttaaatcagggagttgaagagtaatattttcctttttaaaaggtcacaatgtgaattgtaaaaaaataaataaataaataaagctagattggaggggcaagactagaagtggggagataagttaggataccattacagttaaaaaaagaaaaaaggatgaacctgcactagagtggtagatgtgaaagtggagggaagtagcttcatttgagagattagggaagcagactcaataggacctggtgactatctggttgagtagctagaagagatatcagtggatgctaatacaggactgagctcagaaagaaaaataagcaaaggtgaccaaaacagaatgatcagaaaacacaagaaaaactattatggcatttcacacccaaaacaagcgtttgaggagatattggtctatggtataggttgagtaaatgaggtctgaaaaagaatcagtgtgcttgacaagtaggaagtcagtgaaatttgccagaggagtttcagaagtggggtggaactagaagtcaaataagcaaagtgaggagaaaataggaggtgaagaaacagataaagcaggtgcaaatttctcttttaaaaaagcttaacagtcagggatagaaagaactgatagcaaaaaaaaaattatagagcccagggaaagtggtggccttttaatttttttagatgggaggaactggaaccttcatcagaacgagctaataaaagataaagtttgggaaaaataggattgtattcttcttataccagacattggggtatattgagtaagagacactactgacacaaaatgtcttttaaataatatgttggaataaactcccaaaagcatgaacaatattccaataaagttatgcaagttgcaagataggtgattgaagaagagctctttattaatcaaagaaaactctcaggtacacactgcctgacatccttaaatggtaacatgtagctaaagatgacatccaggaaccttaattaataaaaccaggaccataaacctcaggaacaagagttggaaagaagttttacagaggaagtttcaaaaatggcaatgagtggccggaaaaagaggaaaaatcagcatgcgtgtgctgatgatattttaccagctaatagctcctcagaatttcttctccatcagtctcccacaaccccagatcatcacactgcattggaccattttcttgatagctttggctctgagcctctctagagccctctgctggtggatttttttaaaaaaaaatacaaggattaaggattttacctgacttctagatcccatccatccaaggtaaaacccttcacatatctggctttcctgggaagagtattccagaggaaacactatttccactttaatgtaagtgttcatgggaagtgaaagtaaacattttgcacacagagaaaacctatcaaagactcagagcaggagataaaaaggaaggaagatacaaaaaaatgtaaaaatcaagaagggaaagttatgcattgtgggtgactgcaggttctggaaacaatctacctgaattcaaactctggcattatgctttaacagacacatggctgttaacaagttgcttagtatttttggacttcattttcctcatcaggaaagtatggaaaaaaatatcttttattatgttgattaaataattaataaatgcaaaaaaatgcaaatggattctattgctacattttcggttctctcttcagtgtcttatagaaaagtaaaggaaatcaacttgtcaactagcagaaagcagtatctaataactgatcaaattatacgggcagtaatgctaattgattaaaagtcatagcatatcgtcatatactgagttccaacagatggcatgaaaagcctttgcagtcctgaatctctgccttctatacaacatgctactgattaattgtttgtttgtttgtttgtttggttggttggttgtttttacctcagcaactaaatatcccattcatataaaccacagcactagtatcagagacccattcagtgcttgtctagtctaatttcatgaaggaaaacatcatgcttatttgaagactatccttgaaaagctacagtggttaatttcagtattctagatatgtcagtatcagatattgagtcctgctttgcctatcacctctttctaagactgagtgtacaacctatacccccaaacctcagactgtgctccaagcatctcaaagtggccattaggtgaccagtacattaattctcgtgtacattaaattctgtacaatgggtggaagtggtaagtggctaggtaaatcagatttcatcactcgggacctataaaggaaaaatatggatgaaattaaccagtggaattaggaattaacacacaaaaagaaagagtcttattaatggtagagtgctagagtcaagatccatgaaactaccactaagaggaataacattatctggtccccattctcagaaggtcctgtgggattctgctactctaccctacatgtgttctcataaaactccaatcattcatgttctccatgacaggaaattgccaaactagcacattatagcatttaattatcattccttcccctcttttggcctacatacttactggatcatcctttcaacattcaagagactaaattacagaattacattgatatggcttagctgtgtccccacccaaatctcgagttgtagctcccataatacccatgtgtcatcggagggacccgggggggaagtaattgaatcatgggagtgagttttttccttgctgttcttgtgatagtgaataagtctaatgagatctgatagtttcataaagggcagtttccctgcacatgctctcttgcctgccaccatgtaagacatgactttgctcctccttcaccttctgccatgattgtaagacttccccagccatgtggaactgtgagtccattaaatctctctttctttataaattaccccatcttgggcatttcttcatagcagtatgaaaatagactaatacatacatctttgagacattttttttctagcctaaatgttaagtggtatatgcataatgagtatggaaagacttcattaattaaacattccatttaagaggactgagcataatattcaaaggaaagaaagaattctaggattcaatcaaactatttaagtactaaagttcacttagagacccagttaatcaatccctcatttgaaagttaaggacattgggagccaggaagtaagtcactaggaactgagagacctgtcaaaaatgacacagctatttagaggcaaaggcaaaaccagaatcagaggtacaaattcctacttcaaaactttttttttcctattagtgaattttaattctcaaaaagtttacttctactcttggtctgaagtgactttttaacctcttaaccttaattccaacatctttgaaaggtgctcatataattgtgactgctgagaggatgttacttcattttgtgaaaaactttgaagataaatagcaccattacaattatgactcatctcaaaaagtttaacatttcaacctttgcttcttattgtctttttatgcaacatgattaatgcactctatttttttgtggctgtcacaagagccacaaaatctctcacttcctttattgtgactcagtttgaaaaaaatatgcacaaactttttcttgagtgcttgcttacataaatttaccaagtaaaaaaattatactactcactcaccatcatcaagtgaaatactatgtcatcttacagcagcatctcctggctgatgtttgtggcaagtctaaagagcttcataaacctttcctacatttcactctgtaggaaaaggtatgggaggtggaagtatgattgtaagataaaagagaattaaggagaaaaaatgatgtggacatggatgagaagcctgggagacaatagaagaggcacaaagagagaaatgaagggagctaataagaataagtgtgtgtatacaggtgtgtgtgttgatgtgtacatgtgtgtttgtgtgcagctggtcacagaaatacagtcagaaagaagtcgttattatgttgttttgactgatctgttgcagaacaggaactgtgatgaaaacagcagcaaacagggtcaacttactattgatcaatataccacaattataataagtagttctaaattaatccaaggctatttcagaaatcccaaatagaacaaaaaaatgaaattctacccttattaatcataccattgccggccaaaaggagcagaattatactcctgagagtattctgaaaatgtcagtgcaacattgttctgtaccaagaactgttagcctgcaaatgtatccttcctttaaaaaaaattgccaccaaaagtagatattaaaggagcaactaaatagatgtttctatttacccaaacaagctccagaggaacttacgtgaagtgtcttaggcagaataaagctatacgttactcagaataaataaataaccaagaatgttatttcttgcacagttcagagtgatagaagggttaaataagtaggtggagataagggaaggcaaagcttaaaggctcacaccttggaagatatttaagtaggaaagcatattgcaaagttcataagattgttctcctagtctattttaccactgtaaaccctctatttaagtatctagctgtatgcatcttccgacatctaaacccaattaaatgccaactgaaatagccttaaattactacccctaagtaattccctcctacttccataaataaaacaaggaaagtaaacagcactaaaaccagctgtgatgtccttcacacacacacacaaaaaaacttctttttaaaagcaaagttttctgagatattaaatttgtaagaggaaaaaatcaacacagactcattcattccccaaatgtgctcacaatttttaaagttttaatattaccatattagtccgttctcatgctgctataaggacatacctgagactgggcaatttataaaggaaagaaattaaattgactcacagtttcacatggctgggaaggcctcaggaaacttacaatcatggcagaaggcaaagcaaacacatccttcttcacatggtgacaggagagagaagtgaaagcaaagcaggggaaaagccccttataaaaccatcaatcttgtaagaagtcacggactggcacaagaacagcatgagggtaactgcccccatgattcaatacctcccaccgggtccctcccaccacacatggggattatggaaactataattcaagatgagacttgtgtggggacacaggggacatagccaaaacatatcaaccactttattcttactcctagttattataaattactgtattttataataaagataatttgtgaaaatgagcttaactgtcatcttttgttttacttttccccagtttcatacacaatatccaggtgccacagaaaaggtaactagtataaaggaatttacaaaattataatttatgaggtttattctgtaccttctgcgccttaaaagaggtgatactattgaaatttggaggtgaaaagattttgactctggaaaaaactgaagccttttagggaaccacttgtggccaaagtctacagtagacttatatagcagaaaatgaattaataatggtatttgaagaggaagaatgaagcaagaggagtgaggggtattggaaaaagaagcaaaaaagtgagacagataaaggaagaatgagagcagcttccaagctctataaaggatcatggaaggaggggggttgggaatctaataggtaactttaaacaagaaaaatggtattaaaaccaaatacctgaaaaactaattgatagtgaccaaaagcagatctgtggttgcctgtggctggggattgagaagggagcttgcctataaaaaggcagacagaaatttctagagtgatagaaatcttatatttcaattatggttgtggttacctgaatggctacatttctcaaaactcaatcaaccattaaaatgggtgcattttattgtattcaaatcatacctcaataaagttgattttaaaaattgaatgtttagtaaagcacactcacagacatatatttaagtgtatagaagaaagagaacaccaaaaaggctgctaaaaagaaacttgcacgaataaataaagcaaggaaagcataaaactatcccataatctttaggaacaatgtgttctagaagagtaaattttattgaatactgaagcttatgtttttaaagcctcccattttttcaattcatttcccctagtatcccaaccccaacattctttctaccacattggatcaccaaatccatcaattatatcaactttttagtcacacacacacacaaacacacacacacgcacacgtaccacctcacctcactacaatcacaccacaccgagctgattttttaaagtgttaagtctgcaaggcttgtgaaaaaatatatacatttaaattactttttttttttttttgagacagagtctcgctctgtcacccaggctggagtgcagtggcacaatctcggctcactgcagcctctgcctccggggttcaagcaattctcctgccttagatttgcaagtagctgggattacaggcacgcaccaccgtgcccagctaatttttgactttttggtagagacggggtatcaccatgttggccaggctggtcttgaactcctgacctcatgatctgcctgccttggcctcccaaagtgctgagattataggcatgagccactgcacctggccttaaattacatttaaaagaaatttggctttaagtgtatcttggctttcagtggaggtcccattcagaaacaaggaacagagaagtgacagtaaagctgagtgatcaccatattgagaaaattctacacagagggaggaaaataagccaacaaaaacaaaatagttcagtgcatcaagggaatcataaatagtcaatctcgctggaaataataagggggagaagaggagactggacatgcacatagcaaagaccagccttagaagtctgaggacgatagccattgattctgtgacaatgaaacctgtgttttgttcattagcatgtccctggaccgtaacaattttctaggatgtactgggtgctcaacaaatatttgacaaatagatggacagatgggtggatatatgaataaataaatgactggcctgaatcatggagggttttgtttgtggtaaaaagtctggactttgatctaaaacccagcttttgctaaccataataatagacaatcatttatgaagtatgtcacaagtaatttgttagaaattaaagtcaaagtaccataatttgtgaataatttactttttaaatttaaattagagtctgttcaagattacccctacattactaccttcatgttcattccttactttactgagtggtaaagtaaggaattttagccaattcaccaataaatgcacatctattataagctgttattgatagtaaattaccacggctaaactactaataactgtggccattataaattattgaagtctgtacttcctaaaaaataaactttaggtaatcctagcactttgggaggccaaggcaggcggatcacgaggtcaggagatcaagaccatcctggctaacacggtgaaatcccgtctctactaaaaataaaaaaaaataaggcatggtggaggggcctgtagtcccagctactcaggaggctgaggcaggagaatggcatgaacccgggaggcggagtttgcagcaagctgagatcgcgccactgcactccagcctgggcgacagagcgagaatccgtctcaaaaaaaaaaaaaataataataataataaaataaactttagcatttctcaaagttgggcaaatcactgaagtatacaaggcatgtgaaatcaccagtcatgtgactctaatgaaggcaacagagagtcattgaataattttaagaataggattgatattatgtaatttgtgctagagaaaaatcacttttgtggcaatgccaattagtggagcgtatgagacctgaggcaggagactgctacaaaagtataggtgagaggtggagaaagtctgaaccaagatagtagcaacaaatatgtagaaaagaaaaggacaagagaagtaaataagcaataaaattaagacttatgcatcaattagattcactaccttaggcaaaatggctttgcttaaacaacaaggtcaaacagcatataaaagaagagggtcatactaggtaggaaagataagaagttctatattagacatgctgacttggatacaaggatgccaaactgagaaaaagaggtctggaatagaggtactgattcaggattcctgaaacagaggtgtaaaagcctagagagagtgcatagagttagcaaaagagaatgtcacacagacagaacctggaataatatcacttttaagataaacagcaagtatttgggcttctactgaaccccaaaaagaagatgcacataatttgaatcatagaccgttagttcctccaagtagagttcctcttagtgtaatttcatgcatagtataggcatttaataattaaaatgaataattagaaagccaaaactaaaaagaaagaaatcatctatactacggctaggaaatcagtttcaagactaactgcagtcattttcgcatgactatctataaaactgtgtcaatagactctgaggtcaagtatggaattcaaaggaaagactcccataactctcaggtaacattaaagccatgggctcaggacaagagaagcaatcattcgtgtgtcacatattgccactattgatattttctgtttattacatagtttattttttattttagtatataatttaactatgaaaataatacaagtaaattgtaatatcaaacaatacagagataaatgcagaaaatataaataatattccccaacctgctctgaagtcttattccccgaaggcaacaaatactcaacaagagtaaaatgttctgcatttatgctctcactcctttctcctgctcataaaagggttttgttttggtttcatttgttcataaaattattatcaaaggaagacattatgacataggaagcattatggcatatggataaaattgctaatgtccaaatttattgttagagttgactatcatttattattgtttaaaaagtattttctataattatatgtaagattatatttttcttctctaagaaggtttatcagtagtttgcctgctacattgatttttatcagcgacccaaatgacttctaagtggcccattccaatgttcaagtttcagtcttcttggcagcatttgacacagctggtcactttgtccttgagatttcaagtagtgttcttaccagcttaatgaagttccttctcagattcccttgctattcctcctcattcttctgacatctaactgctggagtacacacacagtgcccagtcctcagaccttttcttttctccatctgtactatcatccaattccatgtcataattgccatctttattctgtctacctcaagtatgtatcttcagcccaacctctctatcactcagcatcttcattttattgcctaacaggcattcaaaattcatacccaaagtaaactccccatcttttccttaccccaaaatattaccattgatcattaaattgggtgagttggttattcagcaaattgattgacaacttagcagatatttacctccacccctctcattaatctatccactgaagaactgaccataataatatctaaagtatctcagtaacggggagggggaactaagaattttatattcagcaaagttgtcctttaactataaactaaactgataggccatctcaaatatattaagaacttagtaaaattaagcactttgtaagtgcttagtaaaaagcacttacaagtgcttccttaacaaattcccagaccacaaaatctaaccattcaaacaaacaaactcagtaatatcgaaataatagtaatagggctggtgttgagcacaaactctatttttaaatggaacaaggaacatgttattaaatagctttaataactacagttacagaacaaacaaaaaatgtactaaatcaatgtataaagaataagatatcaaaaatcagaggagggggaggggatctgttaaaaagtatgtttgttattttttcatcttttatagaaaatcactagtgattgcactgctttaatatgttaactttgtgctctacaagcctctacataactttcaaacatgctctgttcctatgaccatcactacattagaatagaaaacaattgaaattgactcctaataaatagtcgtacttgaaagaaaaaatatgttaatttcaaactcttagactgagtttattctttttgaatagtgataatgggatttgtaaatcggctatatcatttatggtaatgaaatatttatctgagtggaatcaacagctcctccagttttatttcaatctctctttcttatgttaaattcaagtaaaagtaaattaatacttggtatttaaaatgccatgtatactgtgatcccattttcctaaaattacatctagctatattttgctcaatatagacacactgagaaatgtctggaaagatgttcaaatgctgagaatggttatttctggaaagtggaatttggagtgtttttctgcgttcttatttttctgagttgtttaaattttataataatcacatcattttataacaaaagctattaaattttttgtcaagggccttagtacaaacagaaatattctaatagttaaatctagtaactcccaccaccaccaccatcaacaaaagcaaggccttttgcagttcaaaatacatggaagggatcaaagctcagagggaaagacctcaagatcttgcttttttgggtatgacattgatctcatctcttcaacagtaatagataattttggttttatgtcatctagccatgacagagccattcattgcatcattggttgagataatatagcataaagtatttaacagcaaccaccctaaagatgacaatatggaaatactgcttaatggacagaaatttttttatctgtaaaatagcataagccatgttttacctcctcacattcagaggaggtgattaatgattttcccccttgaaaatataaagtattttttaaatgcctatacttccaaatccatataataattaagtagctctgaacttaacctttcaaaatttattctaaagggtttcttttactttttattctggctttcaaaatagtaaaaggcattattaaattcctttccgtagctgtcacccaaattgtacctttagcacacatataccaccgatctatttgcatctaacatttcatttctttatgcttaaaagcagtaaatgtttcaaaaactgtagatcttcttttcagcataattttcttttgaaagaaaaaattagatagcaattatctgttgatttcataagcagcacatatcatcgggttttgttttgttttgtttttttctttttgtttttttctttttttgcttcttttttaaattttattattattatactttaagttttagggtacatgtgcacaacatgcaggtttgttacatatgtatacatgtgccatactggtgtgctgcacccattaactcttcatttagcattaggtatatctcctaatgctatccctcccccgtccccccaccccacaacagtcccccgtgtgtgatgttccccttcctgtgtccatgtgttctcattgttctttttttttttttgagattgagtctctccctgtcgccaggctgcagtgcagtggcacaatcttggctcactgcaacctccgccttccgggttcaaacgattctcctgcctcagcctcccaagtagctgggactacaggcacccatcaccatgcccggctaattttttgtatttttagtagagacagggtttcaccatgttagccaggatggtgtcgatctcctgacctcctgatccacctgactcggcctcccaaagggctgggattacaggctgagccaccgcgcctggccatcatcgggggttttaaggtcaaacatactactttctggatctgtgttcagtaggtatgctttggccatgtttcacccttttcaactagaccttcttggtgtgactgttgcagagttgccaatgagagaagttaactttaaagtcagctttagtttatttttatagcccttgtgaaaaaccacagttgaatctctttaaaatcaggagacagcttaataaactttttctttgtttgcatataatcataatgggggcaaaagagggatggcttaacaggcaatgaaaaccatttttttttttttacataaggagggatagatgtgaggtgtaaagacatttaattgaattatcagacattctaatatgtaggagaaaatgcctattaggtatttactacttgttttaccccctacttactcaggattaggcaccccagtccccttctattctaaaccaaaagaaataattgaacacattctgcctgaactatcctgaagcagtgtggcatccatttattatcaactacattaataattaggattctcctaatcttgatggaaagattgaaacattaatgttctacattttatcccccattctcccactgaagatcatgtgaccttaagcaagctacctgtcatcacttagggcttagttttccacctgtaaaatgatggaagttaccctagatctgcagttagtggatgttgggggctcacagaatcaaaagaaatgaaaactaatggatctttccccagtaaaatgcacacatgcataaaccaaagaacaaacaatgttctacaaggtcccatatggtatagccagcagtcctctccccaaaccctaattttccaccttcatctccatgttcactctgctccagctacattggcctccttgctctttctcaaacatgacaagcagactatcaacttagggtaattgcattgactgttctcctcacctggaatattcctttttacctccaagcctttgctcaaatgttgccttctcagtgaagcttactctgatcaccttatttaaaattgcagaccacgttgctttccagctttactagcccttgctccttgctgtaaaattattttccccaatgcacttgtcataatctagctgttcacaaaaaacttaacatagcagacctaactgctacccttcaaaaggaaggcttaaaaggttggtccttggctggcatctagaaacttgggtttcaggagggtttccacatgcctagaactggtaagagtagctcactatacctaagtgtttgtgcaaacaatgtagtttatgctgaccatctgctttcctttggccagtatacaaatttggtatgtgctaggcagagggagggtgctgtgtgatcagcccccaataaaaaccctgagcactgagtctccaataaactgtactggtagacaacatttcatatatgttgtcacaactcattgctggaaaattaagtgtatcctgtgtgacttcactaaaagaagtgtgtaacttagtctttcccagactttgcttcttttcccttttctctttgtggatctcgcccaatatctcttcactgtgataaatcatagctgtgagtaaaaccatatacaagtcctgtgagtcctcctagcaagtcatagggaccaggggtaatctccggtaaccccaacccggtagcacactaaaatttactcatgaattatgcctagcacataaaaggtgcttgattaatatttattaaataagtacatgcaaaattttgcaattaatttaagaaagttaatggagctccctaaaaaaagtgctaatcattgatactggtaaggactcctttccaagatgctctccttataatttgaagattcaaaattctaagcaatggccaggtgcagtggctcacacctgtaatcgcaacactttgggaagcctaggcagatggatcacttgaggtcaggagtttaagaccagcctggccaacaaagtaaaactccatctctaatgaaaatacaaaaaatagccaggcatggtggcgggtgcctgtaatcccagctactttggaggctaaggcaggagaatcacttgaacctgggaggtggaggttccagtgagctgagactgctccactgcactccagcctgggtgacaagagcgagactcagtctcaaaaaaaaaaaaaaaaaaaaattctaagcaagaagatctgtctctgaactagtttctcttcctgaaaatgcttacatttatggaaaagtagaaggaactgtatatgttttagttggccaaactaggcacatgtcctcagaattaagtgtgacggcatgttgtaaacttggtaaaaaccctggctacacatgagcccttgatggaaatatgaggtttccatttttcttggataccatagcttcaaaattagatttgggaaagcctcttaaagccagacttttgaagctcagtaatcttctgagccaagttaatctagagggagtctcacggcctcctttaaaaatgaaaaacatggaaagttaaagaaattttaaagaggaaattagaaaaagccaactctgagaacagagccaatctttgagtatgtgcagaacatatgagggaggggagaggaagaaaaagttgttattactgttaactgaatcctgtcagaatcaaaaaacaatgtgcaaagccctctcatgtcagcaatactacaatagagataaccagcagcttgggtgcaagcctacattttaaaatatttaatcttttctggtagcaagaaatattggccaatatatttattttggcaagaaagatgcccacttgtagacaaaatgctcacagaactaaatttcatgctgggtactcaaagggagcatatgagtaggttctgttatgggggcatagtaggagttcaataaatgctagtgaaattaataagcatgcctggtaggtattcaataaatgttagtgaaatgaataaatgtgtgcaagacactgggctacacgttgattatagccttagtgcaaatcatacaggtcttaattactttctatagtaagtctgggcatattacagaatttgggggagattacaaaagcagacccttagtcagtgaattaaaagaagagaattgagattggaaggaaacatttctgctgtttttaattaacaaatcctaaagtagttattttagctgttaaaatagattctaagtctttattcaatttttgcaaattttatcactaaattacttagcaatagcttcttctctaaaccatcctccctcctgctccaccccacacaacgcttttggttccattaaaacctgtaagaatcttgatttctttgcagaaaaagttctttgtggcccaacactaactgcacttaacatatgatcttatcatgatattgttaaaaactgtaaaacctcaaaggtagccaatttcaaagagagaagataagcactaattattcaatcaccaatccccatgtttatagttgcaaagtgcaatcaagaattaatttttaagctagtctcaaagcacctaagagaagatagattaaagatgcagaaagaaacattctaacttctttacacactgaattctatgtatctctagaaggagcctctggaattcccatgtcatcagttctttgatggaagcatttatgtgattctactcttcattcctacttatgacttaaacagcccgtatcttcagtcaggattctgcatgattaagtgccatcctagaccaatgggacgggtctcaacaggcagatcagcggcacccagagggaaagaaatccacatcagatcccaacacagaccataatcttttgaccataccatgtagatttcttattacattcatgagactggtttcagagccctcttcttaccttatcctaaactttctctctagatgatctcaaatgctgccataactttaaatatcatctctaagctgaaactccaaattttaaatctcgagtccacacctctcctcttaaattcaaactcacatatacaacttgatttctgtttttggatgtctcacaggcattgcaaacttgtatgcaaaattgaactgtttcaccctaccacacaccttggatctgcttctcttcaacttcttccatccctataagcagcccctccacctactcatttgctcaggtggaatatttgtgtcatattaatatttatttttcacctccctccatacacaccccacattgaatccatcagccaggcctagtgtgtgcgccacacagatcacaaacctgtcaaaccttttcttatacactgacaaggtcctagtccaagatactgtgtcatttttcacttgggtttcagcatggggagaaaagtccatgcttatacttgaaaaaaaaagaccttttataaaattataacattacaaattttaaacaggcatttaagaagtctcatacgtgtgttcaatggaacacacttgtgtttctttttcttttttatttataacttttattttaagttcagggtacatgtgcaggtttgttatataggtaaacttgtatcatgagggtttgttgtagagattatttcatcacccaggtattaagttcagtacccagtggttatttttccggatcctctccctcctctcaccacccacctttcaataggcccaatgtgtattgttcctttctgtgtgtccatgtgttctcatcatttagctcccacttataagtgagaacatgtggtatttggtttgctgtttctgctttagtttgctaagaataatggcctccagctctatccatgttcctgcataggacatgatcacattttttatagatgcatagtattccatagtgtatatgtaccacattttctttatccagtctaccattcataggcatttaggtttattccatgtctttgctattgtgattagtgctgcaattagcacacaagtgcatgcatctttataatagaataatttatattcctttcagtatatacccagtatttgaattgctggatcaaatgatatttctgtctttaggtctttgagaaatcaccacaccatcttccacaatggtcaaactaatttatcccacaaacagtgtataaacattcctttttctctacaatctcaccaacatctattatatttggactttttaacaatagccattctgactggtgtgagatgatacctcattgtggttttgatttgcatttctttaatgatcagtgattttaagctttttttcatatgattcttggccacatgtatgtcttattttgcaaaatgtctgttcatgtcatttgcccactttttaatggggttgtttttttcttgtaaatttgtttaagctccttataaatgttggatgttagacctttgacagatgcatagtttgctaaaattgcctcccattctttaggttgtctgttgactcttttgatagcttccttttctgtgcagaagctctttaatttaattaggtcccatttgtcaatttttgcttttgttgcaattgcttttggtgtctttgtcattaaatcattgcccatgcctatgtacagaatggtattgactattttctcttcagggtttttatagtttttggttttgcatctaaatctttaatccatcttgagttgatttttgtatacggtgtaaggaaggggtccggtttcaatcttagcatatggctagccagttatctcagcaccacttattgaatagggaatcctttctctattgcttgtttttgtcagctttgttgaagatcagatagttgaggtgtgtggccttatttctgggttctctattctgttccactggtctatgtgtctgttcttgtaccagtaccatgctgttttggttattgcagccttgtagtataatttgaagtcagggagcgtgatgcttccagctttgttctttctgcttaggatggtcttggctatctaggctcttttttggccccataagaattttaaaatagttctgtgaagtgtttcaatggtagtttaatagaaatagcatcaaatctctaaatcactttgggaagtatggccattttaacaacattgattcttcctgtccatgagcatagaatgtttttcgatttgtttgtgtaatctctgatttctttgagcagtgttttatagttttccttgtagagaacttttacctccctggttagctgtattctgtggtgttttattttaccttttttgtgtgtgacacctgtgaatgagattatgttcctgatttgattctcagcttgattgttgttggtacatagaaacattagtaatttttgcacattgattttgcatcctgagactctgttgcaaaactgttgaagtcgcttatcaggttaagaagcttttgggctgagatgatgaagttttctagttataggatgatgtcatctgcaaaaaagggatagtttgacttcctctctttttatttggatgctcttattttctttctcttgcctgattgccctggccaggacttccaatactatgttgaataggattggtgagagaaggcatccttgtcttgtgctggttttcaatgggaaatactagaaatgcttctagcttttgcccatcagtatgatgttgactgaatgagtttgtcatagatggctcttattaatttaaggtatgttccttcaatacctagtttattgagtgtttttaacatgaaggaatgttgaatttatcaaaaagccttttctgcatctattaagataatcatgtggcttttgtttttacttctgttatgtgatgaatcacatttattgatttgcatacattgaaccaaccttgcattctagggataaagcctaatcgattatggtggataatatttttgatgtgctgctggattcagtttaccagtattttgttgaggatttttgcatcaatgttcttcaaggatattagtctgaaattttctcctttttttttttttgtcttgccagattttggtatcaggatgatgctggcctcatagatgaggtagaaagaagaccctccttctcacttttgtttggaatagtttcagcagtaatggtaccagctcttccttgtacatgtggtagaattcagctatgaatccacctggttcttggcttttttgattgataggctatttattacggctcaatttcagaactcattattgatcaattcagagattcagttcttcctggttcagtcttgggaggttgtatgtgtctaggaatttatctgtttcttccagattttctagtttatgtgcttagaggtcttcataatactctctgattgttatttgtatttctgtggggtcaatggtaatgtgtccttgttgtttctgattatgtttatttgaatcttctctctttccttctttattagtctagctagtggtctattttattaattttttcaaagaaatggttcctggattcattgatctttaaatgctttctcgtgtctcaatctccttcagttcagctctgattttggttatttcttatcttctgctagctttgggatttgtttgctcctggttctctagttcttttagttgtggtgttaggttgttaacttgacatctttctaactttttgatgtgggcatttagtgctataaatttcccttttaacactgccttagctgtgtctcaaagattctggtatgttgtatctttgttctcactggtttcaaagaacttcttagtttctaccttaatttcactgtttactcaaaagtcatttaggaggttattcaattcccatgaaattatgtggctttgagtgaatttgttagtcttgatttctcattttattacactatagtccatgacatggtatgttatgatttcagttcttttgcattttgtagagaattgttttacttctgattatgtgatcaattttacaatgtgtgccatgtggtcatgagaagaatgtataatctgttgttttggggtggagagttctgtatatatttagcaggtacatttgatccagagctgagttcaggtcctgaatatctttgttattttctgtcttgatgatctggctaatattgttagtggggtgttaaagtctccccctattatattgtgggaatgtaagattctttgaaggtctctaagaacttagtttatgaatctgggtgctcctgggttgggcacataggtatttaggatcttcttgttgacttgacccctttactattatgtaatgcccttctttgcattttttgatctttgttggctggcttaacatctgttttgtcagacactaggattgcaacccctgcttttatctgttttccatttgcttggtatatttttctctatccctttattttgaatttatgtgtgtctctgcatgtgagatgggtctcttgaagacagcatactatgatttttggttctttatctaacttgccactctgtgccttttaattggggcatttaagccatttacactcaaggttagtaatgatatgtgtggatttgatcctgtcatcatgacgttacctggttgttttgcagacttgtttatgtagttgctttatagtgtcacttgtctgtgtacttcagtatgtttttgtagtggctgacaacagtctttcctttccatatttagtgctacctttaagagttcttgtaaagtagttgatggtaacaatttccctcagcatttgcctgtctgaaaaggatcttatttctccttcatttatgcagcttagtttggccggataagaatttctgggttgaaatttcttttctttaagaatgttgaatattggcccccaatttcctctggcttgtatggtttctgctgaaagctccactgttagtctgatgggcttccctttgtaggtcacctgacctttctctctagctgcctttaacactttttctttcatttcaaccatggagagaatctgattattataggtcttgagaatgatcttcttgtgaagtatcttaggggttctctgcatttcctgaatttgaatgttggcctctttagctaggctggggaagttctggatgatatcctgaaatatattttccaagttggttccattttccccatctctttcagggacaaaaatgagtcacagatttggtctctttacataatcccatatttcttggaggttttgtttgttccttttcattcttttttctctattcttgtctgaatgtcttatttcagacagccagttttcaagctctgggattctttcctccacttgttctattctgctattaatacttgtgattgcactatgaaactcttgtagtgtgtttttcagctctatcaggtcaattagattcttttctaggctggctattttgactgtcagctcctgcatcattttatcatgatttttagcttccttggattgggtttcaaaatacttctgtagctcaatgatctttattcctatccatattctgaattctatttctgtcatttcagccatctcaatccagttcagaacccttgctggagaggtgatgtggtcatttggagcaaagaaggtactctggctttttgagttatcagggttcttgtgctgattccttctcatctttgtggacttaccttccttcaatctttaaaactgctgacctttggatggggtttttttccttttatcctatttgatgaccttgaagtttgattgtggtataaagtgaattcagctaactgccttcatttctggaagattttacagggccaatgcttagctcccaactcctggactgcatgctgtaactctgggggacttgtattgagccccaactttgttctctggctccttgaggttaggaatccacttcactggggaggtgggggagaatgaggtgctcccagaccactggtcagtacactccaacgggtggtgtcagccaaagtgtttcagagtgcgatgacagtgggacccattcttgctcacaagtgccagtagcagcagtagcaacagctgtggcatagtgggtggcaggtgccaggatgcctgcctccctgcaagtgttcaccacagtggcaaagtcaacgcagctggggggcctccgctggtgactgtgtgtgtggtcaccctgaaggtggtgttttggctcaggagtggggcactgatgggtgcaggtctgggtgtataggtctctgtgcctcgcaagcaggaatgattgctcaggcatgggaggatccaccattctctgcagagtgttaccataagggcagagcactggcgggggcagggctggctgactctgtgcccaccaagactctgtctgcaacagaggtcagtggggagaggaagggtagactgcacacccaaatgctgatggtcaagaaaagcaaaacccacctccacagacacatgccagcaaagcaatgtggggagttgccttaggcctaaagaaagctgcagtatgggagggagcatgggggttggtgcatggctgtaggggccatcctgctggagctctctaccagtcaggcacaatctgccagtgcagaagctatggtgtgggaccccagggcacccgaggctgctctgcaagcaggtgtagccaggctggggctctgggaaaggacagcagaccaaggggttctcaggtcagactggcctcgtctgatgggcaagaccaccctgcagagttcaggactgacagttcccctagtcctgcaccaaactcttcgggctccacatcagctggctgctgcccctaacccttctctaagcagctctccatgccatcttgagtgtccatagtggtcaaggggtctccccctgccagggttccagaggcctgtggcaaaagcagtttgctccttgccagtgcaactcacctgttccctcagagccactgggggccaggaatgagtgtgggtatactgtagccccatgtagcgtttccagctttctcacccttcagcccagcttctgcgtcttccctctgtccattcttagtgcctttatctctgaagatgtgttaggagtgtgtcagtcatctgagtcccttcatgagagccgttccacctgcctgcgtctagttggtcatcttgtcccccaccaattctttttctttttttatgattaataggatattataggacttatttggttttgaaactttttcaatataaacatacataaacacatgtactttttcattgtaccataaatgtagcataatattaaatatcagaattctgatttgtaacatccagataaacccataagtgatttttccagtaatcactctttctaattgatttatccattgatcctaccccactgatctaatgtttaatataaaatggcaaatgggctgggtgcaagggctcatgcctataatcctagcattttgggagaccaaggtgggtggaccgcttgagctcaggagttcaagaccagcccggacaacatgggaaaacccatgtgtactaaaaatacaaaaattagctgggcatagtgatgcatgcctgtagtcccagctacttggagtgctgaggcaggaggatcgcttcaacccaggaggtcaaggctgcagtcagctgagatgatgccactgcactttagcctgggtgacaaagtgagaccctgtctcaaaaataaaatcaaataaaagtcaaatggtaataaatagtaacatacttaaagtacatttggtttgctacatggatgtggcaagggagttttaccttgatacttgtaagttgtattctaatatttggatcttcctcattactttaagaaaaaaggaaaaccactcaggccctgttgcccaattattttacatttacagcatgattttgaatgtagaatatacatacatattgtcactgttcttataaagtaactcaaatagatgattctaaatattaaaatgggaagagataaaaaactcaaatcaacaaatatttacggagggcttactatgcacaaatagtgaagctacttacaatccacattgttaagtaggtatgaaatgagcaattagctgcaagttaaagacactcaaaatcacagtgcttcaaatgagacagaagtttactttgctttcacaaaaaaagtctggaggtaaagtgctcctgagctgatgtagtggttctgctttataaaatacctaggaacccaggcgtcttccaacttctcactccgccaccttaggtgtggccttatcctcatagtccaagatgccagctagagttccaaccatgacatccacattccaggcagcaggatagagccaaagtgtgcaggtagactaacttttatggaagtttgcaaaagttacccaataaaaatttcacttatatgtcattaatcttacttgcatctcaaagcataattacagctgcaagggaaactgggaggtatagctgctattactgttggtcattaatttagcaggattctgtttttagaagacaaggacaattcatattggaggcaacatctcactgtcacatctctctcctgcatgtttcccaaaactcaaatttctgaatgttctgtgtctattctgcccagccatgctgtaggaggcagcatgaagcagctcttaaatatttctatatttaaactgcctggatttgaatacagtctccaatgggtcctcatctgtgaaatggagataacagtaagatctactcctaggagctgtaaagattaatcagttcgtacatataaagcgattggcacagtgactgacacactgaaagataagcgcagcatatattactatcattatatcaatttagtcaagaggaaatggaagtaacttaactacaggcttaatagcttcctacacaggatcatgggaggcagtcagaagaacagagttaccactacagttttcatggtgagtcctgctgccaccccagtaccgtccataaagaaaatagagaggaactgacttgtataaagtgtcattttctaaaaaaaaaagctccttattcataccacattaataaagttaggcagaaaatctaaacatacagatcactccccaaaccttcctcagacgatacctgggataaactggtatttcaccctgccaaagagaagtaaaatacggataaaggaaaagcaattacggcaatttgttaaaggcatccagcaccaaagctaagatctgaattcaaaatccctccccactaatcctgtggacaaaatggtggaattcatacttgctgaaaccacctttacttataaatattatgaaaatactttaaaccacaaatcaagcaataaaaatcaggtttagggggaaattttctgggtatttttttcccacacacattcaaaattgcttttaagtctttactgacaaaagtgacattgttttttaaaaataaattgggaatacagaaactgccagattactgtgttggagtagtgttgctgggatatcacctctcttccatatttcccagtcttctaatgttaaatttaggctcctgttggcaaactgtttttcttcttttatggcacaaaatgattatcttacttcaactgccaaagtccaagcttgagacatgcaggataaagaaaagtgaataaactgctgtgtttccattttccaacatcacttgcaggcagcaggaagtcacaagcataaagtcacagggaattatcacaaagacaaaacaattcatttaaggctatttagaagcatatttttttatttttgctcccaaatgttgtctagtcatagtattgtgagaatcaacaaaggattctcctccaactgggggagggccgggggagggacagaatgggctagttcagatttggaacagtgacctagaaggcagttctatcactcagctattcaagtgatgtggccatctgaacatctttcccttccttggtagcagagtgagatgaatatatatgtgttaacattcttgagatgagatatagtatctttcctagccaaacataacttctccaaagccaactttttccacatgctttagagtaagaaagataatatttttagagatgttgagaacttttaggctttatcactaaaactgaattcacccagtgaagaggaaccctaaggaaaatttcaaacataatgtcttcccagtgaatttcatctttactcctgaatctgaggcaataggctactttctcccttattaaacataaagaaaaataattacttaatgagagaatatatagccattctcaataaaagcaactgggattccacaaacattactatgtcatgactgaatgaatgaagtgctaagataaagagtttagaaagaatgaaaaacctaattacttataggaatctgtgtgattaagtctagaaaaataaaaggaagaaaagtgcattagtctaatgagatgtagacaaaatatttaaaattggctcaaagtgtttggttgaattatcttgaataataaaagattaaatttcctagaaaatctttgttccaaagtaaaatgattttctgattcatgcttttgaaactttataaagtgaaacaaaagggcattttcctattctttttagtgttgaaaaatggtaactgggcctcagcagaactgaatttgggaacctaaatggcaaacctaaaaattcacttaaagaaggtgaattaggaaactttgttcctcataacagagctccagtgcttgagaactaaagcataaaactactttctgtgaactgtagagatagatttctgtaagatgtctgactcctccattaggaactagtgatccacatttttaaataagcaggaggttcatggatacagatcccattttttgagaaatgttgacctaaacaacacttacctgttctgttgatgcagaatgaaatcaggtaaactgccctaagcttcctcaagatctactcaagctcagtttatcctgttagcctatatctatctctttttctttacacattttttaaaagcaattttccctaatttcatatcccatgatttggagtcgattgtccactctcaataagaaggtatttctcctacagctctaactctggaactgttttatgaaagcttgcaaacagttagtaagcattacactcacctctgaaagatttttcctacctgtaatttaatttagctccaagctatagcacgtgaatgcccctgcattctttatatgactctttacgtcaagtctctacacactggattatatgaagatcccctatgattcacacagtcaataaataaatcaacaaaaatgtagaaaggaaggaggaggatccagttttagatagtaaagatcagaaagaatagtctacatactttatcaaagcgtactgcaatgaaaagtgtaagcatgactactttcaaatgcagattcctagcatgttcatttcctttgttcttcaagtattcatggaattaaagaaacaggaaacaatcagttatgtatattagtgcttccttcactgcactaggtcatcataagcttctgatgaccaaacagaactaagactaaaatggctgatgttcctaaaaacctcccagttgacccagataataagctaggatcaaaaataacaacaagccaatgcagcttttttctctaagaaattctgttattgctgttattagatttacagttacattgggatgctaagatttcttgctgtatttttatggtaattgcagttttatatacataatatcatcaacagctcatatattctgtgggctggttttatgctgggttggatttaaatgctcttcaaggaactgtacttttttgtccccatttaaaaagactgtagacaggtcagataataatagcaataactcagaaacctgaagattagaaaattgaataaggctgattctaaaaaggcatggaaatttcatacccatgctattttgttggctcactgagtacatgatggagtaaaaagaacattgaaactaaaatctgggaacatcagctctaatttcagctatcacactgtcctttaaggtcactggcctccttgggcctcagttgcctcatgtgaaaaatgagaggtctactagattatacatggcacttactttcatctctcacatcaattacaatcaactgataatggctggctgaagcactgtgttaagaaggattatgaggctgattctggacaaaagtagagtgtcatgggtgatttgctaagtcttccataaggacattgaggaaatagctgtacatatgcaatatattttccttatttgacccaaaggaccactaggatttcctttagttacagtctataaagcatattttacaataaaatatcataagatcctttatacaaaatgtttggtcttgttgcttcctccagccacccaagctgctgaaaggaaagaaggccaaggcagagaaggtggttctagtcccttatcataaagaagcagaaggccaacaaggtggtgaatcccctgtttgagaaaaggtctaagaattttggcattggacagcacatccatctcaaaaggaacctcacttgttttgtcaaagggccccactgcatctggctgcatcagcaaaaagctatcctctatgaatggctgaaagtgcctcctgcaattaaccagttcatctaggctttggactgccaaacagctactcaaatgctgaaactgacccacaagtacagagcagagacaaagcaagagaagaagaaagctgctggcaaagaagatgttcccactaagataacacctgtcctttgagcaagggttaacactgtcaccaccttggtagaaaacaagaaggctcagatggtagtgactgcacgtgatgtgggttccatcaagctgattgctgagggctcgccctgtatcctaagatgggagttccttactgcactatcaagagaaggcaagcctaaaagacatccagtccccaggaatacttgtgccactgtggccttcacacatgttaactcagaagacaaaggagttctggctgagctggtggaagctatcagtactaactacaaggttagatataatgagatctgtcagcactgaggaggcaacatcctgggtccaaaatctgtggcttgcattgccaagctagaaaaggcaaagactaaagaacttgccactaacctgggttaatgtacactgttgagttttctgtgcacaaaaacaatccaaattctttaaaaaacagcttggttgtatagattatctataaaatgatttctatattgaaaatcacttaacttcatgacactgtttcctcaatagtatacacacacacacacacatatacacacacacattgatgagaaaaaaaaatctactgccagccagagccactgtcagtatggggtttccacattctccccatctgtttgagttttctcgtgggacaccagtttcctcccgtatcccaaagatgtccacattagattaattattgtatctacaatgtccaagttggagtgagtgtgggagtgtgtgtatgagtgaggctgcaatggaatggagtcctgtcaagggctggttcctgccttgcaccctgacctgccaggataggcaccagccacccacaaccctgaacaggaataagcaggttggaaaatgaatgaatataaattattgtaaaataaatttattttgacaccaaacagtggggtccaaaagtgctcagcaagcctgccatatttattgtttgtttttgaactgtgtggtgataggaggtgctccttataattctcactttgcaaacatttattccttgattcaacccatcaccactacaaccactatcactcactgattcaccaaaacttgggtaaataattatcttacttgtttttattaatctttcttgaatgtatgtttggctcacatttatttcaatgtttaatattaaaagtgttttgagtctttacttagaagtttgatatttctatgacaaacatgctgtaggagcttactgcttgtttatgtaaattagcctaaggtaaagttagttttattacatatcattttgcttaaagttgtagtctccaagaacctatcgacaacgttgagaacttactgtgtgtaaatgtgtgtatataaccttgttttattgtgcctcactttatggcacctcacaaatagtgtttttttttttttttacaaattgaaggtttgtggcaaatcggtgtcaactgctatttttccaacaccatgtgctcacttcctgtctctgtgtcacattttggtaatttccacaatatttcaaacttcttcattattattatatctgttacaatgatctgtgatctatgttaccatcgtaattgttgtggggcaccatgaacagcacccataaaagaaagtgaacttaattactcaatgttttatgtgttctggctgctccaataaccagttgtccccatctcctccatctctccttctcctagggcttttttattccttgagatacaatgttgaaattaggccaattaataatcctaaaatgactctaagtgttcaaatgaaagaaactgtagcaggtctgtcactttccaccaaaagctaaacatttccttaagccaaaacctaacccagagcaagacctacctcttttcaattctatgaaggctcagagaagtaaggaagcttcagaagaaaagttggaagctcgcagaggttggtttataagatttagggaaagaagtttccttcataacataaaagttcaaggtgaagcagcaggtgctgagggagaagctgcagcatattatccaggagattagcccagataattgatgaaagtggctacactaaacaacagattttcagtgtagacaaaacacccttttagtagaagaagattccatctaggactttcagagctagagaggaaaagtcaatgcttggtttcaaagcttcaaaagacaggtggactctcttgctggggctaatgcagctgatgactcttaaagtcatcaacttaattgaagccaatgttcatttaccatctgaaaatcctagggcccttaagaactgtgataaatctactctgcctgtgctttataaatgtaacaaagcctagatgacagcacatttgtttatggcatggtatactgaatattttaagctcactgtggagacctactgctcagaaaaaagattcctttcaaaatattacagttctttgacaatgcacctggtcacccaagagctctgatagagatatacaaggaaataaatggatttttcatgcttgctaacacaacatccattctgtagcccatggatcaaggagtaaattcaactttcaagccttattatttaataaatacatttcataggctatacctgtcatagatagtaattcctatgatggacctgagcaaagtaaattaaaaaccttctagaaagaattcaccattctagatgccattaagagcattcacgattcatgggaggaggtcaaaatcagcattaacaggagtttggaagaagtcaattccaacctgcttgaaaaactgtgagggcttcaagacttcaatggcagaagtaacagtaaatgtaagagaaatagcaagagaactggaattagaagtgaagcctgaagatatgggtaattgctgcaatctcatgataaaacttgaatggaggagtagttgcttctactgggtgtgccaagaaagtagtttcttgagatggaatctactcctggtgaagatgcagtgaacactgtttaaatgacaacaaaggatttggaatattacataaacttagttgataaagcagtagccgggtttgaaaggattgaccacaattttgaaagaagttatattatgggtaaaatgctatcaaacaacatcacatgctatagagaaatttttcattaaagtaacagccaattaataggtctaacttcattgtggccttatttttaagaaattgccacagccacccaacatacggcaactattaccctgatcaatcaacagccatcaacattgaggtaagacccttcactagcagaaagatcatgatccactgaaggctcaaatgatcattagcatttagcaataaagtatttttaaattaacatatgcacagtgtttttggatataatgcaattgcacacttaatgggctacagtatagtataaacataacttttatatgcactgggaaatcaaaaaatttgagcgacactttattgcaatatttgctttattgcagtagtctgaaataaaacacacaatatctccaaggtatgcctctatatataaagagagggagacctaggaaaatacttgaaatgtattaattaatttgtttcatcttcaggagccagattgtgttaggctattcttgtactgctgtaaagaaatacccaaggctgggtaatttataaagaaaacaggtttaattggttcacagttctgcagactgtacaggaaacatggagctggcatttgcttcttgtgagggcttcagtgagcttacagtcatggcagaaggaaagggaagctggcttgtcacatggtgacagcatgagcaaggtgtggggggaggtgccatatacttttaaacaatcagatctcatatgaactcaaagcaagaactccctcatcactaaggggagtacaccaagccatttatgagggaccgagggacctgcccccatgatccaaacacctcccaccaggccacagtttcaacactgggaattacatttcaacatgaaatgtggaggggacaaacatccacaccatatcagagaccaattcttctctttattatacaaatgccaataaagcccaggagagaaaataacagaaaaaaaaattgtagctaatggcaatcactgataaggaatcataaatgagactcagaatatcttaaaatagttgtgcaaatgacaggaaaatcaaaacaaccttcttccagtaaatgtctcatgaagcaattgtgtataagcaaactgcagtagcttgcctacaatagctaacaacatcatctcacttaagatggatgaggtaaaagacatttctgccaatcttgctgtagccaccaaaaagcaaaaaatatgtaacagtcttttcgatgtcaacatttctttgatgatatctgtaaacatttgtttccatgtaacaagcaacctattcttcaaccaatgaatacagcatgagataagagtcataagacttgaagtttgctcccctctttcatggaatcattggggtcttcataacccacctaacctcagctgcctcaataaattatgaaagttgaccaatatttctcttctagctcataagaaaatgaattgaagtcttgtagaatggagaagtggctgagttgcaaaaatccttggagaggctctagaccaggtactggttgtcacctttacatggccatggtgggcttcttgcaatcactcattcttcaggataaattctatccctgagcaaagaaagcaaaatcttgtccttattaagactatatttttattgtcttttttttccaaagtggacataaatcctagcttacctattagtaatgcacacataatcacatcaagtttgggcaaagctaatgacttatccaatatcacatggtggttcaataaagaaattaaatatcacaattcccagatcttgttccaactaaataatggcaatactgaagcaaaattaggatatacacgatatatcctaaggattataggcaaactcaaaagcctacaatgtttagttgttggagttagagtgacaatcagaaatgttaatgtttatccaactccggtattccataaaatatcccagtttcatgtcaaataagttatacctacaatactttttactacggagaactagaaaaatctaaaatgaaaagagaactaaatacaacatgttctgatatattatgctctaggcaatgatcatgttcctaatttacaaagtccatgaaaagaatactcttatgttgaaatagctgttattaaaagtgagtgctcttacagtgaaaatagatcagatgtaacatatctctaagaaattattgttgttctagccattactttgtgaagatgtgctttgttttgattgatttagaaaattgtaataaataagaactgttcagttggaatatgatgtttattccttatgccaatatacgaccaaaaatattttctcacttcagcctagaaagtgagatgtgtattatttatctccaaataaatgtgtaaaaagatgtgtgctttcagtttttcttctttatcccaaaatatttaaatgcctaataaaataatattgttcattaatatattaattgtcctgcttatattttcagtatccaattagtcatttcaagtatgagatatagaaaagaatgcttggaatgtttgctatggctttgtacaaataaaatataatacctaacaagggcaggaggaaggaggagggatttataagtttgcttattgtatttttaaaagtcaaatttcatttaaaattatgtttaaataatattaccagaatattccaaaataaaagtcaaaggtaagaaaaataatgttaaaatcttctcaaatttatgaagaaaaaatgaagtaaaaaataaaaaatcttgtgaaatttatctggtctttcctgaagctctttggtatctccatagacatggtttgaatgcaaaaaactgcccatgcagtgtctatgataagattgcctttaacacactcagcatgctaatatatcaggttcaaaaaatgatttcataattgttttacttaagactaacaggcaaagattgtcctgaatttgctgctctgctgtgtttttgtaggaccaaatcccaggtgcagtttggcctctaagaggcataatctgctccaggaaagccaatcaggaagtcttccttttaactatggcacaaccgttcagattcacctgctactgctgtttccccagaacttctactctaattgaatgtatcaagttgttaagcaattttacataagatgtggcttaaaataagtagctttttatatagaatgaaatgttctgatgaatatagtattacactttgaaaaggaagaaaaacatctagtggatattgtcatgtttgatatttctttttggtgtcaatggaaactgaatagtacatttttttcaacttttactacatattaaagggatggaggaagtagaagcgtaaacagagtaaacagggatggcaagacaaaggagtgttaagtcctcgaggattttacaatctagttattgaaataagacatataggtttttatttattttttcaatttttaatttttgtgggtacatagtaggtataaatatttatagggtacataaggcattttgatacaggcatggaaagcataataatcacatcatggaggatggggtatcaattgtctcaagcatttatcctttgtgttacaatcaaattacacttttagttatttcagaatgtataattaaattattattgactatagtcactctgttgtgctgtcaaatagtaggtcttattcattctttctactttttttttgtacccatttaccatttccatctctgcgtcacctccccacaactacacttcccagcctctggtaaccacattctactctccatctacatgagttcaattgttttgatttttagatcccacaaataagtgagaacatgcaatgtttgtctttctgtgccttgcttatttcacttaacttaatgatctccagttccatccatgtggttccaaatgacaggatcttattcttttttatggccaaatactactccattgtgtatatgtaccacattttctttatccattcatctgttgatggacacttaagttgcttccaaattttgtctattgtgaacagtattgcaacaaacatgggagtccagatatctcttcaatatattgatttcctttctttggggcatatacctagcaatgggattgctgcatcatttggtagctctatttttagtttttgagaaacctcaaaactgttctctataatggttgtactaatttataatcccaccaagagtgtacaatgactcccttttctccatatcctcattagcatttgttattgcctgtcttttgggtataagccattttaactacggtgagatgatgtataattatagtcttgctttgcatttttctgatgagcaatgatatttagcaccttccatatgcctttttgccatttatgtgtcttttttttgcctcaaactccatctattctacatagctattccagttttcttttgattcgtagtttcccagtatatattttttattcttttaatttatttatttttcttctttttttttttttttttttttagacagagtctcactctgtcgcccaggctggagtgcaaaggcgcggtctcggctcacggcaagctccgcctcccgggttcatgccattctcctgcctcagcctcccgaatagctgggactacaggcgcccaccaccatgcccggctaattttttgtatttttagtagagacagggtttcaccgtgttaagccaggatggtctcaatctcctgaccttgtgatccacccacctcggcctcccaaagtgctgggattacaggcgtgagccaccgcacccggcctgttggttgtatctttagctgagtgaatgatttgcaacttgacgtgatcccatttgtcctgttttgttttaggtgcctgtgcttgtggggtgttactcaaggaatctttgcccactccaatgtcctggagattttctccaacgttttctgtagtagtttcatagtttgagatcttagatttaaatattcaatccattttgatttgatttttgtatatggaagagataggggtctagtttcattcttctgtacatggatatccagttttcccagcagcatttattgaagagactgtcttttttcgccaatgtatgttcttggcacctttgtcgaaaatgagttcactgcaggtgtgtgaattagtttctggattctttattctgttccattggcctgtgtgtctgtttttatgccagtaccatgcagtattggttactatagctctgtagtaaatttgaagttaggtaatataatttctccagttttgttttgttttgtttttttctttttttggatggctttggctgttctggctctttcgtggttccacataattttccttttcttttgagtctgactcttgctctatcacccaggctagagtacagtggcacgatcttggctcactgcaacctctgcctcccacgttcaagcaattcttgtgcctcaggcttctgagtagctgggattacaggtgcaccaccatacccagctaatttttgtatttttagtagagacagtgtttcaccatgttggccaggctggtctcgaactcctgacctcaagtgatctgcccgccttggcctcccaaagtgctgggattacaggtgtgaggcaccgcgcccagcccatataaattttaggatagtttttttctatttctgtgaagaatgtcattggtgttttaatagggattgcattaaatatatagattactttaggttgtatggacattttaacaatattgactttttccaatccatgaacatggaatatctttccattttttggtgtcttcttctatttctttcatgagtgttttatagtttccattataaagatctttcacttctttggttaagttaatttctaggtatttaattttatttgtggctattgtaaatgggattccattttaatattttttcatattgttcactgttggcatatagaaatgctactgatttttgtatgttgattttgcatcctacagctttactgaatttgtttatcagttctaacagttttttggcagaatatttagatttttccaaatataagatgatataatctgcaaacaagcataatttcacttcttcctttccaattggatgctctttattttttctcttgtctgattgctctatctaggacttccagtactatgttgaataacagtggtggaagtgagcatctttgtgtgttccagatcttagtggaaaggctttcaattttttctccattctatatgacagatccccagctagtataacactacagcttttattatattatatattttatattttattatattatattaattatactttattttattatagtataatactatagcttttattatgttgaagtatgctcattctatacccaggttttttagggtttttatcatgaaaggatgttaaattttatgaaatgctttttcagcatcaatttcaattgaaatgaatgtatgatttttgtccttcattctgttgatatgatatatcacattgattgtttcatgtatgttgaaccatccttgcatcccagggataaaatccacttgttcatgatgaatgacctttttaattaattgttgaatttggtttgctagtattttgttgaggatttttgcatcaatattcatcagagatattggcctgtagttttctttctctttttttttctgatgtgtctttgtctggtttttgacatcagggtaccactggcctcaaagagagagtttggaatttttccctcctcctctattttttggaatatttttactagcattggtattagttcttctttaaatgtttactaggattcagcagtaaagccactgggtctgggcttttctttactaggagacttttactacagcttcaatcttgtcacttggtattgatctgttcaggttttttatttcttcatggttcaatcttgataggttgtatgtgtctacgaatttttccatttcttctagattgtttcaccttattagcttatagttgctcatagtagccactaatgatcctttgaatttctgtggtatcagttgtatgtccccctttttcatatgtgattttatttatttggatcttctctcctttttcttactctgcctaaaggtttgtcaattttgtttagctttttaaaacaccaactttttgtttcattgatcttttatattgttttcatttcaatttcatttatttctgctctaatctttatttatagtttcttctactaatgtggggtttgcattttctctcacttttccagttctttaaaattcctcattatgttatttatttgaagtttttttttcttttttgatatagacatttatagatataaacttccctcctggtactgattttactgcattccacaggttttggtatgttgtgtttccattatcatttgtttcaaaaaatttttcaatttccttcttaatttcttcattgacccagtggtcattctagagcaggttgtttaatttccttttatttgtatagtttccaaaattcctcctgttattggtttgtagttttatttcttgtggtcagagaagatgcttgatatttcaattcttttgaatgttttaagacttgttttgtgacctaacacatggtctatccttgagaataatccacgtgctgaaggaaagaatgtgtattcattggatgacatgttctgtaaatatctactagatccatttggttcatagtgcagattaagtccaatgtttctttgttgattttctgtctggtagatctgttcaatgctgaaagtggggtgttgaagtctccagctattattaggggcctctctctttagctctaataatatttgctttatatatctgggcgcttcagtgttgggtgcatatatatttaaaattgttatatcctcttgctggattgatgcctttatcattatatagtgactttctttgtctcttcttattgttttcgccttgaaatctattttgtctgatataaatgtatctacttctgctcttttttagtttccatttgcatggaatatcttttcccatccctttatttttagtctatctgtgtctttataggtgaagtgtgttttttgtaaggcacagatcaatgggtcttatttttttatccattcagccactcaatgtctttcgattggagagtttagtccatttacattcaatgttattattgttaaaaaaggacttactcctgccattttgttgtttgttttctagttgttttgtggtcttctcttccttctttcttcccttcatgtctccctttgaatgaaggtgttttctctggtaatgtttagtttcttgttttttttattttctgattgtatccattgtatatttttggtttgaggcttccatgaggcttgcaaatactatcttataacctattattttagcctgataactacttaagttgtttgtagaaagaaagaaacaaacaaaaagaaaactaataaaaactctatactttgttccctcactttttaacttttttgtttctatttataccttattgtactatctaggtctttaaaagctttgtagttattatttttattggctcatcctgtagtctttccacttaagagtagtttatgcaccacaattacagtgttataatattatgtgtatttctgtgtacttactattatcaatgagttttgtaccttcaggtgatttcttattgctcattaatatacttttctttctaattgaagtactctcttttccatttcttgcaggacaggtctggtgttggtgaaatccctcagcttttgtttgtctgggaatgtttttatttctctttcatctttgacggatgttttcaccagatatactattctagagtaaaagtttttttttccttaagtgctttaaattaaattaatgaataaatggaccttattagaacagacgaggcttggaccttaaagggcacactgtatatggacaagtagaaaatatggagagagaaacttctagttataagtgagtttctgcaggccttcctaatctcgtggcgatagatgagagttcattaatagaaataatccaaatttcttccctcaactatctaatgtcaggtctccttcctgaagaatttctgtgaagccttaaagagtgtcaagatcattccctcatgaacttacatttagaaaccctttcccactgatatcaatgccacatcattgtccctcctgcttgtgccctcagcttgagacagcagatgtgatactcaaagagctgcctgcctccaagggaccacagaggcattctatttcctgcagtcctccctgagtcagaatcactctaatgagttaaaattatgagaatttttttattattggaggaagttattttatctaattcttgatctacttataataagtaatcctagaatttttttttttttttgagacagggtctcattctgtctcccaggctagagatctcagctcactgcaacttctgcttcccaggctcaagcgattctctagcctcagcctcccaagtagctgggactatgggcatgagccaccaatgcccagctaatttgggttttgttttgttttgttttttgtagagatggggtttcaccatgttgcccaggctggtctggaactcctgagctcaaagccattttcccacctcagcctcccaaagtgctgggattacaggcatgagacactgtacccagccagtaatcccagaatttttacaaaagctcctattgttgcataatgaaacagtattctcttgccattatttaaagtcacttttttcactttctggtaaaaaaattcgttcaatcattgacaaatatttgctgaacacccactctgtgccgtgtactactatgttaggtgctggatatatgttgatgaatgaaacaaactgtatccttgtagaatttgagtctgctgaactcagaagtaaattctttgaaagttaggatggatagtaaagttgagtactcttagtttcaatatttaacatgttgctcttatcaattttttagtaaatgttagtgtacaaaggtaatttaggttttgaggtgtatccagaaaaatctggtttttttaatcaagagaatccactcaagagactactcatagaaaagaatttatatgatgcatcagatagaaagtaaaatttagtgttttcctgaaaaaaaaaaaaaaaacacaaaaaccaaatacaatggaggcttctcttccacattctgtggcatttgttttttcaactaaacaccaacactacactcatgaaaacaactccttcagcactacctgtactctgcttcaccaaaccagaaacgtcaatataaaaaacaagcagcatgccaaaggtcaactgatcttcaacaagggtgccaaaaatacacaatggggaaaggatagtctcttcaacaaatggtgtaaaaactcatatccatatgcaaaaacatgaaattgaacccttacaccatacataacattcaactcaaagtagattaaagacaaacataagacctgaaactataaaacttctagaagaaaacatagtggaaaatcttcatgaccttggtcttggcagtgatttcatgaatatctcatcaaaaacacaagcaacaaaagcaaaaataaacaaatgagcccacatcaaaggagaaagcttctgcacagcaaaggaaacaattgacagggtgaaaacgcaacctacagaataggaaaaaatgtttacaaaccatatgtattagtccattctgcattgccataaaggaatacctgagacagggtaatttataaagaaaagaggcttattttggcccactgttctgcaggctgtacacaaagcgtggcaccagcatctgctcccagtgagggcctcaagaagcttccaacaatggtggaagggaaagggggagcctgcgtttcacatgataagagagagagcaagagacagagggaggaggtgcccggcacttttaaacaaccagatcgcacatgaattcacagaatgagaacccacttgttactgcaaggacagcaccaagattttcataagggatctttccccatgacccaaacacctcccattaggctcacctccaacattggaggtcacatttcaacgtgagatttggaggggacaaaacatccaaaccatatcaccatatatctgataaggagataattcctaaaatatataaggaactcccacaactcaacagcaaaaagactaataacccaattttttaaatggggcaaaaaaacttgaacagactatgtcacagtatctatgtgaaaatatacgcaacatcattaatcatcaaggaaatacaaatcacaaccacaatgagatatcatctcacacctgttagaatggctattatcaaaaagatgaaagataagtgttgtcaaggatatggagaaactggaacctttgcacactgtcagtggaaatgcaaaatggtatggccgctatggaaaacaacatgaagtttttttaaaaattaaaaatagaactaccatatgattcagcagtcccactctgggtatttatccaaaagaactgagatcaggacttcaaagagcaattagcattcccaggttcattgcagcactatctacaatagctaaaatgtggaaacaatctaaatgtccatcaacaaatgaatgaataaagaaaatgttgtatctatatacaatggaatattattcagcctttaaaaagaaggaaattctgcaatatatgacaccagagatgactgaggaaattgtgctaagtgaaaaaagccagtcatcaaaggacaaatactgcatgattccacctatatgaagtatcgaaaatagttaaattcatagactcaaagaatggaatggtgattgccagggactcaagggagaagaaaaagggaagttgataatcaaggggagtaaagtttcaattaatcaagataaataagttctagagatctgctgtacaacattgtacctatagttatcaatactatattgcacacttaaaaaatttgttgaaagtagatctcatattaaatgttttacaacaataaaataacataaaaaataaaatgacaaagaagcatgctgtaatggctattccaggttatcttccagtaggctttgctaattgatttcctccaacctcagcctagagctcccaggcaaagcaactccttatgacctacacagttgttcaacactcatactcagacatggattaatcacacttaagtgggaacccctacacaggaggattaaggtaaggtatcagggcactcagtatatcagcttaattatgtcagaagatttgtgatgatgaactgtgacagacaaggctagtcaaataagatgagtcctgttgcagatggtaatttaattaccaatttcgggcatgtattgagccctgaccacttgtgcaaaatgttttatttaggtcttatcatgacctatttgaaaatgacaaactgaggtttagctatattaatctgtcaaggtcactcagctagcgtgtggcagagctgagaataaaaccatgcctagtgaatgtcagagtctctgcccttaactactagaccataccatggttgtgagagaatcagtaaagggtcatgaacaaatgttggtatgaagaaagcaccattatagaaagactggattgctggggacaatgtataggagagaaagatagttggaggaggggaaacttgttgctttcatttaatgttaattagtaaaagttcagtcctaatccacaataatatttatactttctcatagcactagtgtgtttccttaataaatggactaaagcagtagcttggaataccagcactaaacttaagtttttaagattataaccataaagatctgtgtgaatgatgaccaaatggttagtaaaaaaaaaaaaaaaaaattatgtaataaaaaacccaccaccaacaacaaagaaaattacccaaagatgactgagaaacatctttacaccactatttgcctaatagaatgactaaataaaacaaacaatgccagatgctggtgaggatgtaaagcaactggagctctcataggttgctgatgagaatagaaaatggcatagccctgtgaaaaacagttttccagtttcttataaagttaaacatatatttagcatattacccaaaaatcctacttctaggtatttacccaagtgaaaacctctattcatacaaaaaaaaaaatctgtatgtgaaaaaagtatgtgtatatatatatatatatatatgcattattcataattaccaaaagctgtaaataacctgcattcccctcaaatagacatgtgtttttaaaaatggtgatacgcccatagtgtgaaatagtatccaacaataaagataaataaactattgatacatgcaacaaagggatgaatctcaaatgctttatgctaagtgaaagaagtcagactcaaaaggctatagtatgattccactcattcatataacattctggaataggcaaaacagatgagtgggtgtcaggtgttaaaggtatggggaagatttgacttcaaagggagaagataagagaatattagaggaggtatattgaaattgttctttatcttaactgtggtaatgggttacataactctacctattttccaaaactcatagaaatatacaccaaaaaagtcaattttactgtatatgaattaaaactacactttcaaataaaaaatctcttctacaagaaagcatacagcaaaagtttcacatattctaaatgttataaaccacgaaacatttcacaaagcaccatctacaaaaaagataatgtaactgagtatttaaacaaaaaaccaagctataattttttaaaaattatatacaaggcataaaacatgcctattaaaagcataagtagttggccagcgtgttgtttaccacctctgaatagctgtaaaatgtttatagatttttatacctttcatgaataaagcagagtaaattaatgcaaagttatttttctgagagaagctgtcaaactcctttctggccaaaagggaatttgtgacttcctgttatgttaaatttggtactaaagcctgaatgaaccacctcaaatgggctatttactatgataaatactgtttcctaacaagaggaaaagtggtggcctgggaagataactgctgggattttaatgcactctctgaaacactctgacatactctgttagagaaaataatttaatattaaccagaagtcaggcttaacattccatttcctgaaaatgatcatcaaaagacaaatgcaatttaattcaccaaacatgtattaagcatttaatatatgccaagcactgtgctaggcattaggtaaacaaactgaaaataacacaatatttgcctttaaagattgcacaaactagcaggggatagagacaagtaataagcaaatatacttccatacaataatctaagtgtgatgatagaagtgtgatcgggtacggggacaaccaggggaaaaagtgattgtctgagttctaacaaaaagcacatcaaccagatcctaggactccctaaatctgccttcagatgattaaaatgctaacaggaacaaatagaaagctgcatgatttgaagaggccattccttttatatttaccaccaccatcttccatgacagttttgaaaacactgagcaaggcatacctgtgctgatgtatttattccttgacttgaaataatcctccaggtgatgaaattcccacaggacaaaggaataataatctaaagtctccctttccagaaagtggaaaagttccaagtagtattattccttactgaaacctaagatccctttatgcaaaagaataaaaaaaaaaggtctcatgcctcatgctaattcactgtggctaactacactacttaaaattaagatagaaaggtatgaatgttccatttttcctgtatgttagcagtgatcatatctaacacataattccaattcactgttactacgaaatgtaactattgctccagtactctcacaacggattaaacaagtaaaagtaagcattccgaaataatggaactcctactatctcctgtgtcttcaagcccttccctgaaactactagccctaacagagaagaacccagtagcactttctttcctctcttctttctatcctttccattctatccgtcacagaaagtagcatcttttttccttcatcctttttattctatccatcacagatattaattccaggtatgtacacaatggccaactagcagaaaataaatcattagaaaatgttaaaagcaaaacagtgggaaggaaaacctaagtgtcacatctttgagggccagcactacgtttccaaaatgggaaaggttttatagctagaagatctgggctcagatcctgcttccgccacttactagctctgtagctttagacaacatattcacctgtctgaatgtcagtgttcacttccacaaaatgtagatgataggaactgctactttgcataattattcttgagattaggtgccatacaagactgattctcaatcccactgcatgctaaaattcgggggcaccactctgagactctgttttcattggtctactgtggggcatgaactacaaaaagagagagagaagaagcagcacatctccaaggtattcaactttacagctgggcaacaacctctgcattatagtaactgcaagaactccctaaactttaattcagtgcagcatttcacaatttattattgtattttaaaagtaccattgaactcatcctgttatgcacgttacatagtcttaaagattgctagtaattcaatagttaaatttgatgtttacttagaatgcctcccttgacaagcaaatcatcattttcaacaactgagaattgttacaaggagctgagaaaacaagatatatacattaaatgattaaagtcacttcttaggtgccaaaaatgaaaggagtatgatgatgggataagctttatgatgcttgaggtcaggtaccatgatttttaaaaatagtttcagcatcaaggacagtgcacagaactcaataaatatttgttaaataagtagatgaatgtgtgagtgaacggatgaatgtaaagatttccacaggaatttaccaagagtcatcactaaagactggaatgaagaggaaggtattttcattggaaaaataagtctcagccactgccaccaatgaagctgcaatgtctctaatgaagagaccgaacttcaggtttgaaaggtaaattgcagtccttgcattttcagttaaatctttcaaacagcagcccactccgcctccattcttggtcccaattctgactctcctccaaacttctaacattaacaattggcacaaggctagctttctaaaacaaacatttctcattactaggaacattacaaaagtcttgctttctgagcattggatacctgctttaagagctagttaatgcacagtataaaacaaggaagacaaaagacatgatctacccagctgggttagccaaggggcctgggagataaattgaccaactgcctgtgtagcatcttacattctccaaaataaccctacaaggttgctgcagatctcagattaagaaaaatttattgctgagtttattatttttaacatcctttgtctgagcacctagcaactaaagtgataagtaccttcaacttgcaaggataaatgctgcaaatatcttggctgaattacccatttgtatgtatgtttgtaacttgaattattcatttacattttttattttttaaagaggagaataaaactagaaagagaagagatactaaaaaatctcattgctgtagatttaaaggttttccggtggtaggaagccaaaaggccccttcagcaataaacaatagatttattctacaatctaattaatactcacaaactatgttacttatgaaacaaacaatatatctagggaatgcaattgcatccaagcaaaagtatccatattaataaggaaaaatcttacaaaagtaggcttggaaaagtatgtgcagcaaaaaagttatggtttttctttaaaactgtatttgaatactaacaacaatgggtaggtcccatttaattgctggtcttacaataaagcaaacattttaaatttgggtgacgatatgagctttccctgaaaactttgctaataacaacctagggtatctatttcttatttgaaaaggaatgaagggtttcctacacctatgtgtaggtgataatgcaagaccatgaaaattctagacccataaacctaccatagaaaaaaatttaatcccttccaaattaatactttgctattgtccaaatgatagtttaagattaacattgatttatttatttgttttcttattaacaataacaccaccactttgtcaatggttgtcaaagtggggtatgtcattgtgatgtgagaagaaaatatcagaacttctacttgtacttatttttatcaaaaacagaaagaaattaaactttattgatattttaaaaagaaattacactgaccccattccctgtccctatatcaaatgtaaacaagacaggcagatttcatgagataggcagaaggaagtagttgttggtgaaacactcactcatctcctagctttcatcaggttgcaaagtaccatactgtgtgtagccacgagtagtggatttactgaatacattacctagttttatttaaactaaccctacaaaacaaaaaagaaagaaaaaaattcttgcaaagaatcatggaatttatgattacacaaataattgatgattgataataattggtggctatacaaataatgtaagcacaaaaaaaaaggtggagctgtaacttctgctcctgcggtgagttcttcatcattcctgagtaaatcagcctgacaagaagtcaagcaaaaaaaaaaaccttttcataatattaaaatatgaacattcatccaccatcattaaaagtcaaggtagctttaagtatatagaatgccttgagatattatgcaatgataatacaaagctatcatcgttttcaaaccgtttaaaaatgttgattacttcacctttatcccattcttccctttatatattgcactgtgtacaatctgtattaggtcagtagtacatatgcataattcatagtgaagagggaatcccagaccttattctccaagtcacactgcccttctcccagcctccacaccatcatctacaggagttagagagtatcaaagttctatatctgtctccacaacactcatagccttacaactttaaagaccatcaagagaaattccatcaacctctttatcaccacaggaaacccaaagttcctgggttttccctcactactaggtctctggtctatgcatccttaatttcaccctgtcttcccaagttcagagcccattacactatgtcctctggagaacataaagtccctcatgttctatctcctcctgaatactgcctccacctctttgctgtaaataaaagccagttattccccaaggactctcttcccctgtagggtccacaaatgatggctattttctctctcatattccaactatcactgtcctacttcctcatcattgtagaaaactgtgtcccttctacctccctccaaaaatccagccttgcaactcatgccatcaaattagacaacttttactactactggctgcagttaacttcagtttctataactgctacaagattttgattatgattttatcatttgcatctgtcatttccacataactgaatctcccagtaccctcaatcctcagatccttaaattgtaaacttcaatgagcttgtcctcagccatttcatggtgatctggacctcttttttattatcaataacagcagccctccatgacctcaactccaagtatccagttccaaaatattacttcccatttttccagctcacgccctctcattctttgataacaatccttaatcaactttttgctgtattttacctccttctgttctagttacattgcctccttacttagcttagattccatggtccatcattacaatcagctccctggtggccctctcttcccttgtttaatcaacctggtaaaacttatactttgactaaatacagctttccacccacttgaacccaaatatctaaacatgggctgagaggattacacaccatccttactggtttcactttaaattcataatgataatcttcaatggggcttcagttcctcccagtgatcttttatgcatttctgcagtcaattcattctcctacacaaccgtttaacgtctctttcctcaaacctccaacattttctctaccatcctcactataatagatgaaacatattcacagatatacaccaccatatctagcagcctagcattcatacacccactagtgtaaactatccaagctcttatctaagaaaacctctccacatgtatcctaacttttaactctcctcactgtctgaaatgcattactctcttcctcttctctctcattgtatcaacactattttctcaattgtggatcatttaatttacatcaaacatgatgttatatctcccagaagataaaatatatctggaaaacccaagagaatcaactgaaaaaaatactataaacaatatgagaatttactacaatatcatgatgcatattaatacagagaaagcacaaggcttcatatattcaataaaatatgccatttacgatagcagaaaagacactagagtaaacttaatagaaagtatgtaagatctataggaagaaaacctaacaacacaactgaaaacacaaaagaagacttcagaaaatgaaattacatcagctagaaaaacacaacatcataaatatgtcaattcttcttaagataatttataaatataaaaccatcataataaaaatacaacagttggtttgggggacttttgatgttattcttttatttttgaacaaagtagctgaccccaaagttcttataaatagtaagcatgcaagaatagcaagggaagctattacaaagaacaataaaggggtgagggtatgagcaccaccatacattaaatgagaaaaaaagaagagccaaaacaatgctaaaaaattaattttaaaagtccaagaacttgaactgtctgacttcagaattcaacataaagcctcagtaatcaccgcaacacatttttgggttgaatatagacatataaattaatggagcaaaatacagagtccagaaataaacctggatatatatgaataattaattttcaacaaaagagcaaagcaatttgatgagaaaaggataatattttcaataagccatgctggaagaatgactaaccatatgcaaaaaaaaatctccacacttacctcatgatacacaaaaattaattcaaaatgggtcacagacctgttaaattttagagttaatactttaactcctagaagaaaacatagaagaaaatcttagtgatgttgggtctggcaaagatattttaagcagggcacgaaactataaaagaaaactgaactggacttcatcaacactaaaacattttgcttctcaaaagacactattacaaaaatgaaaaggggatcttggaccagatggccaactagacacagccaggaaacatctgtctcaccaaggaaaaaacaaaatatggggtaaaccatcacactttgcacagatcttttgagagaaaacattaaaagttgacaaaaaagaaccacagacacccagtttgaagaaggaggaagctaggaagcctacatagagtccctgagtgccagaacaagctcctagtcctgcaaaggccctaaagaaggggtgagttaaggaattctggggacctcaggagtcctagctacaaggataccctgcccaggtatcttctacacttgacctactacatcaacagaccacccatagacataccccacaacccattctgactcttgccaggcacagaggaccagtgggtcgtcagagagttgtaagtctccttacaactgaccttcagctcaggcttcccccaaaagagaaggaggtgcagcccaccagggacccccttggggctaaggaaatgcaggcactgcaacagtgattaaagaggtctcccccaaggccccagaatggatttggtaagggggtcatcacttgcacccaccccctcgtcttctcctccccagaacactgctgtgaacagaatgaaatataagagacatgcatggctgagcaagatcctatctgctagcccttactcttaagcaccatctaatagaatgcagcctagatgacaccacgaaaacataaataaattccataaatatgcatcacctgtgaaacccaatgcagcaaaactaatcacaacgaaggaacccatacagagccttggttctctgaaagcacctagaaaaaggaccaattgactatatacagtcaaaccctcaagtgaaaaaagtacaaaaacaaaaaggcccattcaaatgacataactttaaaaaaaaaaaaaaagaaagaaacaaagaaacactagccctctcaggtgagaagaaatcagtacaatgactctggtaattaaaaaagtcagagtgtttccttaccttcaaaagatcacactacctacccagcaatacaccctaactagattaaaatgtggaaatgacagacatagaattcagaatctggatgggtaggaagctcgatgagattcaagaaaaagttgaaagccaatccaaggaagcaagtaaaacgatctaagagttgaaagatgacatagtcattttaagaaagaaccaaactgaacttatagaattgaaaattttactgcagaaatttcaaaatacagttggaagcttcaataacagactagaccaacctgaggaaagaatttcagagcttagtcagacaaaaataaagaaaaaaattttttgatgaaccttttaaagcctcaaagaaatatgggattatgtagagaccaaatctatgactcattggctttcttgagagaggagagtaagaaactttgaaacatatttgagtacctagtccaggaaaatttcccaagtctcactagagaagtcaacatgcaatcccaagaaactcagagaaccctcatgaaatgctaaacaagaagatcattctgaaggcattttgtaatcagacttttctaagtcaacaaagaaggaaaaatcaaaaaggtagctagaaaaaagggtcagattacttcaaaaggcaaccccagcaggctaacagcagacttctcagtaggtttctacttttcaagcaagaaaaaattgggagcctatttttggcatccctaaagaaatgaaattccaatcaagaatttcaaaccccaccaaactaagcttcatagtacaggagaaataaaatcttttctggacaagcaaacactaagggaatttattaccactagcccggctataaatgagatctttaagggagccctaaacataaaaaagaaagaacaacacctgctaccataaaaacatatgtaagtacagagcccacagaccctataaagaaacaatgcaattgagaatacaaagctacaagctaataatatcatgactggatcaaaacctcacatatcaatattaatcttgaatgtaaatgatatagatgccccatctaaaaggcatagagagcaagcaggaaaaaaaaaaaaaaaaaacaagaaccaaatgtcttctctcttcaagagaccaatcacacataacagccataggggcaaagtaaagggatggagaagcatctatgtattagtcagttttcacattgctataaagaatacctgagactgggtaatttataaataaaagaggtttaattgacttacagttctacagactatacgggaagcatagcagcttctgcttctggggaggtctcagggagcttccaatcatggtggaaggcaaagagggagcaggcatcttatatggcaggagcaagagcagagagggggaggtgctacatacttttaaacaatcgatctcatgataactcactcactattgcaaagacagtaccaagggaatggtactaaaccattcatgagaaatccacccccatgatccagtctccactcaccaggccacacctccaacactgaggattacaattcgacatgagatttggataggaacacatatccaaactatatcagtctatcacataaatggaaaacaaaaaagagcagtgattgatattctttcataagataaaacagactttaaaccatctacagtaaaaaaaaaaaagaacaaagaagggtattacataatgataaagtgttcaattcaacaagaagacttaactatctaaaatatctctgcacccaacatcagagcacccagattcagaacacaactgcctatagacctacaaaaagacttagatagtcacataatagaggaggacttcaacacaccactgacagcattagacagatcactgaggcagaactctaacaaagaaattatggacttatatttgacacttgaccaactggatctaataaacatctacagaatactccactcatcaaccacagaatatacattcttctcatctgcacacagaacatactgcaagactgatcacatgctcagccataaagcaagtctcaaataactttaaagaatgaaacataccaaccatactcttggaccacaatgcaataaaaacaaatcaataccaattaaacatcccaaaaccacacaattacattaaaattagacaacttgttcctggaagacttttgggtaaacagcaaaatcaaggcaaaaaatagaaaattatttgaaattaatgaaaacagagatacaacataccaaaatctgtgggatgcagcaaaagcagcattaagaggaaagtttagagtgcaatatgcctacatcaaaaagtcagaaagatctcaaattaacaatctaacattgcaactatgggaactagaaaaaacaagaagaaactaattcaaagctaacagaaaatataaatatctaaaatcagagcaaaactgaatggaattgaaaagtgaaaatccacaaaaagcagcaacaaaaccaaaagttggtctttgaaacaataaacaagatccatacactgctagtcagaaacaaagaaaaaaggaagaagatccaataaacacaataaaaaaatgacaatggtgacattataaccaatttcatagaaatacaaaagatcctcagaaactattatgaacactatctatgcatacaaactagaaaatctagaggaaatgaatacattcctggaaacacacaacttcccaagattgaaacaggaagaaattaaaactctgacctgatcaataacaagttccaaagttgaatcaataataaaaattctaccaaccaataaaagccctgaaccagatggatttacagctgaattctaccagggatacaaaaaagagctgctaccaatcctgctgaaactgctcgaaaaaacagaggaggagaaacttctccctaactcattgttcaaagccagcaacatcatcataataccaaaacctgacaaagacaggatgaaaaaagaaaactacaggccaacatccctaatgaacatggatgcaaaaatccccagcaaaatactagcaaaccgaattcagcagcacatcaaaaagttatttcaccatgatcaagtgagcttcactccaataatgcaacagtgattcaatatatgcaaatcaataaatgtgatttaccatataaacagaattaaaaacaaaaccatatatcatcttaatagatgcaaaagaagattttgccaaaatccaaaatcccttcatgttaaaaaacctaacgagcatatctcaaaataataatagccatctatgacaaacccacagccaacatcatactgaatgagcaaaagctggaagcattcccccttaagaactggaacaagaaaaagatgcccactctcactactcattttcaacacagtactggaagttctagctagaacattcaggcaagaaaaagaaataaaaggcattcaaatagaaaaaaaaaaaaatcaaactctctctcttcagagatgatatgattctatacttagaaaaccctgaagtctctgccaaaaggtttctagaacagataaacaacttcagcaaagtttcagaatacaaaatcaacgtattaaaatcaataacatttctatacaccaataacactcaagctgacatccaaatcaagaacacaatcctatttattaatacaatatccacacacaaaaataaaagacctaagaattcatctaaccaaggaggtaaaagatctctacaaggagatctacaaaacactgtttcaaagaaaccagagatgacacaaaataaaaataaaaataattccctgcttattgacagaaagaatcaatatcactaaaatggccatattgcccaaagcaatctacacattcaatgctattcctatcaaactaccaccgtttttcacagaattagaaaaaaaatttctgaaactcatataaaaccaaaaaagagcccaaatagccaaagcaatcctaagcaaaaagaacaaaaccagaggcatcacactacataaattcaaactatactacaaggctacagtaaacaaacaacatagtaccagtataaaaatagacaaattcaaaagctagcagaaggcaagaaataactaagatcagagcagaactgaaaaagaaagagacacacacacacacaaaaaaactcttcaaaaaatcaatgaatccaggagctggttttttcaaaaagatcaacaaaatagatagactgctagcaagactaataaagaagaaaagagagaagaacaaatagatgcaataaaaataatataataataaagggaatatcaccaccaatcccacagaaatagaaactaccatcagagaataccataaacacttctacgcaaataaactagaaaatctagaaaaaatggataaattcctggacacatacactctcccaagactaaaccaggaagaagttgaatctctgactacaccaataacaggttctgaaattgaggcaataattaatagcctaccaatcaagaacagtccaggaccagacatattcacagccaaactcttccagaggtacaaagaagagttggtaccattccttctgaaacaatttccaaccaatagaaaaaagagggaatcctcccaaactcattttatgaggcagcatcatcctgataccaaagcctggcagagacacaacaaaagaagagaattttaggccaatatgcctgatgaacatcaatgcaaaagtcctcaataaaatactgacaaacccaatccagcagcacatcaaaaagcttatccaccatgatcaagtcggcttcatctctgggatgcaaggctggttcaacatatgcaaatcaataaacgtaatccatcacataaacagtaccaatgacaaaaaccacatgattatctcaatagatgcagaaaaggccttcaacaaaattcaacagccttttatgtcaaaaactctcaataaactaggtattgatggaatgtatctcataataagagctatttatgacaaacccacagccaatatcatactgaatggcaaaaactggaagcattccctttgaaaattggcacaagacaaggatgccctctctcaccactcctattcaatgtagtgttggaagtcctggccagggcaattaggcaggagaaagaaataaagggtattcaattaggatacttcagcaaagtctcaggatacaaaaccaatgtacaaaaatcacaagcattcctatacaccaatagcagacaaacagagagccaaatcatgagtgaactcccattcacaattactacaaagagaataaaatctaggaatccaacttaaaagtgatgtgaaggccctcttcaaggagaactacaaaccactgcccaacaaaataaaagaggacacaagcaaatggaaaaacattccatgctcatggataggaagaatcaaaatcatgaaaatggccatactgcccaaggtaatttatacattcaatgccatacccatcaagctaccactgactttcttcatagaattggaaaaacctactttaaaattcatatggaaccaaaaaagagcccacatagccaagacaatcctaagcaaaaagaacaaagttggaggcatcacactacctgacatcaaactatactacaaggctacagtaaccaaaacagcatggtactggtaccaaaacagaagcatagaccaatgcaacagaacagaggcctcagaaataataccacacatctacaactatctaatctttgacaaacctgacaaaaacaagaaatggggaaaggatttcctatttaataaatggtgctgggaaaactggcgaaccatatgtagaaagctgaaacaggatcccttccttatatcttatacaaaaaataactcaagatggagcacagacttaaatgtaagacctaacaccataaaaaccctagaagaaaacctaggcaataccattcaggacataggcatgggcaaagccttcatgactaaaacaccaaaagcaatgacaacaaaagccaaaatagacaaatgggatctaattaaactaaagagcttctgcacagcaaaagaaaataccatcagagtgaacaggcaacccacataaagggagaaacattttgcaatctacccatgtgacaaagggctaatatccagaatctaaaaagaacttaaacaaatttacaagaaaaaaacaaacaaccccatcaaaaagtgggcaaaggatatgaacagacttttctcaaaagaagacatttatgcagccaacagacacatgaaaaaatgctcatcatcactggtcatcagagaaatgcaaatcaaaactatgatgagataccatctcacgccagttagaatggcaatcattaaaaagtcaggaaacaacagatgctggagaggatgtgaagaaataggaacgcttttacactgttgatgggagtgtaaattagttcaactattgtggaagacagtgtggcaattcctcaaggacctagaactagaaataccatttgacccagccatcccattactgggtatatacccaaaggattataaatcatgctactataaagatgcatgcgcacgtatgtttattgcggcactattcacaatagcaaagacttggacccaacccaaatgtccaacaatgatagactggattaagaaaatgtggcacatatacaccatggaatactaagttcatgtcctttgcagggacatggatgaagctggaaaccatcattctaagtcaactatcacaaggacagaaaaccaaacacttcatgttctcactcatagatgggtgttgaacaatgagaacacatggacacaaggcagggaacatcacacacaccagggcctgtcgggggttggggggctgagggaaggacagcattaggagaaatgcctaatgtaaatgacaagttgatgggtgcagcaaaccaacatggcacatgtatacctatgtaacaaatctgcatcttgtgcacatgtatcctagaacttaaagtataaaaaataaaataaaataaagaaaagaaattcactgacattcagaaaaaaaaatagacacatagtcacctgaggtcaggagttcgaggccagcctggccaacatggtgaaaccccgtctctactaaaaatacaaaaatcagccaggagtggtggcacatgcctccaatcccagctacttgggagggtgaggcaggagaattgcttgaacctgggaggcggaggttgcagtgagcaggaatcctgccactgcactccagcctgggtgacaagagcaaaacttcgtccaaaggaaaaaaaaaaagacacatagattaatgggacagaatagagaacagaaataaggccacacacctacaaccatctgctctttgacaaagttgatgaaaacatacaatggggaaagaactctctactccctattcaataaatgatgctgagataactggctatccatatgcagaagaataaaactggacccctacctctaactacatacaaacattaactcaagatggattaaactatcctctaaaactgtgagaaataaatttgttgtttaggttaaaaattttcaaaaagtttaaaaaaaaaggtggattgcagacttaaatgcaaaacctaaaactaaaaatattctagaagaaaagctaggaaatgcctttttagacatcagccttggaaaagaatttatggctaagtcctgcaattgcaacaaaaatgaaaaagtgggacctaattaaactaaagtgcttctgcaaagcaaaagaaactatcaacagaataaaaagacaacctacagagttggtgataatattcacaaactaggtatccaacaatggtctaaaatccagactctataaggaacttagaaaattcaacaagcgaaaaacaaataaccccattaaaaagtggacaaagaacattaacagacatttctcaaaagaagacatacaagtggccaccaaacatacgaaaaaaatattcaacatcattaatcaaaactatgagatcccatcttacacaagtcagaatgtctattaataaaaagtcaaaaaaaaaacagatgttggtgaaggctacagagaaaagtaaatgcctataaactgtttgtgggaatgtcaattagtttagccactgtgaaacacagtttggagatttatcaaagtactaaaaatagaattaccatgcgaacagcaatcccaatactagggatatatccaaaggacaattattcattcaaccaaaaagacacacacacccagatcttcatcacagcactattcacaatagcaaagacatggaatcaacctaggtgcccgtcaaaagtgaactggataaagaaaatgtcgaatacagtatgcccataaaaaataacgaagtcttgttttttgcaccaatatggctgcagctggaagccaatatcctaagtgaactaatgcagaaacagaaaaccacatactgtatgttcttgcttataagtgggagctaaacattggatgcacatgggcataaaaatggtgacaacaagagtgcggaaaaagggagaaaggaaagtgttgaaaaactaatcattgggtactatgctcagtatgtgggtgataggtttaattgtatcccaaatctcagcatcacacaacacacccttgtaaaaaacctgcgcatgtaccccttgaatctaaaacagaagctggtgggaaaagggcttacagagctccaaaaaaaatgaatgaaaaagtacaccacggaatgggagaaaatattcgaaaaataaatgtcccacaaaggacttatacctagaatatttaaagaagttttacaacttgatagaaggacaaacaaaagattgaacctaacaggcatctcaccaaagaagatgtagagatggcaaataagcacgtgagatgtttaacatcattagttattaaggaaatagaagttaaaaccaaattgagatagttctacatgctcactagaatggctgaaatttaaaaggctgaccataaaaagactattggcaaggatgtggaccactgaaactctcatacacagatagtgggaatgtaaaatggcacaactcctttggaaaacagtttgatgatttcttaaaagtgtaaaaatacatctaccatgtgactaagccactgcactcctagatatttgctcaagataaatcaaaatgtctctttacacaaaaacttaaatacatgaatgttcatgacagttgtactcgtaatagcctaaaactggaaacaacccaagcatctatcagcagctaaataaataaacgaataatggtatccatacaatggaatactatttcacaatatttaaaactactgataaacacaacatgatggatgaatctcaaaataattatgctgagtgaaaaaaagctacataaaaagagcacatgttatataattccatgtctataaaattccagaaatgtgaattaatctacagtgacataaagcagatcagtggttacctgtggagaggaggaagagagacacaggaggcagaaaagggaaacattgcagacgggcaagagaaaactttagggagagattggtacatttactatcttgactatggtgatggtttcaccatcgacatatttcaaaactcatcaaattgtacacttaaaatgtatgcactctactttaggggctgaagcagggggatcttttgagcctaaaagctagaaggtagcctgggcaacacagcaaaaccctgtcactaaaatatgtatgtataatgcattacatatattaaacctcaataaatctatttttaaagccttggtaattaaaatactgatgctgtaagatgaataggaagaattaaaaatccaaaaatagattcaaatacataaacgaatgcattctgtgaaaaaagtgatatctcaaacaagttaggagacttgctggtcaagacttgctcttggaaaaactggataaacatccagaaaaaattaaataagattgaatccatacctcacattatatcattatattccagatgcatatattctaaatagatcaaagatttgcttgtagaaagtgcaaccatgtgataattccttttcaaccttgggcctgcgagctaactatgactgagtcaataaaagaaaaaaatgtataaatctgacaacaattaaaatcttctccatggcgaaaatacaccataagcaaattcaaaagacaacaatctggaaaaagtgtaattgcaagtcatattacaaagagttaatctactcaatattttaaaagctcctaaaaatcagtaagcaaaagaagtccagtaactcaaaagaaaatgggtaaagaatgtgaacaaatatgcatatgtacagataaagatgcttaacctttctaataaaaaatgcaaattaaaataacactagataatatcttttgcctatcagcttagaaaaataaccaaagttaaagacactgttagttaggcttcagcatgcaggtattctcatacaccatgagaatgtaaattagtaccaccattttggaggacactttggcaatatctgtacaaattacaaatgcatatgccctttaaccccaaactttcacttctgagaatttatcctacaaataacacttgcatgcctatgaagttgtatatatgcatgtgtaggtgtgtctacatacttaagtgtatgtatgtatatatgtatgtatgtgtgtatatatatagttattacttacattattctgtgtaatggcaaaagattgaaaatcattaaaatgtccatcaataaaggactggtcaaacaaattttggtatgtctatataattgaatactataaagctgttacaaaaaataaggcagatctctatatgctgatgtggaaagatctccacttgatttttttttattcaggtttcatcattttacttttttcacaaaatttgtgtatgtgactcacatcaattcattttgatatataatttatttctgatattttgtttatttgaagtgacaggtaactgggtaattatctatactctgcttttaccatgtattttatttctaggtaaatttgaaaaatctgaagtatttttctaaatttgatcatggtttatttgacagtttacaagtacttgcaggcatgtgtttgcatgcgaataacgacaaatagctaagaaatcttacaatagtatagtttcataatttgggggtcctggttatacattttacatctgtaggttaggaatgcatattgttaatttcccttcatggttccttataactaaactctgtttagtaagattttctacttatcaaaggcataataactcactatttggtatatttgctctttaatgtgacatatgacatattttctgtggataaggagaactctgtatttgtgtgtatatgtacatataatgttttcaactaatcactatttcagagaaaaaacagatgaaaagaaacttgtttgcattacattaaatataatcctatacatgttaagaggaagttttttttgtttttttttttttttgagacagagtctcgctctgtcgcccaggctggagtgcagtggcgggatctcggctcactgcaagctgcgcctcccgggttcacgccattctcctgcctcagcctcccaagtagctgggactacaggcgcccgccgctacgcccggctaattttttgtatttttagtagagacggggtttcaccgttttagcctggatggtctcgatctcctgacctcttgatccgcccgcctcggcctcccaaagtgctgggattacaggcgtgagccaccgcgcccggccaagaggaagttttacagcaagaaattgttcctttttttcttcccatttttctttttatatatacatattttttttctattatactttaagttctagggtacatgtgcataatgtgcaggtttgttacatatgtatacatgtgccatgttggtgtgctgcacccattaactcgtcatttacattaggtatatctcctaatgctatccctcccccctccccccatcccacaacaggccccagtgtgtgatgttccccttcctgtgtccatgtgttctcattgttcaattcccaccaatgagtgagaacatgtggtgtttggttttttgtccttgcaatagtttgctgagaatgatagtttccagcatcatcgatgtccctgcaaaggacatgaactcatctttcttatggtgtcatagtattccatggtgtatatgtgccacattttcttaatccagtctatcattgatggacatctgggttggttccaagtctttgctattgtgaatagtgctgcaataaacatatgtgtgcatgtgtctttatagcagcatgatttataatcctttgggtatatacccagtaatgggatggctgggtcaaatggtatttctagttctagatccctgaagaatcaccacactgtcttccacaatggttcaactagtttacagtctgacctacagtataaaagtgttcctatttctccacatcctctccagcacctgctgtttcctgactttttaatgattgccattctaactggtgtgagatggtatctcattgtggttttgatttgcatttgtctgatggccagtgatgatgagcattttttcatctgtctgttggctgcataaatgtcttcttttgagaagtgtctgttcatatctttcgcccacttgctgatgggttgttttttttttcttgtaaatttgtttgagttctttgtagattctggatattagccctttgtcagatgagtagattgcaaaaattttctcccattctgtaggttgcctattcactctgatggtattttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctggggtttttatggttttaggtctaacatttaagtctttaatccatattgaattatgaaatgaagcgtgaagagaagtttagagaaaaaagaataaaaagaaacgaataaagcctccaagaaatatgggactatgtgaaaagaccaaatctacgtctgattggtgtacctgaaagtgatagggagaatggaaccaagttggaaaacactctgcaggatattatccaggagaacttccccaacctagcaaggcaggccaacattcaaattcaggatatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcagatctctcggcagaaactctacaagccagaagagactgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagacctcctgaaggaagtactaaacatggaaaggaacaaccggtaccagccactgcaaaaacatgccaaattgtaaagaccatcgaggctaggaagaaactgcatcaactaacgtgcaaaatcaccagctaacataataatgacaggatgattcacacataacaatattaaccttaaatgtaaatgggctaaatgctccaattaaaagacacagactggcaaattggataaagagtcaagacccatcagagtgctgtattcaggaaacccatctcacatgcagagacatgcatagctcaaaataaagggatggaggaagatctaccaagcaaatggaaaacaaaaaaaaggcagggattgcaatcttagtctctgataaaacagactttaaatcaataaagatcaaaagagacaaagaaggccattacataattgtagagggataaattcaacaagaagagctaactatcctaaatatatatgcacccaatacaggagcacccagattcataaagcaagtccttggagacgtacaaagagacttagactcccacacaacaataatgggagactttaacacccaactgtcaacattagacagatccatgagacagaaagttaacaaagatatccaggaattgaactcagctctgcaccaagatctccacttgttaagtgaaaaagatctcccacaatgttaagtgaaaaaaagcaagctacagaggagttgtatagttgttacttttctgtaaaatgatggggtaataagaatctatatttatgttttcttatatatataaagagtctctggaaagatacataagaaacacataattttgattaccctgatggatgggtggggttgtatagatgagggcagagaagtcaagggaaacttcactgtacatttcatatataatttttctgatctgtttatatatctgtctctcccctgaaaacaacatgctatgccccatggggtcaggcacttagttgtaatgtttaatgtaatgtttatgtttatctccagtgcctcaaatggttcctagcaaatggtagaacttttgtaaaacttattttttgatagaagtgcacattttaaaaactttcagaccactgtagtaaattatgtctagatttccttacagctctagagtaggtttcagcaaaatttttctataaagagccagatactaaatattttaaggtttgttggccatatggtctctgtcacgattactcaactctgcttttatggtacaaaagcagccacagacaataagtaaacaagtgggtgtgactgtgttctaataaaatattatttataacaacaggtagccagccagatttggtccaagggctgtagtttgcccaactctgttctggaattttgtttctctgattatccatcagttgaaccttgaaaggtatgtaagatttccatctttcaaaataaaaaaattggataacgaatgaacgaataaataaataaataaatattaaccaacttttccataaggaagagttattcatattcttattcatccgatcttattcatcagatttacttcttttatattgggctatatgatactgtatctctaatgagacttttttgctttaaatccactgcattttattttattaatttataatttttattggtacatattaggtgtatatatttatggagtacatgagatattttgttacaggtaaataatgtctagtgaggtgacttttgaacagggacttgaaggaagtaaagcagcaatctatatggttagctaagggaagagggcctcagggagaagaaacagtcaacataagctacttgaagagaaaatttgcttggcttgtcttaaaactatttttaataatttcattaaagcaaaaaattctacattatagaacaccaaatatacaacttatttagtttaatatacaaatatatatctcttaagaacacaactccaaaatgaaaatatttagatattaagttaggacataaatagactaatcatttaatgatacaactccaggaggcacatagccctaagacatgtttgacaccgacatactaaaagttgaagatgctatttattatcctgcccaaattatttaaattattttagtgtatgcttggtcttgccatgattgtgagaagagcacagagacatcagaggatctagtttcttatcctaactctaccactaactagccatgtgacaagtttttaatggtaaacacaggagttgaactagataatgcctactcttcctatataacattcagcaatatctggataaattattgggtatcacaatgagtcaaggtcagggatgctcttaaaaacctgcaatgggccgggtgcagtggctcatgcctgtaatcccaggactttgggaagccgaggtggacagatcacctgaggtcaggagttcacaaccagcctagccaacatggcgaaaccctgtctctgctaaaaatacaaaaaaattagcctagctgggcgtgatggcatgttactgtaatcccagctactcgggaagctgaggcaagagaatcgcttcaactcgggaggcagaagttgcagtgagccaagagcactccaccctgggcaatagagcaagactctgtctcaaaaaaaaaacaaaaacctgcaatgcagaggacatctcacacaataattattcaacactaaatgtcaatagtgccaaggttaagaaaccctgtcctaatgaaaaggattcttctctacttcattgaaggtggtcaatgactatcatatattaattaggaatccttctggctaacaaaacctgaaataaatggtagtttaattttctgaaaacaaattcataagggtggctgccaacaacagaacagcttcaagaactcataggctaacccccaaagtgatgatattagaaggtgggaccttttgggaggtgattagttcaggaaggcggaacccttatgaataggatcagtgctcttataaaagaggccaaaaggaacccatttaccttctaccttgagagaacagagcaggaaggcactgtctatgagaaagtgggccctcaccagctgccaaatataccagtgccttgatcttaaacttcccaaactccagaactgtgaaaaataaactccagttgtttataagctacctagtttgtggcattttgttacagcagaccaaatggactaagacagggagaaagcagtagtactagccacatctatgtcttttatcaggaaagcaaaatctaacaccttaggggacagaactaccttcaagggaggtcaggaaagtcacttaaccctcactgcctgcaagggaggctggactagtaaacacttagcttccttagacttcatagtggagtctggcaaaagagaagaggattggaaattggtcttaggttaatcagttaatagagcctaccttatagtcaatatcctctcacatgaattaagatgaatactaaataataaataagtcctcatcaaacagttgatttctgggatttcctccttggtagagatgaaagaataggtgcgtaaggactacaaatctaattcatatagctcaccgatgctctgtggacaatgtcatttaaaaagtggtgctttcttctttaattgacccactgttcacacattcagctttatgttatgctatggttagatattaagttaggacgtagacaaaagaaactagtaagccaagtatccctctttcatagcagagtaagagacaaactaaaaagctatcaaccagagactaacatcgtgaaaaatcttggaaaccctcttaagggaactcttggaaaagtagtttaattacagagaacaatctcaattgctgcaggaaaagccattcctaactaacctgccagggcacttcagagatattacagccttgatacgagaaagtcaatacacatcaaagctcaaagatatatgttagagcccatagctatgatgccttttgaatctgctcagcgccatccaagcaagtggtataaattcaagattatttggcttatatttaaaatgaaaaaggcatgtttgcattccagtgcacagataaaagtgctctcttcctctagggatgaatatatcctaaccagtttaacatactttagtttggatttctgtttggtacagtaacaatgtagaccctgctaaactttatgtaatccacagtagatgtaatatattcagattttcaaacagacctaaaaagatttaacctctgagattgctgttaaaaagaaaaccttctgtactagaaagtagaatgtgtatgtagcagcatcagggagaagaaagaagatgtatattaaggaaagaatgagaagtcaccaataggaaaatttgtcagaataagttaagagtagggactagttgaaatctcctaggtcttttcagtttagcatttccttctctagagggaaattctatgaagtacttttctattataaacttgaatttctcatcctaatactttccaaataaaattattttacactaacattcaacgactgatttaaagtacagggtctggaaatttggggataaattgttttaaattttttgcaggttgctgaattctgagatgtttttgctctaactattctttctctataaaaagagcttattttaaaaaaaattttcattgacatataataattatatacatttatggagtacatagtgatgtttcaatgcctataatgtatggtgatcagagcagggtaattagcatatctaccatctaaaacatttgtcatttctttgtgttgggaacattcagtttcttccttctaggagtttgaaactacataatatattattgttaattatagtcatcctacagtgctagagaacaccagaacttattcctcctatcttgctgtaactttttttttaagagacagtcttgctctgtcacccaggctggagtagtagcacaatcatagctcactgcagccttgaactcctgggttcaagccacccccacacttcagcctcccaagtaactgggactacaggcgcatgccacaaaacaaggcttctagctttaattttgtaccctttaacaaatctctatcaccttcttccccctacccttctcagaccctagtgtcctatgttctactttttacttttttttatgttttaatgttttgtataattacagtgatatttgttccaaacctcaaactgggacacttaatataacaaaagattttaaacattttgagaatttttaaaattttaacttgttattttgaaataactttagacttacaaaagagttgtcataatgatacagagagtttctgtatatctattgcccagctttctcaaatgttaacatcactaatgttaacatcctacataaccaggtatggttatcaaaactaagaaacgaatatttgtgtagaacactattaacaaatgccagactttattagagttctaccattcttttttaatggatgtccttattctgtttcagggtccaatcaaagatgttatgaaacattttgtggtcatcttcttttgtctcctcagatctgtgagaattctgtgagaaagacagtctccatctttcctgttctttcataaccttgacatgtttggaaagtccctcatccacgtatgacttagaacatgcagtttttaactgtctgttcctgacttatttcacttaacagtgtcctccagttccaaccatgttgctgtgaatgacaggatttcattctttttatggctgaatagtgttaatggaatatatacacaatggtgtatatataccacattttttatttaatagatcattttatgccctttagaatttatttagttgctatcataataagtaacatataagggcaattccattgaagcattctggactttggctaggtaactgaacaattatgagatacatgtcaaataatgggcacttgatacatttctgttgccatttgtcattttcaattgtcgtttgtctacattgacaaatgcagagcttcttcactgtgtttgtgtacctaactgcatcaaccatttaaaaggtatctaaaaatctatgtctaggaattctaaatacaagatttgaccttttgtggaaaatactacatatgtcttaaaatatttctctgtttaaaacataatattacattattataaagttgccatgagcataattctgtcttttattttttaatactcatccaaagaccacattgtatagtgaaaatagcatagaagtaggagtcaggatgcctgtgtttcagctctagccccccgcttggacaagtctcttaaaatcctcaagcctcagattcatcttctacaaaacgaaggtgatataacttccttgcctagttcacagggcaactatgatcattatatgctatgatccttatgaaagtgtttataaattgaaaggcattatacaaagatattaatatagttaaatataaacaagaatatggcatataacccttggtggggaaaatggactaaaaatatatttagaaagtatcatgcgaatatgaacatcacattgcttttcccaaaggtaaagcaaacaagtttatactttaaaggctcttggtaattttttaaataggatcaataggtgacaggtccacacttaatacaagccatctgatctagaataggaaatccaagactttagagtacaatgaggtgaaaatcctaaaccatgagtagagcatagaattagtctggagaggccgggcgcggtggctcacgcctgtaatcccagcactttgggaggccgaggcgggcggatcacgaggtcaggagatcgagagcatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagtgagactccgtctcaaaaaaaaaaaaaaaaaaaaaaagaattagtctggagagcaaacagaacacttacagtaggggcattatgcctgttatcaaactaatctaatttctatgtaaggcaatgttcttttgtattttgctgaagaagaaataagaggaatctgagaggtcttagaaactaatttttgaaagattatattttcattcaaaatggatcagataaagttctaaagtctaagaaaatctaaggtacgatgtgagcaacatgaaatttttcattccacttagaaattctgaaaaaagagaacatactataaccagtgaaatgggaatgaaaattcaagtaaaaccttttcatgaaagattattcaataaataaaagaatattcctggagattaactgtaatcttccaagaggcataggtgcataggtggctcctttcatgggttgtgtataaaagttaattcaacaaatatgcattgagttagtacctaaaatatcataggtaatagggaggaaacagtatgtggcatgacctgtacttatgaaagactaaaggatcaatatcttttacaactaagagaaagtttgatatactcaactgtctaaatgaatggtacatattctatatgcacagatgcttccacatttgttaatgagtactaagggcaaatagggaagacgaaaacagtaggaatacaaaagaagggtttcatgaagaagtggaggccagagactggtcttacagaactgatatgatttgagtaagggagagagcaactactataaatggagcaaattccttatttgcaatcttggaaggaaatctttaagaagttactttagtcttcatttttctatttcactttgtactttttagtgactaaaataggttagcagagagcactaagagaaatataataccaagaattagaatcctaaaacctcaagggcttcaggtaccatataacaaatctattgccctgaactcaagctccattaccacagtcctgatgactgtctctctgctgattgagtatctccttgaaccaagagctcaccattttatgaaacaattcccttccttgtttcagaatagtctacagatatgaactgaagatcattaaagtattttaagtacacaaatcaatattcccatttgctagccataaaaacactgaaaagtcaaggggaaacatctgcataataaaattaaagactttcatataacttttaggtttcaaaatgaaactacgtgtaaggagactaaaacccagactttcctaaggccacaaagcaatttagtggtaaaaacattctctataaattcaatcttcttaacatctttccagtatgtgttactgtcccacatattctaatccaaaagactctattttgtgtttcatatcaagaactacatgctctgctccacagccttctgaaaatgaaaaaaaagaagtttaatgatctattcagatgtgtttcccttccttcgtgcactgtaattatttccaataaaaatttaaggaggttaactggaagatctgacacaaagcttgagctaaatgtaccaccctctcctcataccaccaccctcccctgaccctctttcatataaaaaatagtacattttaacttcaaagaagttcctgttatctgtgtactctctgcccatggaaattacatatacaacatacatacagtctccagatactccatttctatataggcactttcaaaggaggaactcaggcattaagttctttctagaattgaaaacgctcactcagaaatagcacctccagccctttctgacaggtgaagccctgtctatcaatcattgccctgctgccttgttttctttctttttttttccagtccagtgtgatcaactgaaacaatatcactatccagctctgagcatattcattttacttacatgtacattggaagttctttggtgactaatacttaaaattatatcagtttacttaaaccatgttcaatgaaaaatagataatcaaaaagatttttttccacagaagctgtttgactaacagtttatgagaattcaatgttagtttctttcattctaactttttaattatttttaactaaacatagttaagaaatggaggtttctgtcagcaatccaagtctctcaagttttccaggatgttttatctactgaattcttgaaatgtctactaagaacagtgcaataatttccataagcaaaggatgcctaccagtacagaacccaaagcactaagccctgctaaggcacagcattcacatggcacactaaacaaaaattttaacaaaattgtattcatttttatcaatttataatttatcctatcaattttcaaaaaactttaaaacagtgtaggataaatacatgtataaaataagcagaattaaaataaaaatcaactaaaaatcaactaacaaaggttcatgtgatagaaattatattagaaaaatataatatgtatttgtaggaactactaaaattaaggtttcattaattgttatgatcttcttgacaacatggctctcatcatctgctataagtggacccatctgtttcttactatacatacatttatacatgtatgtgtatatgcctccctgtgttggtccatttgcattgttataaaggaaataacctgaggctgggtgatttataaagaaaagaggtttatttgactcatggtttatttggctcattctgcagggcttctggtgaggcccaggaagcttttactcatagcagaaggtaaagggggagccagcatatctcatgatgaaagcgggaacaagagagaggagggggtgccaggctttcttaaacagtcagatttcatgtgaactcatacagtaagaattcattcattatcacaaagactgtatcaagccattcatgagtgatcagtccccaagacccaaaccctaccactaggcccacctccaacattggaggtcacatttcaacacaggattttgaaggggcaaaacatccaaactacatcactccataagttgttaatgcagtgtttatcaaaggcatgacttaatgtaagtcttggaactgtattcattgcttagttttaatgttacatattatacatattatataatctctattaataaattctcattaaaaattaagaacaattaattgttaatgtactaggtgatttgtttaaaataaatttctaaacaggaagtataatgttctcattcatctatttattcatttattcaacaggaagatgaaaaagccatggtacctaccccgtggcaagcaccgtgaacaaggcattacatgcgtaatgctatttaatcttcacaacagtcgtggtaagaaagtattgccatacccatcttacagctgaggaaactaaagctcagaaagattagaatataccagtaagtagtggagttgggacttgaactcatttgcctagctgcatattaagattctcaccactacataatgtagtctcacaacaagtactaacttaccatttatgtagtaccaaagaccaacttaaaatgtagtgtagactcagaatcacaactagaatgtggtccttgatttttaaggtgtttacagtccactttacctcactaacctaactagagctatgctaggcatatcttggagttcaatgattagttaacaataaatttaaatatagaatgagtcagtagatataatattgagtttctattatatggcagctgcatgcaaaacattgtatatgatgaataaggtgaaaataacccacttctaacattaaacagtgacgtttactagaatctttgatgtaggtaacagagaagtaaaaataatctgtagttgctttttaactttttccttcagactactgaggaaattatgttccacttaatatcaaaccagctttcttgatttattttctaagccaaggttaatgctcttatactaagggtcactaacagattccttaccatttacaccattagattgtatagcattaagataaatctacactagcgtgagaaacattactgttttgctccttatcattacttatatatgtatatatcaccttgtgccagaaaggatataaagtgttttataaggatacataaaacacaaattagcataaatttaaagttggttaaaaaaaaataaaggtaaagacaaagtaaggtcgctatacatcactgtggtggctgcaaatttggctcctttctttctagcaacctacctgaaataagaaaacttatcacttattgaatttacaattccaaaggtatttttctcattgcttaaggaatatatgatatccttggaattaagatgttttaatttctccaaacctcttttaaaaatatgtgacctaataaacaactattttcatgcttcatccactaaatatatgcattatcttcatagacatggtttttcttgttccaggaataaaagaaaaggtactgagttacatgtttgcattcttctagattcccactacttacacacacaccacccactaaaataacagattcttgtttgtttgataaattcccaggtcttcttccattgtgcaggctcaaagttccaggggagcccaaaactgaaacagctccctaaggctaggcagaactgtttaataaaactctgagccagtgaagaaagggaacaaatacaggaagctcgtatgactcagtttagagaaaaagctttctgagagcttagaaatagagcatggaatgagaggaagaaattaggcagctgctacatatagaagattgtaaaaatgagagaataaggaaaaaatatttaagaaagccttactgagtattatgcaattattcccctttgcctatttgataagaaaaagtggtaaagatttgaatttcttttcaattatttttgatgctactttgttgcttctttcaatgtgaatgccaccaaaaaggcctattttgataagaaaaagtggtaaagatttgaatttcttttcggttattttacatgctactttgttgcttctttcaatgtgaatgctaccaaaaaagggcctattttgataagaaaaagtagtaaagatttgaatttcttttcaattattttatatgctactttgttgcttctttcaatgtgaatgctaccaaaaaagggaaagagatggcttgctttatgcagcttatagtctaatgacctcagtatagaataatggcatcccagggcctcctgtggctccagccatctgcacacttgtggttgacaagggacttctccttctgtccagaattcacttatgcaagaatgggactttttaattttttcaaacctcagaagttttctttcagaaactagaaaaagcataataaggaaacttgaaccaaaaagaacacttctacctaatatagtttttgaggtgcccctaatctctattgagacccagaatctttcagtgatcacacattcatcaaagtaatggttttcagccttcttcacaaactctaatagaataaagtttgcaccactgttacctttgattgtacaaatatctatatgtgtatagttaaaaacactagtttaaaggaagaaggaatcatatataggagaattacccaactcttcacccttttttttctcttccccacttcattctcctaaaccaaggctgcatgtgaaacttgagcattctgagcgcaaagcaacagcaccatcagagcaagacagctgtgtccaggaactacattcctacagagggtttggcagccagtgtggtcccacagtgcctggtggggatataccctgaaggatctcaaaaaaaaaaaaaaaaacctggggagtgttggaggacagcagaagtttcacagtcatgcaagtggaagctaccagcctgtgcacgggagctttaatattaatgtgacctcctggtcacatacagtgcagtaaagggacatttaaataatatacaaaatggaaataccatcaccttatctgcttatgtctctacattgtttcgagcatctaaaaatgaaatgcataaaaaggcactcagaaactataatgtacaatataagtatatgccaatattctaacttccaaataaaacttactcataaattaggtatagggttagacctgattctgaattctttacattgccatgcaccatagggaatgtgcttctaaaaatatgcaataagttatttggacagtctgacgaaagcataaggagttcttactttttataattacacattgaatttcatctcatttatttacgttcggtcctgttttcaactacttggaattcttctgagcagaaatttttctttatacagacattacataactcacaggtctcaggctactcaccccctccatgtccatctccttctgcccctctaacataccacataccacccttcttaccctctcttcagatggtaaaatgggcgtttctcacattcttttacctaagatctgacttcaacacttgtttgaactgagttgaaagccttcattaaacatcagcagaaaaaaagactgacaatagatcctagggggaagtgaacaaaaaggaaagaaaaacaaagcactgaggaagatcatcttaaaggaaaaagatagaaaaagtcttatactttaatcccaatggcctttgtatatgttttaagaatagtgccagaacacgaaaaatgaggggtttcatttacttatgactgaaatactgagaatgataaaggtaggaaatagtgtctgtcacttaatgattacatgactgataattaccttaagaaagttggccatgcacattaacatgagttccacataatgttaataacaaagcaaaccacaagttcctttttggttaattcaagtctgatcaaaagcaagtgaaagcacatacaattctcacaaaagttaagtatttgttaagacctcattccaaaacctccgtcctaccttcctatccttctttaaatcatctgaagttctgatctgtaacaagaagcccgttagttgagggaggacccaagacggccgaataggaacggctctggtctacagctcccagcgtgagcgacgcagaagacgggtgatttctgcatttccaactgaggtaccaggttcatctcactagggagtgccagacagtgggcgcaggtcagtgggtgcgcgcaccgtgcaccagccgaagcagggtgaggcattgcctcactggggaagcgcaaggggtcagggagttccctttccgagtcaaagaaaggggtgacggacggcacctgaaaaatcgggtcactcccacccgaatactgcgcttttcctaggggcttaaaaaacggcgcaccacgagagtatatcccgcacctggctcggagggtcctacgccccacggagtctcgctgattgctagcacggcagtctgagatcaaactgcaaggcagcagcgaggctgggggaggggcgcccaccatagcccaggcttgattaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaaccagcagactgcctcctcaagtgggtccctgacccctgacctctgagcagcctaactgggaggcaccctccagcaggagcacactgacacctcacatggcagggtattccaacagacctgcagctgagggtcctgtctgttagaaggaaaacttacaaacagaaaggacacccacaccaaaaacccatctgtacatcaccatcatcaaagaccaaaagtagataaaaccacaaagatggggaaaaaacagaacagaaaaactggaaactctaaaaagcagagggcctctcctcctccaaaggaacacagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgacgtgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaaaccagaagagagtgagggccaatattcaacattcttaaagaaaagaattttcaacccagaatttcatatccagccaaactaagcttcataagtgaaggagaaataaaatactttatagacaagcaaatgctgagagattttgtcaccaccaggccggccttacaagagctcctgaaggaagcgctaaacatggaaaggaacaaccagtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaacagacaaagaaggccattacataatggtaaagggatcaattcaacaagaagagctaactatcctaaatatatatgcacccaatacaggagcacccagattcataaagcaagtcctgagtgacctacaaagagacttagactcccacacattaaaaatgggagactttaacaccccactgtcaacattagacagatcaatgagacaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataagaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacactcaaaagctagcagaaggcaagaaataactaaaatcagagcagaacggaaggaaataaagacataaaaaacccttcaaaaaattaatgaatccaggagctggttttttgaaaggatcaacaaaattgatagaccactagcatgactaataaagaaaaagagaagaatcaaatagatgcaataaaaaatgataagggggatatcaccaccgatcccacagaaatacaaactaccatcagagaatactacaaacacctctatgcaaataaactagaaaatctagaagaaatggataaattcctcgacacatacactctcccaagactaaaccaggaagaaactgaatctctgaatagaccaacaacaggatctgaaattgtggcaataatcaacagcttaccaaccaaaaagagtccaggaccagatgtattcacagccgaattctacaagaggtacaaggaggaactggtaccattcctactgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaaccagaagcattgcctttgaaaactggcacaagacagggatgccctctcttaccactcctattcaacatagtgttggaagttctggccagggcaattaggcaggagaaggaaataaagggtattcaattaggaaaagaggaagtcaaattgtccctgtttgcagacgacatgattgtatatctagaaaccccattgtctcagcccaaaatctccttaagctgataagcaacttcagcaaagtctcaggatacaaaatcaatgtacaaaaatcacaagcattcttatacaccaacaacagacaaacagagacccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccacgctcatgggtaggaaaatcaatatcgtgaaaatggccatactgcccaaggtaatttacagattcaatgccatccccatcaagctaccaatgcctttcttcacagaattggaaaaaactactttaaagttcatatggaaccaaaaaagagcccacatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctacccatttgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactcaagagcttctgcacagcaaaacaaactaccatcagagtgaacaggcaacctacaaaatgggagaaaattttcacaacctactcatctgacaaagggctaatatccagaatctacagtgaactcaaataaatttacaagaaaaaaacaaacaaccccatcaaaaagtgggcaaaggacaagaacagacacttctcaaaagaagacatttattcagccaacagacacgtgaaaaaatgctcatcatcactggccatcagagaaatgcaaatcaaaaccacaatgagataccatctcacaccagttagaatggcgatcattaaaaagtcaggaaacaacaggtgctggagaagatgtggagaaataggaacacttttacactgttggtgggactgtaaactacttcaaccattgtggaagtcagtgtggtgattcctcagggatctagaactacaaataccatttgacccagccatcccattactgggtatatacccaaaggactataaatcatgctgctataaagacgcatgcacacgtatgtttattgcggcactcttcacaagagcaaagacttggaaccaacccaaatgtccatcaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaagcaggagggatagcattgggagatatacctaatgctagatgatgagttagtgggtgcagcgcaccagcatggcacatgtatacatatgtaactagcctgcacaatgtacacatgtaccctaaaacttaaagtataataataaaaaaaaaataaataaaaataaaaataaaaagaatgtggccatgatgacagggaggaagatttacctcagacctgcagtatggacttctactcatcaatatttactggtcacagaaactgctgaattcaaaatctgccaacaataccatctgtgtgctacagaataccttattcaggatcatattattactcataccatcattgttgaccaaggaatttattttacagcaaataaaatgtggcaaagggcccttgctcatgaaattaactaatcttgccatgattttcttcatagcatggataatagtatggtggaatggctttttgaagactcatttatgatgtcagccatatggcaacacttttcagagctgaagtaatatccccagtatattctgcatggtcagcatacatgtgtggtgccatatcgcttacagtccaaatgtatgggtcaaggaatcaaaaggagggaaaaaaaattagaatgtactatcactatttcttcaggtgatatactagcaaacttttgccgctcattgccattattttaggccctgtgagtttagagatcttaatttcaaaggaagtaatgcttctatcaagtgataatgcaataatgattgcattgaactagacattgagacttgacccagccaaattagggccttcaattaacaggcaacaaatggggtttctgtactagttggagtgattcttctagctatcaaggtaaaattaggtttctactaaaaaataaaaagatatatatacctgaaatggaggagatcttccagagtgcttattagtattctcatttcttgtgattgaaatcagtggaaaactagcacagctcaattcaggatggactgataatcacccagatccttcagcaataatgatttaggtaacttcatcaggcaagaaattaaacaaactgaagttcttgctgggggcaaaggatataaaaatggtagtggaagaagctgtttaaacataccagctataacgatgagaccagttgcggatatatggactaacttaattatgagtatttcttatctttatataaatatgactcttttgtgtgtgtgatatcacatacacaatgtttactttattttctttcttccctcattccctaatcatgtaaaataagatgtgttaataatgcttaactttatatctcagtatttaaggtacaccgtatcaataatggagcatgaatagaagaatgaatatcaaaaaaaaaaaaagaagcccgttagttaaatcagtatgggaagtgggcaatgctgtaaaacagcagctgacatcagtattgtaaaatacataaaatctttcataaaatgaaagatagcacagacagctataagaggcatgtttgctttgaaataccccttaagaatcttagcactacacagtacctgccacagagttacctttttacaaagaaagagtaattctccaaaatcttacaacatttctgcacaatactggctaaggtcattctgatccagtatgacccagccagatattgcattataatacctgtattagaatgacaattctcacctccaggatgttagtaaaataccaatctgattactaattcaaacaaaaatacagggagggagcatcaaatatccataaaaattatttacagcaactgtagttattcaggtcatttttacagaaagcctatcccctgggccaatgtatttgtggcatttttttttattactacatagctcaaaagtgcctttcatgctcagcaggcacatcataggcaaagaactgacaaattgaaaagctatcataagaatataaatcaaaaattctataaaatttggcttatatgcccaaagatgtcaaaaacatgatatactacatcagttattcaccatcaacaaaaagaaacattgaaagcatctattttaatcctgatttttacacttgcagattttcccccaccaaatttatcttaaataattcttaagtacactttctcctcatatatattttattggctttcccttaaacatgaaaaattatagcagtttctctacacatctaatcaactcatttcagtaaaaaccataaccaattaaaatttattctcaaaaaaaggaatctaattcttaaccataggctaatgatgcttaaaagaattgctttgcagcttgaccagcagatgggacatcactttagactgcaacacaaggagaaattgatgagaaaaaactaagagactttctgttaggagaaaaactgtaagggacaccacaggaaggagccatttataatcattttctcctccacataatttaaagctgtgggccaggagccaaatgatggcaaggaacacacctcccaccaagcaagaattaagataaccagctctaatataagcaacacaaaactaattattctcataaattcccttcatagtgttaacacaaaacatcaacactatggtgctgacagcagcaggcagggaagtggtagaaaatttagatccagcactttcctttaaacttagattagtacatcatagcaatatctatattggaaaagtacaaacagaactaacagaagcataatggaacaaatttcagaatgtgaatagtaggaaacattttcagattataacaacatatattctaaatgatgacattacataacaacaatagttaagattttttaacatttccattaatcccactatccaatttaatcccccaacaacctatgtggatagaattatttccctactttacaaacaagaaagtagaggatttcagggtgacctcaaggcaataattagtttaatggcaaagccacaagtcttggtttccatttcagagctctttccaatatattaagctgcctatctatgtatattttttagtattattaacagtaaatattaaattaacatttaaaaacatcactttaaatgtatgtttgtaaaataaaagcagagtatatttttaaagaaagatcattgaaaattttaaatgacataaaaatttctttagatgattactgtaaccaaaaagaaataatcacaaaactatctgaaagcaaataacaacatcaacttgtaaacatcaattattcagaaaggaaacagaatatatcctaggaagacacaaagttgaaactcaatatgaatctagaaaaataggattatatgtttaaacttataatttatttgatgatgacactataaaaaagaacattcaaataaaatattaaataagatgcttctgacatttgactaaattcaatagatattatcattattaatatggtatcatcatcaaaattatcatattggtaaaattatcattccagctatgtaatttgatcatgttttattataagcatcaaaatcaatgtacagatgaccactgaataacatgggagttaggagtgtcaaaccccacacagattttcagctgcatataactttcaacttccccaaaatttaacaggaatgtctactgttgatcagaagccttaccaataacataaacaattaacaaacattttgtatgttataaagcaagctaaagaaaagaaaatgttgttaaaacaatcataaaaaagagaaaatatatttattatttgatatggtttggctctgtccccacccaaatctcatcttgaattgtagtttccataatccccatgtgtcatgggagggacacggtgggaggtaattgaatcgtgggggcagttaccccatgctgctgttattgtgatagtgagtgagttctcacaagagctgatggttttataaggggctttcccccgttttgattggacttctccttcctggcaccatatgtttgcttccccttcgccatgttgtaagtttcctgaggcctccccagccattctgaaccgtgagtcaattaaacctctttcctttataaattacccagtcttacatatgtctttattaccagcatgagaatggactaatacagtatattggtaccacagagagtggggtgctgctgtaaagacacccaaaaatatggaagcaactttggaactgggtcacaagcagaggttggaacagtttagagggctcagaagaaaacatgaaaatgtggggaagtttggaacatcctagagactaggagagctcagaagacaggaaggtgtgggaaagtttggaacttcctagagatttgttgaacagctttgaccaaaatgctgatagtgatatggacaataaagtccaggctgaggtgatctcagatggagaggaggaactttttgggaactggagcaaaggtgactcttgtcattctgtaacaaagaaactggcagcattttgcccctgccctagagacttgtggaactttgaacttgagagagataatttagggtatctggcagaataaatttctaagtgacaaagcattcaagaggaagcagagcataaaagttcggaaaatttgcagcctgaggatgcaatagaatagaaaagcccattttctggggagaaattcaagcctgctgcagaaacttgcataagtaacaaggccaaatgtaatcaccaagacaatggctaaaatgtctccaggccatgtcagagaccatcacagcagcccctcccattacaggcatagaggcctaggagaaaataatgatttcatgggcagagcccagggcccccctgctgtatgcagacttgggacttggtgccctgcatcccagctgctccagacatggctaaaaggggtcaaggtacagctcaggctatggcttcagagggtgcaagccccaagccttggcagcttccacatggtgttgagcctgtgggtgcacagaagtcaaaaactgaggtttaggaacctctgcctagatttcagaggatgtatggaaatgcttggatgtctaggcagaagtttgttgcagaggcagagccctcatggagaacctctgctaggaagtgtggaagggaaatgtggtgtgggagcccccacacagagtctccactggggcactgtcaaatggagttgtgagaagagggccactgtcctccagaccccagaatggtagatctgctaagagcttgtggctggaaaagcagcagacactcaatgccagccagtgaaagtagccaggagggttgctataccctgaaaagccacatgggcagagctgcccaaggccatgggagcccacctcttgtgtcagtgtaccctagatgtgagacatgaagtcaaagagcattttggaactttaaggtttaatgactgccctattggatcttggacttgcatggggcctgtagcccctttgttttgaccaattttgcccacttggaacaggtgtatttactcaacacctgtacccccattttacctaggaagtaactaacttgcttttgattttataggctcataggtggaagggacttgccttatctcagatgagactttggacttgtacttttgggttaatgctggaatgagttaagactttgggggactgttaggaaggcatgattgtgttttaaaatgtgatgacacaagatttgggaggagccaggggtggaatgatatggtttggctgtgtccctacccaaatcttatcttgaatttagttcccataatccccacgtgtcatgggagggtacctggtgggaggtaattgaatcatctgggtggttacctctacactgttgctttcatgatagtgagtgagttctcatgagatctgatggttttataaggggcttttcccccttttgcttggcactcctccttcctgtctccacgtgaagaaggacatgtttacttccccttctgccatgattgtaagtttcctgaggccttccagccatgttgaactgtgagtcaattaagcctctttccttcataaattacccagtctcagatatgtctttattagcagcatgagaacagaacgaatacactattcattaagtggaagtggattatcatgaaggccttcatccttgttgtcttcacactgagtaggatgaggaggaggagaaagagaaagggtgggtcttgctgtctcagtgggggcagaggcagaagagatggaggaggcagaaagggaggcaagagagacaggcaccctccatgtagcttttattttttaaaatctacatataaatgcacctgcacagttcaaatccttgttgttcaagggtcaactataaacgaatttgttagagtgacagacaagtaccacctttgctcaaattgtaaaaccaatattattaattttatagcattttatcagcattttttcattaaatgaatatacaattgtcacattaaatcccctagactctcatcaaaattgtaaatcatttcattagtaatcaaataaaatttgcagtttttggctaagtcattgacaacactccatgctctgtcccatcctaactctttcaacaccattttctaccatgtaatccaaatatactgggcattttatgctttctcacttttacaacatctcccaaggttttttccaggtagaacaccctccatttctccttgttaaaataatacctgatcttcaccacccaactcacatcctatgtccttagttcagacttccctgatcctgtcaactgttggagatcttttcctccattaaggtacttaccaaagtttgtcttatgtttctgataattttcataagtctcaaataactataagcattatggtaaccaagactgttttaaacttttgtatctcccaaaatacttcagtaccatagatcaagtacacattcatgaattctgcatctactacatagtcagaaaagtggaagaatttctatagttatattttaattacaatttttttttattatactttaagttttagggtacatgtgcacaacatgcaggtttgttacatatgtatacatgggccatgttggtgtgctgcacccattaactcatcatttagcattaggtatatctcctaatgctattccctcccacctccccccaccccacaacagtccccggtgtgtgatgttccccttcctatgtccatgtgttctcattgttcaatttaattacaatctttaaaatcacagaaactcttgaatacatataccaaaaccttcaagatgccaataagaattttactctgttgtgagtgcttgtcatttgtaactatattgttcccacatctaacaatctatcacccataaacatgtcaaagtactgtgacaaagtataacaaatgattctccaatattttgaatagatttacttttaaataaatgttacagatgtattatgaaataagaaataagcttacaaatacatttattttaacatcttgtgttgattatgagaacaataaaaatgagcaattcacgggaaaataatttcagatagattttgtctccctacaaatgggcatcctgatattcactctggaataaatactttaggaagaagatgatattgagatcatatccctttgtttggtaatcaaaggcttatttttcatgtggaaaattttaagtgctaataaataatccactgcaaaccacataatttttgaaaataacccccaaattatatacacaaacaagtaaattttagtgaatgtatgcaattgctattggcagttattagatcctaattacttttcaaaagtggaattaataatatgtaatttaatgtcttacaggatattataaagatgtaattttattggactttgcttctaatacactgaaccataaggctaaatttaaaaccacttagaaaagaatattagaattaaattacagagaaatttacaactaaattaagaaactctatcaattaaaaaactttgctgtcatcctcaaatgtgagtgcttatctaataatatgatcctggactaagtgttgtgtatacttcagatataaaattttcatataggctattcctaggcaaatacaaaaagtaaacaaaaacaaaacaaaaaatactgatgactagtgatcacattaaaataaatgacatcataaaagtgacccttttccccttccacctcccaccacattaggacagcaacagagcatcagcttggaagcaaaagcagccctcacaagatcacacctgtcagtgccttgatcttgaactcctgagcctccagaactatgagaaataaatttctgctctttaaaaaccacccagtttcagcatatactgaaaattcaaaacttgccatacttttaaaatatagattgggactagatacagtcagaaattgccactcccacagaaagagacccaatttaatatacaccaacataatttgaacaaatcttcagagagaaactaccaaacatggattgagaaaagatgcagtcccagagactgaagaagaaggaagttaggcacccaatgtggggtgcctgaatgctaaggctgatttccaaactggaaaggtacctggggaaggggattggtccagtaaggatatgggttatttccataccagacctctccctaagggagccccgtggccccaaagacctaataaaaacaacaacaaaatcgaaggtacagtgctagtgattggatgtggctcccccaagcagacctgatgagggggtcatctatttcccccttgcactgcagaacacagctgcaaatgttaacatagacaaaggaaccacaaggctgagtagaagcctatctactgcccattgctctcaaggaccatctactagattgtagcccaaactacaacaccaaaatcactttactaatcctgcccttgcaaaaccaagagtaagaattctgcaacgaagacaccatacagagccttagttctctaaaaactttcagaaacaaagccaacaaagtacactcaatttacaccacaattaaaagaataccatccctcccagatgagaaagaatcagcataagaactctggcaattcaaaaagccacactgcccccttacctccaaatgagcccactagctccccagaaatgtttcctaaccagtctgaattatctgaaatgacagacatagaattcaaaatatggatggcaaagaagctcattgagatcaagaagaaagttgaaactcaatccaaggaagccaagcaatccagtaaaatgattcaagggctgaaaggtgaaattctcacttaaagagagacaaaaacttaatttcttgagctgaaaaattcactacaaaaattacataatataattggaagtattaacagcagaatagaccaagctgaggaaagaatctgagagctcaaagagcaattctttcaattaacacagtcagacaaaaatacagaaaagagaattgagaaagatgaagagcagagagtgggccgagacctccaattagaagtagctatggtgcatggcactcataaagaggaagaaaagcagtgagtaaatacagcaccttcaactgaaatatccaggttttcgcactgggactgatcagggaaataaccaatccacagaaaacagagaaaagtagggcaggatgatagcccacctggaagtgacgcaaagccaagggaacccccaccccagccaaggaagtggtaagtgaatgtgccaccctgggaaaccacatttctcccatggatctttgcaaccctcagatcaggagatcccctcataaacccactccaccaggaccttgggtcagatacacagagctgtgtggagtctcagcagggcagccactcaggtatgcacagagacccaggagatttacataccccagccacaggatccctggcaaaggtgactacaactcagtcaaggcgggaggtccatacatacccctaggaagggggccgaatccagggagctgaacagcgtccatctgtgggccccatttccaaggcacctcacaaaataagacccactggcttggaacttcagccagccaccagcaacagggtagtgcctgcctgagatggaatggagctgccagggaaaggggtgggctgtcacctttgttatttggacaactcagctgttcaagtctgtgggctttggagagtccaaacagtctggacaagtaagggacccccagcacagcacagcacagctgctctatgaaaatgtggccagactacttctttaagtgggaccccaatccattccaccccactgggcaggacttcccaatagggacctccagccacccctgcccatattctaggaaagaactctgatctctcccttggctggagtgcccagtggggagggatgagctgccaatgttgctttgagcccattccagcctgtaggctttgcagaatccaagccaatacaggcagagatggatccccagcaacgcatggctgttttgtcaaggtgtggccagactgcttctttaaatagaaccccaatccattcctccttgctgggcaggtcctcccaaccagtgcttccaaccaccctcacccatgttctatggctgacaaagttctaatttctccctgtgatggagtgcccagggggccaggtgggctgccacctgtgctgtttgggcatctcacccagtccaacctgtgggccttggaaagtgcaaaactatatgggggtgaagggaagccaaacacagcacagctgctctacaaaaacgcaggaaggctgcttctttaaggaggtccctgatcccattcctcctgactaggtgagacctccaaaacagggtttccagccacatcctatgggtgcattcaggctggcaacaggtcagtacttctctgggacagagctctgagaggaaggggcaggctgccatctttgctgttttgcagccttcaccggtaatacctacaggtactgaaaaaactgaggtgactagggtctgaagcagccgcccagcaaatcatagcagccctacagaaaagtggtcagactgttcaaagaaaaaacgagcaaaacaacaagaacaacaacaacaaaaacccatccaaaggtcaacaacctcaaagatcaaaggtagataagccaacaaagatgagaaagaatcagcacaaaaacacagaaaactcaaaaatccagtgtgctccctttcctctaaatgaccacaacacctctccagcagggatttagaactggactgaggctgagatggctgagatgatagaaataggattccaaatgtggatctaaaaaatgaacttcactgagctaaaggagcactttgcaactcaatgcaaggaagctaagaatcatgataaaacaatgcaggagctgacagccaaaatagccagtatagagaggaatataaccaacctgatagagctgaaaaaaacacaacaagaacttcacgatgcaatcacaagtattaatagcagaataggccaagcagaagaaagaatctcagagcttgaagaatgtcattctgaaataacacaggcagacaaaaatagagaaaaacaatgaaaaggaataaacaaaacctccaagaaatatgggattatgtaaagagactgaatctatgactgattggggtacctgaaaaagatgaggagaatgggaccattttggataacataattcaggatatcatccaggagaacttccctgacctacctacagaagccaacattcaaattcagaaaatgcagagaaccccagtaagatacttactccacaagaagatcgtccccaaaacatgtaatcatcagatcctccaaggtcaaaatgaaataaaaaatgtcaaaggccactggaaagaaaggcgaggccacctacaaagggaagcccattggactaacagtggacctctcagcagaaaccatgcaagccagaagagattgggggacaatattcaacatttttaaagaaaagaaattccaatgcagaattacatatctagccaaactaagcttcataagagaagaaataagatccttttcagacaagcaaattctgagggaatttgttaccaccagacctgctttataaaagctcctgaaggaagcactaaatataaaaagggaaaactgttgccagcctctacaaaaatacactgaagtatacagaccagtgacattataaagcaactacataaacaagtctgcaaaataaccagctagcatcatgatcacaggatcaaatccatacataacagtattaaccttaaatgctccaattaaaagacacagagtaaaaagctggataaagaaccaagacccactggtaagctgtcttcaagagacccatctcacacgcaaaaacatacacaggctaaaaataaagggatggaggaaaatttaccaaccaaatagaaaacagaaaaaagcagggattgcaatcctagcatctaacaaaaaaagactttaaaccaaaaaatatcaaaaaagacaaagaagagtattacataatgataaagggttcaattcaacaagaatagctaactgtcctaaatatatgtgcacccaaaacaggaacacccagattcataaagcaagttcttagagaccttcaaagagacttagactcccacacaataatagtgggagactttaaaaccccattgacaatattttctaatatctctatcatcaagacagaaaattaacaaaaatattcaggacctgaactcaactctggatcaagtggaactgacagatatctatagaactctacaccccagaacaacagaatatacattcttctcattgccacacatcacttactctaaaattggtcacataatcagaagtaaaacactcctcagcaaatgtaaaagaactgaaatcataatgaacaatctctcagaccacagtgcaatcaaattagaaatcaagattaagaaatgcattcaaacccacataatatggtttggctgtgctcccaccaaaatctcctcttgaattgtacttcccaaaatctccacctctcatgggaggaacctggtgggaagtaatcagaacatgggggcagtttcctccatgctgttctcataatagtgagtgagttctcaggagagctgatggttttataagaatctgacatttcccctgctggtacttctctctcctgccaccttgtgaaaaagaacatgcttgcttccccttctgccatgactataagtttcctgaggcctccccagccatgtggaactgtgagtcaattaaacctcttttctctacaaattacccagcctggggtatttcatcatagcagcatgaaaacaaattaataccccacaaaattacatggaaattgaataacctgttcctgaacaactgttggataaataataaaattaaggcagaaatcttgaaattaatgagaacaaaaatacaacataccaaaatctctggaacccagttaatgcagtgttaagagggaaacttacagcactaaattcccacatcaaaatgttaaaaagatctgaaattaacaacctaacatcacaactaaaagaactaggaaaccaagagtgaacaaataacaaagctagctgaagacaataaataaccaaaagcagagctaaactaaaggagatagaaacatgaaaaacctttcaaaagatcaaaaatccagaagctaattttctgaaaaaaagttaataaaatagactgctaactagactaataaaaaagaaaagagagaaaattcaaataaacacaatcagaaatgacatggaggatattaccactgacccacagaaataaaaacgaccatgagagaatgttatgaacacctctatgcacacaaattgaaaatctagaagaaatggacaaatccctggacacatacaccctcccaagactgaaccagaaagaaactgagtccctgaacagatcaacaacaagctctgaaatcaaatcagtaatgaatagcctatcaaccaaaaaaagcccataaccagatggattcaccgcttaactctaccagaggtacaaagaagagctggtaccattcctattgaaactattccaaacaattgaaaagcagggactcccccataacccattctatgaggccagcatcatcctgatactaacacctggcagagatataacaaaaaagaaaacttcgggccaatatccttgataaacattgataccaaaaatcctcaacaaaatactggcaaactgaatctagcagcacatcaaaaagcttatctaccatgattaagtagtcttcatccctggaatgcaagtttcgttcaacacacacagatctataaatgtgatttatcacataaacagaactaaaaacaaaaaacacatgattatctcaacagatgcaggaaaggcctttggtaaaaattagcatcctttcatgtaaaaagctctcaataaactcggttttgaaggaacatacctctaaataataagagccatatatgagaaacccacagccaatatactgaatgggcaaaagctggaagcattccccttaaaaactggcacaagacaaggatgccctctcttaccactcctagtcaacatagtattggaagttctgaccagggaaatcaggcaagaaaaagaaataatgtgtattcaaataggaaaggaagaagtcaaactctcttcgtttgcaggtgacataattgcgtatctagaaaaccccactgactcaccccaaaagcttcttaaggtgataagcaacttcagcaaagtcttaggatacaaaaatcaatgtgcgaaaatcactaccattcctgtggaacaacagcaggcaagtagagagccaaatcataaatgaactcccattcacaattgccacaatgagaataaagtacctaggaatacagctaacagggaagtgaaggacctctttgagaagaactacaaaccactgctcaaagaaatcagagatgacacaaacaaatgggaaatcattcaacaacaggcaagtagagaaacaaatcataaatgaactcccattcacagttgccacaatgagaataaaatacctaggaatagagctaacacggaagtgaaggacctcttcaaggagaactacaaaccactgttcaaagaaatcagagatgacacaaacaaatggaaaatcattccatgctaatgaataggaagaatcaatgttttgaaaatggccatactgtccaaagtaatttatagattcaatgctattcccatcaagctaccattaacattctttacagaaatagaataaaatattttaaaatcaatacggaaccaaaatagaactcgtatagccaatcctaagcaaaaagaacaaagctagaggtaccacattccctgacttcaaactctactacagggctacagtaacccaaacagcacagtactggtacacgaacagacacatagaccaatggaacagaatacagaacccagaaataagactgcacacctacaaccatctgatattcaacaaacctgacaaaaatgaggaatggggaaaggattccctatttaataaatggttctgggagaactggctagccctatgtagaaaattaaaactggaccccttccttacactatatataaaaatcaactcaagatgaattaaagacttaaatgtaaaacccaaaattataaaaaccctagaagaaaacctaggcagtactattcaggacataggcacaggcaaagatttcatgatgaagatgccaaaaacaactgcaacaaaagcaaaaattgacaaatgagatctaattaaactaaagagcttctgcacagcaaaagaaactatcatcaagtgaacagataacctacagagtgggagaaaatttttggaaactatgtatctgacaaaggtctaatatccagcatttaaaaggaacttaaatttacaaaaaaaaaaaaaaaaaagccattataaagtaggcaaaggactgaacagacacttctcaaaagaagacatacatgcatgtggccaacaaacatgtgaaaaaaagctcaacatcactgatcagtagagaaatgcaaatcaaaaccacaatgaaataccatctcatgccaatcataatggcaactattaaaaagtccagaaacaacagatgctggcaaggttgcagagaaataggaacacttttacactgttggtgggagtgtaagttagtttaaccattgtggaagacagtgtggtgattcctcagagatctagaggcagaactaccatttgacccagcaatcccattactggttatatacccaaaggattataaatcatgctactataaagacgcatgcacacgtatgtttattgcggcactattcataatagcaaagacatggaattaacccaaatgcccatcaatgatagactggataaagaaaatatagtacacatacactatggaatactatgcagccataaaaaggaacaagatcgtgtcctttgcaggaacatggatggagttggaagctgttatcctcagcaaactaatgcaggaacagaaaacgaaacaccatatgctctcacttataagtgggaggtgaatgatgagaacacatgaacacattgaggggaataacacacactggaggctgttaggggtggaggtggggtagggggagggaaagcatcaggaagaatagctaagggattctgggcttaatacctaagtgttgggttgattgtgcagcaaactatcaaggcaaatgtttacctatgtaacaaacctgcaaatcttgcacatgtactctggaacttaaaataaaagttgaaggacaaatattttttaaaaagaaatgcaaatcaaagccacaatgagataccatctcacaccagtcagaatggctactgttaaaaagtcaaaaaataacagatgctggagaggtcgtggagaaagaggaacacttacacactgttggtgaagagtggaaattagttcaaccattgtggaagacagtgtggcaattcctcaaagacctaaagacaaaaataccactggacccagcaatcccattactgagtatatacccaaaggaatacaaatcattctgtaataagactcatgcacacatatgtttactgcagcactattcacaatagaaaagatatagaatcaacataaatgcccatcaaagatagactggattaaaaaatgtggctcatatacacaatggaatactatgcagccataaaaaggaatgagatcatgtcacttgcagggacatggatagagttggaggccattatccttagcaaaccaacacaggaactgaaaaccaaacaccaagttttcacttacaagtgggagctaaatgataataacacatagacacatggggggaacaacacacactgggtcctgtcaaagggcaaggggtgagaggagggagaggatgaggaagaatagctagtggatgctgggcttaatacctgggtggtggaatgatctgtggagcaaaccaccatggcacacatttacctatgtaataaatctgcacaacctgtacatgtacccctgaacttaaaataaaagttggaaatataaaaaatagtgttggcaagagtacagagaaaagggaactcttccacactattggtcagaatgtaaattagtacagccttatggatgatgcttccccccacccaaaaaaaaaaaaaaacccacagaaataaagctaccatatgatccagcaatcccaatatgtaataaagtatgtcccactactaggtatatacccaaagtaaatgaatcagtatttcaaagagatttctgctcccctatgttcactgcagccaagacacaaaatcaacctaagtgtccatccacagatgagtagataaagaaaatgtgttatatatacacagggggaacctgttcagccttaaaaacaaaggaaagcttttgatttgccacaacattgatgagtctggagaacattatgttacataaaattagccaagcacagaaagacaaatactgcatgatcaaacttgtgtgtggaatccagaaaagtcaaactcatagaagcagagtaaaaatagtggttaacagaggctgggagtgaggagatgggttacccagaaaaatgctggtgaaaggatacaaaatttcagttagacatgaagaataagttcgagaaatgtacaacatgaggaccacagttaatggcaatgagttgtgtaccttaaatttccaaagacagcagattttaagtgttctcattacaaaaaaatgaaaagtatatgaggtcatgtgtatgctaattagcttgatataatcattccacaatgtctacatatttcaaaacatcatgttgtatgccataaatatatacaatttttgtcaagtaaaaatttttaaaggccgaatttactcaaaggttaatttaatatgaccaaaactgagtggttcaagggatttgcttataggcatttctaggtcattgactcaattcctttttatggtcatagttttcagtaacttggctctgtgtagcagcccattccaaatgaggatctgtaccctgttatatttctgttttgtccacaactgagaagaatattcattggattgtgtatctgagttaggggaaagtctagtgcttctagaaaactccatgacaactgtagatcaatgcacagttttctgccttgaaacttgaaatttcaattgtaagacaatattaaatagaataaaaaatgatactctggcaaatataacagagttttccttttttgtgggagtgtcagattttgagttttacaggagaactaggccttctaattctgatttgactttccaactaacatcaaacttagagctccatatctgagggataactggactggtgattgtgcaaaatatttctgtcttgcatttaaagttgtaacgaattgatagaaatcaatcttaccagcactggctgtcatttaattcttattcttaactttggtgataaaaaaaaataaatctgttgaatctgtgcaaagaagcctttctgagaccaaaatggcagctaaaattatttctgtaattaatttctgccttgtgtgtcaatgttctttagaatataaatgattttgtaaatacttggcagcaatttgtttaatttggaagggcacaaagtacactccattgagttggcaaatgcaacatccttctaaatatttttcctaaaacatcaagtatattatatgtatttaaatttatattacaacacttttctgagaaagtgtaatttttaattatgacctaagtctgactacatgcatgtctttgccttcttgtttcatgcattcattagcaatttgaatagaattttaataaaattcaacaaaaagaaaaatgaacaaaacatctgagaaatatgggattatgaccaaatatatgattcatcagcattcctaagaaataaggagagagaataagcaacttgtaaaatacatttgaggacacaggcatgaaaacttctctagtgtcactacagacattgacatgcaaatccaagaaatacagagaatttcagccagatactatacaagatgaccctacccgaggcacatagtcatcagaatcaccaagatcaatgcaaaagaagaaatctaaaaggcagctagagagaaagtgcaggtcacctacagagggaatcccaccaggctagaagcagatttctcagaaaaaaccttacaagccagaagagattaggggcctattttcagtgtccttaaagaaaggaaattccaaccaaaaatttttatatcctaccaaactaagcttcataactgaaggagaaataagaggcttctctgacaagcaaatgctgagggaatacgtttaaactagagtagccttacaagaggtccttaagggagttctaaacatgaattcaaaagaatgacacctgccaccacaaatgcacacttaagcacatagctcacaggcactataaagcaactacacaagaaccagctaacaatacaatgatagaatcaaaatcacatatatcaataataaccttgaatgtaaatgggctaaacagcccactcaaaagacacagagtggcaggctggataaaaagacaagacccaaccaatctgttgttttcaagagacccatcttacatgtaatgacacccacaaactcaacgtaaaagtatgcggtaagatctaccatgcaaacagaaaacaaaaaagagcaggtgtcaccattcctcatcattcattcattcttcatcattcaattttcattcttcatctttcatcattcattcttcatgtttcatcattcattcttcattcattcatcattcattcattcatcagataaaacagattttaaacacataaaaatgaaggacaatgaagggcactgcataacaataaaggatacagtccgacaagaagccttaactatactaaatatatacacacccaactttggagcactgagatttatacaacaacttcttcttggcctaggaaaacacttaaacaaccacacaataatagtgggagacttcaacaccctactgacaacattagatcatcaaagcacaaaactaacaaagaaactctggacttcaactcaacacttgaccaaatgggcctataaagcactccatccaacaaccacagaatatgcattcttctcatctgcacacagaacatattcaaagatcaaccacatgctcagtcataaagcaggcctcaataaattcagaaagaaattgaaactataccaagtatactctcaaaccacagtgtaataaaactagacatcaataccaaaatgatctctcaaaattacacaaataaatggaaagtaagcaacttattcctgaataactcctgggtgaacatagaaattaaggcagaaatttaaaaaattatttgaagttaatgaaaataggaacacaacttaccaaaatctctgagatatagccaaagcagtgttaagaggaaaattaatagtcctaaatgccttcatcaagaagttagaaaggtctcaaattaacaaactaactttgcacctacaggaacaagaaagaaagagaacaaaccaactccaaagctagcaaaagaaaagaaataactaaaattaaagaagatcttaatgaaattgagatgcaataaaccatacaaaagaccaatgaaaccaagaattggttctttgaaaaactaagactggtagaatccctaactaaatcaacaaagaaaaagaaagagactatccaaataagcaaaatcagaaacaacactaatgatattacaactgatcccacagaaatacaaaagaacctcagagactactatgaacaactctaggcacacaaattagaaaatctaaaggaaatggataaattcctggaagcatacaatctccaaagatggaatcatgaagaaattgaaactctgaatagaccaattttaacttctgaaattgaatcaataataaagaacctaccaagcaaaaaaagccctggaccaagtgaattcacaccccaattctaccagacatacaaacaagaactgatactaatcctactgaagctattccaaaaaactgaggagcaggggctcctccctaacttattctataagacaagcatcagcctgataccaaaatcaggcagagatacaacaacaacaacaaacttcagactaatatccctcataaacacagatgcaaaaatcctcaacaaatattagcaaattgaatctagcagcacatcaaaaagttaatacaccacaatcaagtaggctttattcttgggattcaatactgaaatcacatttgttgtgatttgtgatttgctgtgttgcaagattgcaaatacttgcatatgttgcaaatcatatttgcgtttgttgcacatgttgcaaatcaacaaacatgattcaccacacaaacagaatcaagagcaaaaactataggatcatctcaatagatgcagagaaaccttttgataaaattcaacattccttcattataaaaatcctcaataaacaaaggaacatacctcaaaataataaaagccatccaggcaaacccacagccaacatcagactgaatgggcaaatgatggaaatatttcccttgagaactagaacaagacaaggctgcctactctcaccacttctcttcaacatagtactggaagtccttgccagatcaaccaggcaagagaaagaaataaaaggaatttgaaaaagaaaagaagaagtcaaactcttttcactgacgatatgattttgtacctagaaaaccctaaagactgctaaaaggttccaagaattaataagcaactttagcaaagtttcaggataaaatcaatgtacaaaaatcagtatcatttctatacaccagcaacatccaggctgagagtaaaatctagaacacaattccacttacaatagccacaaataaaatgaagtatctaggaatacagctaaccaggaggtgaaagatctctataaggagaacaacaaaacattggtgaaagaaatcagtgataatgcaaataaatggacaaacattccatactcatgaattgaaagaatcaatattgttaaaatgaccatactgcctaaagcaatttacagttactgctattcctgtcaaactactaatgtcactgtttacagaattagaaaacactattttaaaattcatatagaacgacaaaagagtgtgaatagccaaaacaatactaagcaaaaggaaaaaagacagagacattacactacccaacatgaaactgtactacaaggatatggtaatcaaaacagcatggtattggtacaaaaatagaaacatagaccaattgaacaggttagagaacccagaaataaagccacacacctacaactatctgatatttaacaaggctgacaaaaataagcaatggggaaaggactccctattcaataaatggtgctgggataactggctagccatatgcagaagactgaagctgggcccatactttttaccatatacaagaatgaactcaaaatggattaaacatttaaatgtaaatcctcaaactataaaaatcctagaagaaaacccaggaaatagtcttctcaacattggccttggcaaagaatttatggctaagtccccaaatgcaactgcaataaaaacaaaaatatagtgagaactaattaaactaaagagcttctgcatggcaaaaaaaactatgaacagagcaaagagacaacctatagaatgatacaagatatttgcaaacaaggcatccaacaaagcctaatatccagaatctatggtaaaaaataaataacaagcagaaaataaccccattaaaaagtggacaaatgaccaggcgtggtggctcacgcctgtaatcccagcacctttgggaggccgaggagggtggttcacgaggtcaggagatcgagaccatcctggctaacacagtgaaaccctgtctctactaaaaatacaaaaaattagccgggcgtggtggcgggcgcctgtagtcccagctacttgggagactgaggcaggagaatggcgtgaacccggggggcggagcttgcagtgagccgagatcgcgccactgcactccagcctgggcgacagagagagactctgtctcaaaaaaaaaaaaaaaaaaaaaaaacaagtggacaaaggacatgaacagacacttctcaaaagaagataagtggccagtaaacatatgaaaaaatactccacatcactatcagagaaatgcaagtcaaaaccacaatgaaattctacctcacaccagtcaggatggctattattaaagagccaaaaaaacaacagatgcagaggctgcagagaaaaggaaatgcttatactctgctggtgggaatgtaattagtacggccactgtggaaagcagtcgggagatttctcaaataatttaaaacatagctaccattagacccagcaatcccactactgggtatatatgcaaaagaaaataaatcattctaccaaaaagacacatgtacttgtacattcatcactgtgctagtcacaatagcaaagacatagaatcaacccaggtgcccatcaatggtagattggataaagaaaaaatagtacatatacaccatggaatactgtgtagccataaaaaaaaatgaaaatgtgacttttgcagcaacatggatggagcccttggaggtcataatcctaagcaaattaatggaggaacatataaccaaataccacgtttgcacttataagtgggagctaagccttgtgcacacatggacatcagtatgggaaaaatagacattgtggactccaagagggtggaaggcaggggatattgggttaaaaatctacctaccaggtactaggctcactacaacagtggacgggatctataccccaaacctcggcatcatgcaatattcccatgtaacaaatctgcacatgtaccccctgtatctacaagttgaaattaaataataacaataataaaaagtaaaagtgcctggggtgggggaaggtattatcaaggtgtaagttttcagagtggatctaccctaaaagtccttatagaaagccggtttattttattcaataaaacaaaagaaaggaaataactctaagacaaaagatagggttgtcacatgttgtaaatataatcttcattcatatacaaatccaattaaatttaaatccaatttaaattggtttaaatccaatttaaattggattaaatccagtttggattgggttaaatccaatttcgaacccatccactgtataaatatgaggaaaatatgttaaattttttatatttatatctctccatttaaattcttacatattgtgaataaaatcaaattttattgacatattggcgaagcataattcaatattaaagcatatgtccacacaaaacttttacacaatgttcatagcaacatttttcataagagcccaaaagtggaaacaacccaaatgtccatcaactggtaaatggataagcagcatggagcagaatatccatacaaagaagtattacttggcaataagaaagaatgaagtactgatacatgctacaacatggataaaccttagaagaattatgccctcacattctccaccatagtgcaacctttgttcatcaaagaaaaatgaaataacgtcttttattcctttattattttggaaagcaagagaaagttattaacagtaacatgacaataaatatcatatggaaaagtttcaaactgaccaattcaccttgcacattgttcattcaaatgtaaattagtgcaactattataagaaatagtatgaagttttctcaaaatcgtaaaaatagaactacaatatgatccagaaatcccatttctgggtacatataactttttgtcaaagagatctgcattctgatgtttattgtggccttattcacaacagccaagataagaaatcaacctgtatctatcaacacataaataaatggataaagaaacaggggtatacacacacaattgaatactatttcactgtaaaaaaaaaaaaagacaatattgtcatttgcaacaacatgggtgaacttcaagcatattatgttaagtgatatgtcaggcacagtaagagaaataccacatgatctgacatatgtagaatctaaaaaaagttgaactcacacaagtagagagtagaatgctagttaccagggtcaggggcattattggttaaagaatagaaaatttcaattagatggaaggaataagttcaagaaatctattgtaaaacatgtagtagaaaatccgtgcaaggaagtattacaacagaataacaacgtattgtatttttggaagttgttaagagaataaatcgtaagtgttctcaccacaaaaaaaatgataaatatatgaggtaatgaatatattgattagctcaattgaactatttcacaatgtgtacatattttaaaatatcattcacatgataaatatacataatgtttatttgtcaattaaaataaattttgtttacaaaagaaaaaacagtatgcatatttatatttttcaggattcttgttacattgactttgtttccaatagtaattgtgaggttcttcatgaactgtgcccatgggctccagtgattggtaaattattccacctctaccatggtgactgaattaaacaagatcctcaggtggttcatgtgtacattaaaatctgagaaacacttaaaaaacaaaaaatggaacaatgaagacatttaataaaataaatcttaaacaaattatataattagataggacaatacaataacatgcattatccttgtcttaaaaccaaaaggatattttttcttccaattttcttatttttaaatttatttttaatttcaacttttattttagatacagggggttcatgtgcagatttgttatgtgggaatattgcatgatgttgaggtttggagcatggacctcgtcaccctggtagtgagcatagtgcctgataggtagctttttaacccacccagcccacttcaccctctagtaatctatacagtgttgattgtttttttccaattttctacatatgcctctagagtaattctgtcatcaattacaaataaattaaagcgctttctcatatctctgaaggatgtaaatgaatattagcaaaacagttggtcttcagaaatttagaaactaatgtaatttgaatctttcccttgccagggaacatacatgccaatctagatactcaagagctatgattaaaatttattcttttgtaaaaacaccagtacagtagctatattcacataatcccttttcttaaattagtcacatatctgatgcactagtgttcttccagagttaaacaggatttttttttttttgacagtctcgctctgtcgcccaggctggagtgcagtggcacgatcttggctcactgcaacctccacctcccaagttcaagggattctcccacttcagccacctgagtagctgggactataggtgcccaccaccatgcccagctaatttttgtatttttaatagagacggggtttcaccatattggcaggctggtctcgaactcctgactttgtgatccgcctgcctcagcctcccaaagtgctaaacaggacattttaaaagccaacatcagctaataagctaacagcattttatttttactaatgaaaaaaacatttaaatctatctgtgtagttttttatttcaatcctctaaaacaaaatcaagaactaacaaatggttaagtgaattatgcatgatagtatgattttttattataattaaaatgctctttttcaatatttctaaattataaataattttaacatatagtacaaaaactttgcagcaataagtcagcataactggtaactgaataaagacaatttattatgatcctggactcacaagacagattctctgggttcaaatcccagctctgccttttccagctgcatgacattggagagtactttaacctctctgaaccacatctgaaactaggaagaatattagtacctacatcagagggattttaggagggttcaatgggctaatacatgtaacacacttacggtgtttcctggcacataatcagtactacatgagttagctcacattattatatttattttatttattttctcagagcacagagtattatctttattttccttattactattatcctttcttattttattgttattatcttcagttatatttcatgagcaaagtagtattatctttatttattttcttagagcacaaagtattgttatacgatattaaaccaaattgtaaaatagttgtttcttattattgatattaatacgtataaagttcaggggttaatgagtctcagttgaagtaaagagtgtcttttatcaaacttaatagttttgttgttgttgttctaaagaaaataattcaaatttacttataataaaataatgagtatgccacagacacaaggtacatgttaaaggcctcttctttataatgaaataacatcaccttcatcttatcattttagaacatcatcagacatctccacttcactaaagtctagggaacaggaaaggaagaagttgaattctcctcatttatctgaatcaaaagacatcaataaaatctatggagcatgcctcctagattgacaaagacatggtctttcactaaaaccaaagtgaaagaactaaagaatttgaaatatgtctgctactttgcaggttgcaggatgtgagaaatgtctgtataaaatagaaaatatccatcatggattcagctgtggagattttccttatgattataattccatggataactcacaaagttaatttcttactacaacccagtatttcagggtgtttttgttgttattttttgtttttgttttgtagaccaaactgcatctgctctaacatcctcatagattgtatgtacaagtaaacatgtctcaggtagaataacacatcagcttcagaagactacccacaagggcacctttcccattgtcacatggggaccatgaacacctctctacacatcatgggctttgggtttttaggtacattaagcactcaatttacacaacccttctttgggtttcttgaacaataaatctgaataatgatttcttcttagatttcttacaaattttaataaattatgttttttcatcacgaaatgaaagaagctaatcagattaataagacttttctgatacagatattttcttctactctttctgaattctccagaatgactgataaggtattctgcatgttatataaacttaaaaaaaatactgatataaacaaacaaatggactagtattggtggcattagaataaactcattgttttgaaaatatatacatagaaatatagatgtatgtatatgtatgtgtgtataatatcactaatattgggacaaccaacatcatgctcacactgaggacacaatatcgctttgtgctattgttatcaaaaatgcatagtctgaatttaatcatgaaaacatcagacaaactaaaaacacaaacacaagacaaactgagaaaatcttccacattaaatgaaactaagggaaaaaaattcagtacaatgcatgaccctggaatggatcctggactgtgaaaaataaatagacataatctggggacaactgacaaaatttgaatatgtgtggactctaaactagataatattatatcaatgttaaatttcctgattttgataactgtattgagattattcaacacagtgtccttgttcttagaaaatatacaataacgtatgtaagggtaaaggggcagggtgtctccaacttactctcaaaaagtccagaaggaagagagagagaatgagaaaggaaatgatatacattgtaaacaattaatgaatctgagtaaaatgtgtatgggtaaacaagagcttcttgtactatttctccaacttttttgtaattttaagttaaactgaaatgaagttaccccagatatagcttagatttgtctccccactcaaatctcatgtcaaattagaggaggggcctggtgggaggtgattggatcatgggggtggatttcccccttgctgttctcatgatagtgagtgagttctcactagaactgatggctaaacatgtgggcacattctcattcactctctctttctcctgctccaccatggtaagatgtgcttgcttcctcttcaccttttgccattactgtacgtttcctgaggcctcccagccatgcttcctgtacagcctgtggaactgtgagtccattcaacctcttttcttcataagttacccagtctcaggtagttctttctaggagtgtgagaacaaactaatacactcccccaaaatattaatctgtcaaaaggaatagaggaatgttctttctaaaaggcctagtaattaaacaaacaagaaaaggttgatcttttaaatagaggtgatttccaatatactcttagattttatgctctttggtaaatttattatgcaaagtgatatgaaagcctagatttatttgaatatattaaggaattttctttaaataagccacccaaacaattaggctttgcatatatttgtggtagacatccgttgttttacctgctagcatctcttagtccttcttcaggaaacagcacctctctcctccctccccaacccccagttagcactctgccctttcatcacttcatatgactataaatgctgtcaatattttcactttatctttctctcctaggagtagcacacaacctcaattgaccaaccagaacatcttgtcccaagattttacatgacccaggcagagccaataagaatgtttagagatattgacatagaagaaagagggtaattatcagctaataaaaagaaccatggaagcctaaggtttcaaggaactcgctttgctacctcatagagaagtcagcctgagaacagagccaactcagaggaaaacaacagctactttgggttgttttccgaagacaaagatttatctaattcaaaaagatagacactaaacacttttcagttttaaatcaaattcaaaatgagaactagaatattcattttattttcttattgcaaccttctccccaccaaacataccacaaaaagaaatgaatcaacaacacaatagtaatacatgagacaaagttaacattattgatgattgataatggagtgtattattctctcagattcatagaacagggccccacctatacaggcagtgccaagaaaaggacttggcacatagtgtgctcaatcaatgtttgctgaataaatgaaggtcggggactcttcaatctttacaagttactattgttatcaaaaacgaaagtgcctcaaaataataactgatagagaatgagcatatcatcttcccttagaaatatattctaaatttcaaacatagctctttctggatcttcttattatgaaagcataaatgctgttctagtcaggaaaaagaatcaataaatactcaaaaaattaccaggacctacaaaatgtgggtcaaatgtcaattaacacagtcagccctaatgagctgttctgttaccatctctcaccttcacccattatctgtaggtgtgcgactgatgaggatgtttaaatgaacagataaaggggtccctgcttctatacatttcatattactgttgacatttatcaccaagctttcaaccccaactgtctttgacaatagattttaaaagataataaaattcttcaacaggctttcaattcaatcctcttgtcattgtaacaaaacagcactaaaaatgaaacgaaagccagatatgacagaaactgctgaggagctaaggatgtatgatcattctttttaatgttgatatttacatatgagtttttgcttttcctaccaaaccataaataaaaatttcaatagaaaataaataagttaattcattcttcttatcaatatggtttctatagcatttcatttattaatacctttaaagataactgaaggattctgattatataacatttgctaaggcttcaaggtaccctagataaattttccaaaaactttcttttttatattttgaggcaaacaatttctaactactatttctttccaaaacagaaaaaatagaatcatcattatactcaataattttcttcctagcacttaactctctaaacaattatttctatatttatttgtctaattatgctcatcgactaaattgtaagttccatgaacagagattgtgtttgatgatgttgtcaatctttgttacccaagcatcaaacctggtccatagttggtgctcaatcaatgtttgttaaatgaatacataggtctgctaactttcccacttcttttgaaaatactcaaaaaacatttaatttaatccaaattcattcagtccctaatactatttttaaaaagcgtgtattagaaatgttttcggaattaactgggggcttagacatcagtgtgtcactcaaagcacttagtataatgcttcaaaagtactccctaaatgttaaattgaaataaattacatgtaataaaagttactttgcttctacctgtgaaatataagaaaaatttaacaacatagcaaaactaaaagatgtcttaattaacttatttttgctcattttgtggtgtctttcattcattcaatatttattgaaggcttatactcagccatgtaggtgctagacatacccaaatggatgagatatagtttagtgaaggagacaggtgaacaaacaacaatggtataatatgaaacctctgtaatagaagtatacacaaaagagctgctggagcacaatgcagcagagaggcactctcaatgacaggaaggaagaaagtttcaaaaagagatgggtgatcaggcagaaaataggaaattattaattccatacaaagaatatagtacattcttggttctgcagaactggaatgctttttctcttcatctgttttttgaagaggaaaaaaaaaccgtgcagaagcagggtatagccactaggaatttacttttcctttatttgctatcaaatatggtggcaagcaatatccatatattagctgctttgcctcagcccgccatctgaaggtagggttcttcaagtgcccaaatggtgcaaaatctcgaagctgatatcactcactccataatgagatgaatcacagaggggtcttttgctactcacagctgggccactgtggccatgcatcaccactcatagagaagggggatggagagaggtgttatgaccgtttttgttgctttttgtggagtgaaaattatcagcctatggtgttttccaaccacaacattcttacctcatatactcctccatgctgcagagagacatcctgtttctgggaagggccttgaagactagagaccttggcttatttgagaactagggtcaccctctgtttattgcatagccctatggggtgtcacaggtcctaaggaagagactttccttaaaggtcataaagcataaaacacacacgagtgttccagcgcatgaaatgttcagagatcagcaagaattcccaaatgggtagaaaaaacatagaacaaatgagtagaagaagcagaaaatgaccttgaactaacatatgaagagatttatattctaggataatgaaattattatgactttatcctcctagcaatgtggaaccaacaacacttttgaagcaaagaaatggagcaaacaaatatgtctggctgataactatggtggtagcaagaaagatggattgaaagagaacctaaaagcaaaggggaaaactatttctgatttccaagtgcaacttattaacagttcctcatgaactgtagataggaaatacacaaaattaaagcaaatgatgctgtttgtaataatagtaagttgtaatagaagaaagagtagaaagttggtaaaggatgagttcatgtcctttgcagggacatggatgaagctggaaatcatcattctgagcaaactatcacaaggacagaaaaccaaacaccgcatgttctcactcacagatgggaattgaacaatgagaacacttggacacagagcagggaatatcacacaccggggcctgtcgggaggtgggagcctgggggagggatagcattaggagaaatacctaatgtaaatgacgagttgatgggtgcagcaaaccaacatggcacatgtatacctatgtaacaaacctgcatgttgtgcacatgtaccctagaacttaaagtataattaaaaaaaaaaaagaaagttgttaagtagtagcaacttgcaaggaaatcttgaaataaagatgcaatttaaatagctaactacttagtgcatttatgatacatgctgaaaattttcaatgtacaggaagaaacagtattttttccagattcagtcatcaagagacagttaacttaattttgaagatgagttttcatttcttattatttaacttagtgcgtggtaattaatttttaatttataaatgaacagaaaccagatggtttcacttgatggctttaacaaaattactgtatgtcattaatgattctatctgattctttatgggtaccaggcatcttttgggggatgtttaaaagatctaccaattttgcttctataaaaggctaaataaaggaggggtgactgggcacacagtatggctagtttctccaacagtcctcactcccaagagtgaggagatctgcttcatatacaactgtcctagaaaatccactctgagtcaaagccccaaataagttcctatattcctggagaatcttcctggagggagatatgccaggggaagggagtactaaaaagtgtaatgttgtgattagatatgtcatattgtttgatatcattaaatagcaattagatattcttgccttaaacaaaattatgtcatgttttggccccttctctttgtaaaaattcaaaaaactcatattactgccgagaaagctcactgccttctcgagattatttttcctctcaacttaaactgtggatgtagatacttttctcatacgtattatgtgtatatgaatatatataattcttatataaagtaaactaagatccaaaatatttaactctgttaagtgcaaagtctcatttttataaatcaataaaatgaccagggcaaaaaactagacagtgagctgggggtctgaggattcagatccattcccagctgagctttgacaccacctgttgaaggctgtcctcaccagagttcagtatgcatggggatgattctgggcccagaagatgggtggacttgcagaaaataatgatgcttacagaagacctcccagttggttagctctagttctgttagttcaatagagggagacagcttagtgaacagtgaggtctcaaggtccacctttcatctccctgcttctagagaaaaaattttcccatgaaaagtcttcttccccctcaggtctcccatagaaattcagtccactcttttgagaacaagggttaagaggaaaataggacccaattttaaattatattatatccaagtaagaattcaaaacaattaacataaacattcatgaacagccttcatatggatataagatattgaatatcccttgacttgacagtacatatgtagtagttcagaaataacaattggcatcctaggtaagtatgatgaattaaatgctcttatcaaattccatagtttacctttataattttggagtaattttagtatttacaacatttttctactataataatatacaataaaaggaaattatttatatatcattaatgagttgaagacacgtaaatgaacaaatcattttaaaatgggccttagtaatagaattagagagatgtaaattaattaagaaaatactttaataggtttttccaggaacacaactagaataattgtagttgtaaagggaaatattagcattataacatagcttaataaatggacaaatacctggggagatgagttaattactaaagtagtttcattccaaacataagtgactgtgatggttaacactgagtgtcaacttcattggattgagggatacagattattaatcctggatttgtctgtgtgggtgttgccaaaagagattaacatttgagtcactgggctggggaaggcagatccacctttaatctggtgggcacaatctaatcagcttccaatgaatataaagcaggcagaaaaatgtgaaaaggggagagatggggctagcctaccagcctacatatttctcccttgctggatgcttcctgcccttgaacatcggactccaagttcttcagtattagaactcagactggctctccttgctcctcagcttgcagacaggaccttgtgatcatgtaagttaatacttaataaatgcccatttatatatatcctattagttctgtccctctaagagaaccctaatacactaatacagtgacactttctttactcctgcaaacctcaaataatatacttcttccagaacttgattatgatgtttgtttttatccttacttggatatggcaatcacacattaactctacgaattagtttttgatttgtgtttgtctagtattaagttacttactagaactttggcccctccttacaaataaaagccctaaaattatcaaaatcaacccttcaaacttttctcaaatgctttcattaaaatagattaagaataaaatgatttagtttgcatccatatttctcccatattcttatatattttacatcttttttataaaaggcaaagagcctgaatagaaataacaaattacaatttgactataatagtggtggtgcaatgctatcaatgaataagtgtataaagacccagagttctgttttcttaataattttgaggacaattagaagagattaatgattccccaaagcaagaaatacaggcatttatttgtgttgtatatagttagctaaatagaactcattattagctagtagaactcagcaacattccaaaatagtctgatcattatttatttccatttgtatttgctagaaacagagaaacaaaaggcaacatcaagaaaaagtataaaaacatccaaatcccttatttttgcctgatcaattgtgtaggtttttttctacatgtcgaggcctttttgataaagcaaattgtctatcagagcccaatccagcatctctccactccaaactggtaaggcaattatctagaagactattctcctgagaaaaccaattataaatgttctctcaaagtaagtaagcataccaatttggatgcacatgtttttttggttagcacttaaaagagaaacaaaaaaagtgtgctgagaaaaaaagatctctgtctctctcactcgacacaaaccaaagaatcatcaattgagggaattaccaagaattaactgataaaggaaaaagacttccattgatagttctccataaaatttatttttggtgagaagagtatattactttctcttggtttgctctgccaaatctcttgtccaaatcctttatatttcattttcaagcaatgctacttggctcccacctctatagtcctcctactcttaaacattccaaatatgaccaaaaatacaatgttctttatctgttgctttagccacggaagtaaacaattcacaattacccaattcagctcaaggagcacagttggttcctagaaaagtgctagattagaaatctaaagacctggactgtagtcttggatataaatttaccagctgtgtaatcaaggcagtatcacttcaactcccctagtgtccattttcacatatgttaatggtggaggttgaattggactagatgtcctctaaaatctcttcccattaaaagaagtatgggatcttattattgtgattaggaacttctactccaaagggcaattttatatttaatagtagaaggaaatgatatatttaatagtacccagaatttttttttactttcctaatacaagggagatggaaggagataataggaaaatggttatgatcccctccttcatgtatactcaggtccaggtcattcatttattcaaaaatagttattaaaacttggtatgtgctagacatatcaagcattagacaacagtaaacaggtgtgaaacatcctttaatgcagcttagggtctaatgaaagattaaaatactgtatatgcaattatgggctggaaaaaatggtcctcttttaatgaatgagcatgactcaaacataactacacacacacacacacacacacacacacacacaccctcacacatttcgcctaaaaagaaaactgttctccaagtgggcaagaaaatcaccttttgtccccagcctaaagatattatctttagcaaagataaataaatttgtcattcttgctaaattcctctgagtttgtttataattgaaacttcagatagctccttaagttaacaaaatgggtaaatggcattaagcatgaatttgaccattaagggaaggctattgtcctgttgctcctgcctatcatctttctcaaactgtcataggtattttcacctttggatatcagttgaagtcaaccactaatggactatattaatttttcttctgatgtcagcaactgaaggaacaagtacatcccatgcctgaaatggaaaaggatggtggttatcagtgcagctttattccctaggaactctaaacttgtcttggaaaacaattccctttgcagttttcagggtctttgaccgcagacttaacatatctcagaatcagagtatctgctcatgaactacctttactggttgtttcaggtactcttctaaatgctttaagaatagggacttatttagtccttctaacaaaccccatgagatagatacctatgttatcctaattttacagatgagcaagcagttctcacagcttgtatggcagaaatagaattcaatccaggtagtctggccccatgtagatacttttaactatgtagatacgggtacaaaatgcagcaaatgacaagaagatgcagcctgaagggtacactgagaatatgaaataacccaaaatggactctggggtaacatgtacagcattcttattatattaaatacccattaaaccaagatgaacaaatctcctcttgtttaagagacacagggttagaagtgttaatttttttaaggaatataaataagattgaaaatgaacccacatggcttaaaatgaaattaatcaaacaggagcctttccaaaaatggaagcactatctcatagggactttaatcccataattcaaaatggaatatcattccccaaaacatgtttctcctccagtgttcgtattccagttatggcaccactactctcttaattagaaacctgggaaccatctgaactccaccttctcctccaacccacatattcaacctataataacttagattcaaaaaatgaaattaaaaatattttgaactgaataaaaatgaaacagcatttcaaacttgcaggatgcaactaatgcagtgtataaaggaaaatttatatcgctaaatgcctatattagaaaattaaaatggtctggaaccaattaactaagctcccacctttaaaactagaaaaaaatcaagttaaagccaaaataaaccaataagaaagaaataataaagataaaattagaaattaataaaacagaaaatgtacacttacattaaaaatttcatatatgtttctgctaaaaaactttagtacctatgtttctattagtttcctgaggctgcttaaacaaattgctacaacctttgtagcttaaaacaacgtaaatttattctctcacagttttagaggccatgaatccaaaatcaaggtgtcaacaaggctgcacaccctatagagagatgctgtaagagagaatctcttctttgccttttccagctcctggtggttccaggtgttccctggcctgtggtgctatcactccggtctttgcttctgtcttcacatcactttctcctctatgtgcctgtgccaaaactctctctgcctttttcatataaaatacatatgattgcatttagatcccaaccagatcatccaggataacctcatcctcatgagatccttataatgtgatcacatcatttaccatataaagtaacattcactcttttgccatataaggtactattcacagattctgaggattaggacatgaatttatctttttgggggtcaccattcagcccatgacaacgatcatgagagatatagtttttctttcttgcaatgtttctgtctgattttggcatcagggtgatgctgactttatagactgatttggggagttttttctacaatttttctagaagagtatgtgtagcacttgtattattttttaaatatttgatagaatgcatttttaatttccttcatgaacttttcctttgccttcacaacttggctgtttggcacaagaggcccagctttcagcctgtcttagattttgacataccttcctcactgaacttaactatttttagctttttacttaaagtgagagacatgcaactcttcctttcatttgaacactttgaggcaactgtagggttattaattgacctaatttcaatgattttgtacttcaggtaatagggaggcccaaggagagagacacagatggggaaaggctggttagtagagcagtcagaacacatacagcatttgttaagttcaccatctcaaatgggcttggtttttggtccccaaaacaattacagtagtaacatcaatgagcactgatcacaaatcaccataaaaatgtaataataatgaaaaattttgaaatattgcaagaattaccaaaatgtgacacagacaggaagtgaccacacgctgttgggaaaatggagctgatacacttgctcaatacagagttgccacaaaccttctatctgtaaaaaatgcagtaactgcaaagtgcaataaagtaaagcacaataaaacgaggtatgcctgtgtttctttgtattgcctttatcaaacacattgaacatttacagtaagaattcaatgtattgaatgtatcaaattaatatgtatgaaaatatgtattggatgaatatatcatgaaaatgtattgaataaataaaatgaatgaataaatgaacaagtgaataaacaagtgaaagttcctgtccgtgccatcatcatatattccttagacaccacttcgcacaatagctttaagtggacaaatatgaatcaaccctagccataccacctctctaaaaatgaagtgttcaaaaaattattttcctgaagtttataatcctacatctactaagtactaggcagtcagaactgcctggatttcttgaacttccctctccaacacaccctttctcacctctgagatttctatctagcctgggtacaatctcctcaatacacttttataattttgacatttcagtgacattttcatttgaaccacatattagtctttcttgtctcctctattaatctgaaactccttcaagacaggcttttgactattttttaatatattcctaaaacctaaaagaacaaaagagccacagctttggaatgagtcagaccttaatttgaatcctaagtgtttctgttaacttgcaagctgagtagccttgggtaagttacctcaactctccatctcaatgtcctcatttgaagttggcaataatagtatctatcttgtaaggttgtcattagtactaaataggataaggtccataagcccctatcacagtttctagaatactaataatgccatcaatagtacttaaagtatgggtgcttaatgaacactacaattatttttcctttaggaaaacagaaagcttcacaaggtacacattttaacagtgtcgagattaaatctatttaaatccagaaagcatcccctattatttgctgaatggcatttactgactataaaaactcaggcggtgctatatatccatatatgtgtgtgtctgtgtgtatatgtttaagcccattgtaataaagaaattgctcaattagactcaaagaattgcctaaaatatgtactgccagcagctcaactatattcacaccaaaacccaagcgacatcatggaaatttaaagctgaaacctataaggaatcctaaaaagcacctgattcgcttcttcatttttctgataaggaacctgagtttgatgaaagtcatgacttaccaagtcagcatagtgagtacataggagagccttgttgctgcctcccagatttgaaagtattactgtttcatatctaaacccacattccctctatcttcaatcacctgagtacctgtgaaatcagaaagtaaccttagcaataataaaggagtagatgtatatacaggtagcctccgaagcagtgtgatgttatgcctattgttccgatatattgctataggaatctgctccatgttctacaatttacaaataaagcatttctttttgttatgtattcaaatgttcctagctttttctttctctcattgccttttatttgtaactagtgctcagacataaaggtttctttttctattaagttttaagcccaatttcaacagtaatttcaagtgtaattactgctcctttctggcaacagctctgaagtaaacccacattcatactgttcagcaacatagacaaactcaaacatccatacatccgctttcacattttactcttaaagactgaatttgaacataccttaatgtaataaaagccatctgtgacaaacccacagccaatataacattgaataaggaaaagttgaaagcattctctctgagaaagggaataggcccactctcactgctcctcttcaacatagtactggaagtcctagcgagagcaatcagacaagagaaaaaaaatgaagggaatccacatcaataaagaggaagtcaaactgtcactgtttgctgacaatatgatcgtttaccttgaaaaccctgaagattcctccagaaagctcctagaactgatacaagaattcagcagtttctggatacaagattaatgtacaccaatcagtagctcttctatatactaacagcaactaagcagataatcaaatcaagaactcaatctcttttacaatagctgccaaaaaaataaaatacttaggaatatacctaacaaagcagtcgaaagacctatacaaggaaaactacaaaacactgctgaaagaaatcacacacaacacaaacaaatggaaaaacatcccatgatcatggaggggtagaatcaatactgtgaaaatgaccatactgccaaagacaatctacaaattcaatgcaatccctatcaaaataccaccatcattcttcacagagttagaaaaaacaattctaaaattcatatggaaccaaaaaagagcctgcatagccaaagcaagagaaagcaaaaagaacaaatctggacacatcacactacctgatttcaaactatactataaggccatagtcaccaaaacagcatggtactggtataaaaatagacacatagactaatggaacagaatagagaacccagaaataaacccaaatacttacagccaactgatcttcaacaaagcaaacaaaaacatgaagtgaggagaggacacccttttcaacaaatggtgctgggataattggctagacacaagtaggataatgaaactggatcctaatctctcaccttataaaaaatcaactcaagatggattaaggacttacacctaagacctgaaactattaaaattctagaagataacattagaaaacccttctagacattggcttaggcaaggatttcattaccaagaacccaaaagcaaatgcaataaaaacaaagataaatagctgggacctaatcagactaaagagcttctgcacagcaaaaggaacagtcagcagagtaaacaaacaaaccacagagtgggagaaaatcttcacaatctatacatctgacaaaggactaatatccagaacctacaatgaattcaaacaaatcaataagaaaaaaataaacaatcccatcaaaaaatgggctaaagacatgaaaagacaattctcaaaagaagatacacagatggccaacaaacatatgaaaaaatgctcaacataactaattatcagggaaatgcaaatcaaaaccacaaggcaataccatcttactcctgcaagaatggccataagcaaaaaatcaaaaaacagtagatgttggcatggatgcggtgatcagggaacacttctacactgctggtggaaatgtaaactagtacagccactatggaagacagtatggagatttcttaaagaactgaaagtagagctaccatttgatccagcaatcccactaatgtgtatctacccagaggaaaagaagtcattattcgaaaagatacttgcacatgcatgtttacagcagcacaattcacaactgcaaaatcgtggaaccaatgcaaatgcccatcaatcaatgagtggataaagaaactgcagtaaatacatagatggaatactatgcagctataaaaaggaataaattaacagcatttgcagcgacctggatgagattggagactattattctaagtgaagtaactcagggatggaaaaccaaacatcatatgttctcactgatatgtgggaggtaagcaataaggacccaaaggcataagaatgatacaatggactttggggacctgagaggaagactgggagtggggtgagggataaaatactacaaatatggtgcagtgtatactgcttgggtgatgggtgcaccaaaatctcacaaatcaccactaaagaacttactcatgtaaccaaataccatctgtaccccaataaatttaataaataccccaataaatttaataaataccccaataaatttaataaaatttaaaaatataaaaattacacaaaaaaacaactaattttagaaatgatctaatcatgtaggaactacaacctatgtaactggccatttgagttgtaatataaattagtaaaaatttttcactttgtctttcttttatcaatttcttagtaagaaaaaaagaaatagaacttaaatattcttagatatttttaaggttgatgtggtaattagttttataacttttttctggaatgaaatgaaaataggaaaaaagagctgttttagctaactttctgactgggtataaaaatggtaaaataagcctataattactttttctggagaaatatgaaataaaagatttaaatttgctaaagaaaaatactgaatttgaaagggcaacaaataatggcttggaggaaaataaattaagataaaataattataaaaatggtagaattttggtataaaaatggtagaataagcttataattactttttctggagaaatatgaaataaaagatttaaacttgctaaaaaaaaagaaaaagactgcatttgaaagagcaacaaataatggcttggaggaaaataaataaattaagaggaaagggtcagggagcactaccgactcacagccaagttgtttttcccacttactggcataagcagtacttggcagtttgggcatgatgggaatgttcccaccacccctcctaaaagaagaaaaattgtatgtcaacatacaagaggcaaggctgccaaaactatcaataaagtataaatttcatgagggtagaaatttttgagagtttcattcactgctgaaatctctcaggacagtatctgacacacagcaggctctctctaaacatctgctccgtgaaggcagtacatagaccttattggcctcagcatcagatcctgacagtgaaactccttacaacaccactagcatctaaaattaaatattcaagggaggagcaagatggccaaatagaagccaccatcaattgtccctaaagccggaataccaaattttaacaactaactacacacaaaaaagcactgacataagaacaaaaaatcaggtaagcaatcacagcacctggttttaacttcatattgctgaaagaagcactgaagagggtatgaaagacagctttgaattgctggtgccacccctccccaatctccaggcagtgaccatctggcacagagagagaatctgtgcacaagggggtggaagagcacagtggctggggcacttgctgccttgaaggaagattgaacttatgccctgtcacagcagagagcaaagccatgctgggcttagccagctcctgcccaaaaagggaacatttggacaagccctagccagagggaaatcgcccatcccagtggtcagaacttgagtttcttgacaaacatcaccactgcgggccagagagctctggggtccttggtaagctttaaaggcagtctatgacacaaggactgaaattcctcctactgctgagcttagagccagtggactagggtggcacatgacctagggacagagtgaaaaacggggtgttttttctactcctcccacaagcccaggcagccctgctcgcagaaatgaaagtgactctttccttctgcttgaggagaggaaagcaaatagcaaagaggactttgccttgcatctagaataccagctcacccacaacaggatagggcatcaggcagagtcctgaggccctgtattagcctgttcttgcattgtgataaagaaatacctgaggctgaaaattttataaagaaaagaggtttaattggctcatggttctgccaatcagcatcaggaaacatgatgctggcatctgttcagctcataaggaggtctcaggaaacttacaatcaatggcaaaaggcaaaggggaagcaagcacatcttacatggccggagcaagagcaagagagagagggggaaggtgctacacacttttaaacaaccagacctcatgagaactcactcactatcgtgacaacagcaccaagggggatggtgttaaaccataagaaactgtcctcataatccaatcacctcccactaggccccccacctccaacaataaggattacaattaaacatgacatttaaatagggacagagaaccaaaccatatcagacccccattccagtccgtagctcctgggcaacatttctcaacacaccctgggaacctgcccagaagggagcctgctaccttgaagggaaagaccaagtcctggcaggattcatcatctgactaaggagcccttcggccccgaacaaccaaaggcaatatccaggtaatatgccatgggccttgggtgaaactctgagacatgctggctttaggggagatgcagaatattcccagctgtgggaactatggtgaaaaattctttctgcctgagaaaagcatggggaaacgtaaagggggctttttcttgcacattaggtaccaactcagccacagtgaggtagagtatcaagctgactcttggggtccttgagtccagacctaggttcttaaacagaatttctggacttaccctgggccagaagggagcccacatcccttaagggtgacttccaggcctggcagcgttcaccacaagctgactgaagagccctttggctttaagtgaacatcagcagtggcctggaagtaactcttgtcacctgtggtggtggtggtggcgatggaaagagacagctccgcctgtggaaagtggagggaagagtgggaaggactttgtcttgtggtttgagggcaagctcagatgcagtaaaacagaacacaaggcagatttctaaggtttttttactagaatccctggctcctagacagcatctctgaacctactcaagacccaggagaactttccactctgaagggaaggacataaacctagctggcttccgaacctactgattgtagaaccctagaatgagctagtcagtagccagttagtggttacagtaagcctttggtgagacccagtgctgtcctggcttcaggtctgacctctgtagtcccagtattggtggccacaggggggattgtgttaccccatccccagatgcaggcagctcagcacagagagagaaggtccatttgtttgagagaaagtaagagaagagaacaagagtctctgcctagtaatccagaaaattattctagattctatacaagaccaccaagactgcacctctataagtttgcaggaaccacagcattattgggcctggggcccaaatcccttcaaatacctgggaagcctttccaagaaagatgggcacaaacaagcccagactgagaacactacaataaatacctaactcttcaatgcccagacactgacaaatacccacaagcaacaataccatccaagaaaacatgacctcaccaaacaaactaaataaggcaccagggaccaatactggcgacacagagataggtgacctttaagagagagaattcaaaaagctgctttaaggaaactcaaagaaattcaagataacatggagaaggaattcagaattccatcagataaatttaacaaagagatttaaataataaaaagaagcaagcagaaattctggagttaaaaaatgcaattgacaaactgaataatgcatcagaataccttaatagcagaactggtcaatcagaagaaagaatcagtgagcttgaaaacagactataagaaaatatacagtgagagaagacaaaaaaaaaaaaagaataaaaagcaatgtagcatgccttcaagatctagaaaatagcctcgaaagggcaaatctaagaattattggtcttaaagaggaggtagaaaaagagatagtgatagaaagtttattcaaaaatacaatatcagagaactgcccaaacccagagaaagatatcaacattcaaatacaagaagactatagaacaccaagcatatttaacccaaagactaccttaaagcatttaataacaaaactcccaaagttcaaggataaagaaaggatcctaaaagcaccaaaagaaaagaaacaaatcacatacaatggagctccaatacatctggcagcagacttttcagtggtaactttataggccaggagagagtggtattacatatctaaagtgctgaaggaaaaaacttttattctagaatagtatatactgtgaaaatatccttcaagcatgaaggagaaatactttcctggacaaagaaaagctgaggaatttcatcaagaccagacctacaagaaatactaaagggatctcttcaagcagaaagaaaaggatattcattatcataagaagtcatctgaaggtacaaaactcactgttaattgtaagcatacagaaaaacacagactattacaatgttgtaattgtggtgtgtaaactactcttaagtacaaaaactaatgatgaaccaatcaaaaataattactacaacaactattcaaagcctaagcagtgcaataaggcataagcagtgcaataagacctaagagaaacaaccaaatgataaaaagcagggagatgaagttaaagtgtagagtttttattagttttctttttgtttttttgtttatgcaatcagtgttaagttgttatcagtgtaaaataacgggttataagatagtatttgcaaacttcatggtaacctcaaattgaaaaaacagacaacaaatacacaaaaaaataaaaagcagtaaattaaatcataccaccaaagaaaatcaccttcatggggaaaaaagaaagagaagaccacagaacaaccagaaaacaaataacaaaataacaataagtccttacttatcaataataatattgaatgtaaatggactaaactctgcaatcaaatgtcacagagtggctaaacagattaaaaaaaagagagagacccaatgatctgttgcctacaagaaacacacttcacttacaaaaatacacatagactgaaaacaaaggaatgataaaagatactctatctgaatgaacagccccccaaaaaaggagtagctatacttacatcagacataatagatttcaagacaaaaactgtacaaagagacaaaaaaatcattataaaggatcaattcagcatgataaagggtcaattcagcaagaggatataaaaattgtaaatatatatgcacccaatgatagagcacccagatatatatcattagagctaaagagacaggtagacctcaatataataacaactagagactttaacaccctactttctttttttttaattattattatactttaagttttagggtacatgtgcacaatgtgcaggttagttacatatgtatacatgtgtcatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggtttttcatccttgcaatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaagagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccgttctaactggtgtgagatgatatctcattgtggttttgatttgcatttctctgatggccagtgatgatgagcattttttcatgcgtcttttgattgcataaatgtcttcttttgaatagtgtctgttcatatcctttgcccactttttgatggagttgtttgtttttttcttgtaaatttgtttgagttcattatagattctggatattagccctttgtcagatgagtaggttgtgaaaattttctcccattttgtaggttgcctgttcactctgatggtagtttcttttgctgtgcaggagctctttagtttaattagatcccatttgtcaattttggcttttgttgccattgcttttggtgtttcagacatgaagtctttgcccatgcctatgtcctgaatggtaatgcctaggttttcttctagggtttttatggttttaggtctaatgtttaagtctttaatccatcttgaattactttcatttcagaattggacagatcttccagacagaaaatcaacaaagaaatgtaatatttaatctgtgctatagaacaaatggacttaatagaaatttacagaacatttcaatggctgcagaatacacattcttttcttcagcacaaggatcactctcaaggacagatcatatgttaggtcccaaaacaagtcttaagatattcaagaaattaaaataatatcaaggatctcttctggccacagtggaataaaactagaaaccaataacaggaggaattttggaaactatacaaacatatgaaaattaaacaatatactcctgaatgactagtgggtcaatgaaaaaattaagaagaaaatttacaaatttcttgaaacaaatgacaatggaaacacaacataccaaaacctgtaaaacacagtgaaagtagctccaggaggcaagttcatacctataaatgcctacatcgaaaaagaagaaaaacttcaaataaataacctaatgatgaattttaaagacctaaaaaagccagagcaaaccaaacccaaaattagtagaagaaaataaataataatgatcagagcagacataagtgaaattgaaatgaagaaaacaatacaaaagatcgatgaaatgaaaagttagttttttgaaagcctaaacaaaattgacaaacttttagccagaataactaagaaaaaaggagagaaaatccaaataaataaaatcagagattaaaaaagagatgttacaactgataccacagaaattcaaaggataattagtagctactatgagcaactatatgccaacaaattggaaaatctaaaggaaatggaaaaattcctagacacatacaacctaccaagattgaaccacaaggaaatccaaaacctgaagagaccaataataagcaaagagatccaagccataataaagtgtcatccagcaaacaaaggctcaggacctatggcttcactgctgaatcctatcaaacatttaaagaagaactaattactacaatatagtttatgaagaacaaataatcaggaaaaaaaaactaataccaattctgctcaaactactctgaaaaataaaggagggagtacttccaaactcattccatgaggcgagtattaccctgacaccaaaagcagaccagacaaagacataacagaaaaaagaaaacttgcaagcttaatggtaacctcaaattgaaaaaaacatacaacaaatacacacacaaaaaaagcaagaaattaaatcataacaccaaagaaaagcaacttcatagggaaaaaaggaaaacaacaaaacaaccagaaaacaaataacaaaataacaggcataagttcttataaataatattattgaatataaatgaactaaactctgcaatcaaatgatgtagaggagctaaatgcattaaaaaaaaaaagacctgttgatctgttgcctataagaaacacaagaaaagaaaagagaggggtgaaccctttctttgccctttgccccactcccaagataacaaacctactgcaacccacttccatgataacaacattaatccatttaagaaggcagagccctcatgacctaatcacctcctattaggccctaccttccaaactgttgtaccggggattagatttccaacacatgctttttgggagacatattctaagcatagcagagaggtctttggttcttaaagcaataccactattcagcagccaaaggtaggctgagtttaagcaggtattctttgaataataacaggatcatcaatagaaatttatgtttgagatatacaattatgggattacatataaattttatttcagcaaattactgcatacagccatcatagaatttatcatcttgcactgcaataacccatttactcatctatctcaagtagacagtgagcttcctgagggcagagaaagcttcattttgtcctagtgtctggtacatgacagatgctcaataaacatcagagagaaaagataaaagggacataccagttgacacactgacctgttccctcacatagtattaaagcatagatggcaagttaatctttcattcaacaaacgcgagatacagtctctgccctcaagcaccttacaatatggaatgcaagggaaggcaaacatgaagaaaaaggcctgtattttgaaccgaatcagtcatttgtgagctttgtacatctcctcatttaacttaagcctacaccccttctaacatctaaacccttccactgtatcccttaaaatctatactgtgctctcctacactcccacccctactccctagtccacccctgacagaactttcaaaaactacaacctccacctgagctctcctagaccgaactctcaatgcagcagatagggtttccttctaaaaccccaaaggaatgtgtcattcccctgctcaaaacttctcaggaccctcatcttactcagagtaaaatctaaagtgctgaccactgttcataaggtctgtttccttctctcacttatcatctatgtaaggacaaatacaaaatttttaaaaggcttaattttccctgttgaaaataagagaccctcctcatcttttcttatagcatttacttcagaaaacttgtaagtactttcttctcgctttgaaatgtatataaatccttttgaaaactagataggatcttaccagtttcatgaccaaggaatgtctttctcaaaaaccttggagccatctctttgaatatagacatcaagggagataggagccctatctcccagtttttgtggaaggataatagcccaacttaggtaggcactttgttccacattgcaaaactacatcctaggccaggcatggtggctcacggctgtaatcccagcactttgggagaccaaggagggtggatgatgaggtcaggagatcgagaccatcctggctaacacggtgaaaccccgtctctcctaaaaatacaaaatattagccgggcgtggtggcgggcgcctgtagtcccagctactcgggaggctgaggcaggagaatggcgtgaacccaggaggcagagcttgcagtgagctgagaccgcgccactgcactccagcctgggtgacagagagagactccgtctcaaaaaataaaaaacaataaaaaaaatgacaagttggttttcctctggataatgccaattagctaacattgatggtcactccaattaccaggtgaatctagcgtaagctatatgtggcaagtggtgctgggaagttgtcttgcttgaggactagttattgtttatcttaaaacatgcgtgtaatagattgtatcttcttggctatgtaaaagaatgagatttttttctttgaaatctttcagtagattgcctatgatatgcaacacaatctagtttaatgcttattcaatgataaaagtgttttctttctcaactacctttgtgaagagcatatctgggttggaagattttgtttttaattatatttccccaaatactaccactcttctccttgctccttgttccttcaaagaaaagcctccacctttgttctgcacatatcccctcagtctagaacattccccaccactaccacccatatctgtttggcccatttcctcccatgtattcaggtcgctgctcaatgtcactttcaaagaaagatgatccctgaccaccttgtatcaaacaacaccccttggtcatcacatttctactttacctgtctttattcatcctcatagctcttataactgcttgatgtgtatgtgtttgtttacctgctcattgtctgtcttctctgaccaggataaagtctccccaagagcagagacttttcctgtttcattcacctcttatatttccagggcctagataagagtctggcacaaaggaagagctctttcaatgttagttcaatgaataaattattgttaattatacaaagcaaaagagattcaaataaagtgctattagaatgagccacttaactttgcagaaagtgcaactctgtatagctagagctataaaagagctgagcttttggctacagaaacacctgagcaagaatttatgatagctgagtgcttcttgtcacccctgctttcaaaataactgcaaatttgtgatggacagcaaagagttgtcatcttcatgcaccaattcatatgattcgtatggtcttacctcactaatcaaataatgagggaggagagcagggaaagggactggtttttaataatgaaaagtgaaatattagaatatatgaataaatgttcctgtgtatgaagagaaattaaagaaattctgtccaattcatttatagatttatgcaactccaatcaaaactccaatgcaatttgttcagaaagtgatagaataattctaaaattcatctggaaaattaagcaggtaagataattctaaaaagaaagagattaagcatcctaaagctataataataaaacaaagtgctacggatataaaagtagattaataaaacaggatagctagcctaaaatagaaagaacttattcatgatttaaaaaactcctaatcaaagaagaatgaatgaatgaatgaataataaaacatatcatttaataaacgcttttgggataattgattatgtatttaaagaaaaaataatttgagcacctgttgtacattttatactaaaagaaattctatgcgagttgaagagttaagatggaatcttaaagattctttaagattgaattaagatggaattcttaaagattccatctttaactctttaactcgcataggatttcttatcaaaaacttgataaaaaattactatttattatagatatataattgttatacaatttagaaatatatattattttaatttctaaatatatattaaatataataatatttatatatctataggtggcagatgacatgattctatatctagcaaacctcatagtctcagcccaaaaggtccttcagctgataaacaacttcagcaaagtttcaggatacaaaaccaatatacaaaaatcacttccattactatacaccaacaacagtcaagccaaaagccaaatcagccgaatctcatttacaattgacacaaaacgaattaaaaacctaggaatacagctaacaagggaggggaaagatctctaaaatgagaattacaaaacactgctcaaagaaatgtgagaaaacagaaacaaatggaaaaacattccatgctcatggatagaaagaatcaatgtcattaaaatgggccaatctgcccaaagcaatttatagattccatgctattcttaccaaactaccaataacattctttacagaactagagaaaactattttaaaattcatatggaaccaaaacagagcccaaatagccgaggcaatgctaagcaaaaagaacaaaactggaggcatcatattacccaatttcaaactatactacagggctatagtaacaaaacagcatggtagtgttacaaaaagaggcacctagcccagaaataatgctgtatacctacaactatgtgatctttgacaaatctgacaaaaacaagcaatggagaaaggactccctattcaataaatggtgctgggataactgtctagccatatgctaaagattgaaactggaccccttccttacaccatatacaaaaatcaactcaagatgaattaaagacttaaatgtaaaatccaaaactataaaacccctgaagacaagctagccaataccattctgaacataagaacaagcaatgatttcatgacgaagatgcctaaagcaatcaggacaaaagcaaaaattgacaaatgggatctaattaaactaaagagcttctgcacagcaaaagaaactatcaataaacagacaacctaaatagtaggaaaaaattttgcaaactaacaaaggtctgatatccagcatctataagaaacttaaacaaatttacaagaaaaaacaaataaccccattaaaaagtggacaaaagacatgaacaggcacttttcaagagaagacataacatgtggccaacaagcatatgaaaaaaagctcaatatcactgatcattagagaaatgcaaatcaaaaccacaatgagatgccatctcacaccagtcaggatggttattatttaaaagtgaaaaaataacacatgctggtcaagttgtggtaaaaagggaacacttatatattgttgatgggagtgtaagttagttcaaccattgtggaacgcagtgtggcgattcctcaaagacctaaaaacagaactaccatttgacccagcaatcccattactggatatatgcccagattaatataaatcattctaccataaagacatatgcacatgaatgttcactgcagcacaattcacaaacaacctaaatgcccatcagcggtaggctggataaagaaaatatggtacatatacaccattcaatgctatgcagctacaaaaaagaatgagatcatgtcttttgaagggacatagattgagctggaggccattatccttagcaaactaatgcagaaatcgaaaatcaaataccacatgttctcacttacaagtgggagataaaggataagaactcatggacacaaagaggggaatgacagacactggagcctatttgagggtagagagtaggaggagggagagaatcagaaaaaataactattgggtactaggcttaatacctgggtgatgacatagtctgtacaacaaaccactgtgacacaaatttacctatataaaaaacctgcacatgtacgctgaacctaaaataaaagtttaaaaaaaagttaaagattgaatcatagacaactttatgaaaaaaagactttattctagatatataaattgtatgtaatttataaatatatatttatttcttttagatataatatctatatatctatagatggcctttcgagacttagaacctgctatggtttgaaagtgtccccaaagttcatgtgttagaaacttaaactgccattgtaacagtattaagaggtagggcctttatgaggtaattaggccatgaaggctccatcctcatgaatggtttaataccaactttgcaggagtgagttagttatctcaggagtgggctcctgataaaggataagtttggcccccactttctcttcatctagggtactcacttccacccttccatgcttctgccttcttctatgggatgacactcattagatacagccgcttgatcttggacttcccagccaccagaatcacaagccaaataaatatgttttctttataaattacgcagtctgtggtattctgttatagcaggagaaaacagactaggaaactataaaaataaatgtaaaaagactagaaagatgtgatgttagaaacctatggtaaaaaaaaaagcaattatgagaaaaagtttttgttgtaaacatgatagatctagcttaatatgttgaataaagagatcaaacaagcagataacagaaacactaaaatcccaaaagataagtgagcaaaggtcaaaaacagacaattcatgaaagaggaaatacatctagcaaaaagacatatgaagcaggttctggctcttatcctagattctgcttctggtatccagtccactgaactcttggtttgatgcttcctgacagccaataattagcctccattttgctcttcaactgtgcccttgcttttcaactagaatttgatacttcattgctgcatcttctgttctaactttcacacattctcagttcccagcttttctatgccctgccttatggaagggtaagaaaaccataggaaatctctattttccttacttcatattttaccattttattcattcagtgctgctacataaaggcctatattttattcttcatcactttttcttttatatacactatccaaacaggttaagtaatcccatacacaatgtacaatgatccgtgttgtgataactacatgcaaacacatagttagagttccgaaggaaataaggaaggaagaataggaagagggagaaagggatggagggagggagggagggaggaatggaaggaaggaaggaaggaaggaaggaaggaaggaaggaaggagtagggagaaaaaaagggaagatcatataagcaacactttaaagcatccaaagcaaatacaaattccagggcgttgttaatttactaggcattatagatgcatttgggggaaatataatgtttgcaataccctgtgaaaaactaatattgatatcaaaatataaaaagaaagtaaaaatgaataacgtaattgcctgcaaaatgtattatgagactcaattaactttaaattatgctatcataaacaattcattatatttaaaaagtttgtatattagtttatcttactacaaaagaattcccaatggtacctaacatctaatttaaattaaatagtatttatgtgtgagcaagaatcacaacacatgaattaaacattactcataagatattaaatttcaaagtacatttataaaaatatttccaaatttttctatatcaaaaactacgtttaatgttgggttgcattgtaagtatattttaatacatttgctatgaagtgactgaagcctccaaaaacaagagtgcttaaggcagaaaaagtttttcaatggttgtggcacatgctttgaaaattcagatatgtccaggaggagcggagggttctctttgcttaatgaaacttgtcttgaagaaaaggataggcaggaacacagataatagtttccaagtgaggactgagtttgaaatagcacagtaatgtgttgttaaaattgtccttagagtcagctgaagcctaggagtcaggggtcagggggtagttgggaggagaagactaaaatataatagcaaattaaaaattatataatcatatcagcaaaatctctaaaaggaactggtgaacacaacttggcacaaatagtagtggagggtattagccacacttcaacatgtggctggcagtgtgttactttttgacacttacctagtggagaaagagtggggccatgttaccagatagagacggaggcagccagttatgtaggagcactacagcctgggcactgggccagctgcctccactgatcatcagcttgagagctagggccatgcagccagttaccaagtggagagaaaatagtgattgtatggccagtgctaaccttatgaacacatatgaaagacatgaaaatcccacaatagatatacaaagacatttttgtcatgacagttatgatgtactcctagcaggtaaggcctagagaaacatgggttatataaagaattctattaagtagacacatagaaatccttgaatatgcattagggaaaaaatgttgtcaaatggtcaacttggccatgttatttctgaaaatataaggtactaactctgtgggaaactttccaaggtttaacttttgcttttgtccttgctacaattgttgttgcaaacttatagtaaaacattagtcagatctagatcaacaaggacactgcaaggtatttccagcatggaaaacaaacttcactttcccaaattccaattctgtcaaaccagatgatgcatccatttggaaaagaaaagaaaacaaggcaactacttcagagcaagcttcattaataaatgcagaacagtctgttatctgtaaaaatgtgcagataagagaggaagagaaaaatctgcaagattcccaggctttgttgtgaataaatatagcatggctgtcaaaacaaaattgtaaaccgtattatgtagagtttccttttgttaatttggaatttaaatgtttaagtccaatcccctaaatgcaaaagtgatcaatcccagagcaatatgattactgtttcttgacaatgtggatagaaaccatcaaagccatatgtatacttaaaaacaacagacactgttatttttattcactttattttattttatttctctgaaacccatacacacagaataagaatttcctctgtatgtaaacaatataaataaaatatgcattggatatgagataatatcatatgaaatctacagaggaaaacattcatttctttatcaggcagaatcactatattagagatgaatacattctcttaagactctcaaacacttttaggttgcctatcctttagttttaaggtacattactaatacaacatcttttaaatttgaaccaagtgactttttaacatctattgaagctattggtaccttcaatagacaggagatggatcagaattctcgtggttatttaagaaatacatatgtaagtaagttcaattcacaactgagcttatgtttcctctatatgataaacatgctgaaaacaagttattcagggaaaatttttctggctgtattggaaagcttaggccaaagtcaaagagaaaagaagaactaaagcaatctagcttttcccatatgcaaacgtctatttcgaaacataggatgctgatttacagtgaaatttccgagtcaaataaaaatgaagcattgttgtatagtgggggaaaatgctggcctcgcatcaaaagttctacattccaatctcactttgttcttgctagctgataacctatgccaagtctcttatgggccttattaaatgaggagtgaattagatcatttctaacgatgttcaactctaacattttatgaacctctaccaatggaatcaatgtataagaaaatgagccaaacaaaagaaaataaaaggtattaaagaaagtggaataactaacagagaactatactcaatttacattgaaaagacaaaacattttgtaccattctaatctcataaataaaatataattcaatctattttgtgcaaaacacagtttagagaattacaaaataaagatatgaccctaaaatctactttagtttattgtgcatataaagaatttcaaactgatttaaatttaggtgatgtttccaattttatgaaacaggaaaaaattaccttaaatcactgcatccaagatttaagaaagaatttcttcataatacagttaataaaaattctttctaaaggaatttgtgaaactgtcctccagatgattcgattgtactttctattatactgcatggcatcaattttaacatgcacattttcccatatgttcacatttctcaaattaggatatgtcttccaagtgatggcatcttagatacaataaaatagggtagtttttaaaataggcatgccttatcttctctatcatattgtatttgagaaggaaaaaatagaactgtgcaagaaatcaatatcaagtcataataaacaaataaaagaaaaataaaatcccaattgttgggataccgaagaattccaactagtttacagatactccccctccaggaagaggagcttaaatctccccaccttgagtgtggactgcattagtgacttacttccaaacaggagagtaggaaggggaagggacagggtgaggaagtaaccttgcagtggaaaaacctggcaaacactacattggtcagtgatcaaagttaatatcatcattgataagtcatgtcaatagaatgtcccctttatataatgtcagagaatgtcactttacctttgtggtcatcctccccaaaacccaaaccccagtctaaccctaaggaaaatgttcagacaaatcccatttaagggccattctacaaaatgcctgaccagaccagtattcctgaaactgtcaaagtcatgaaaaacttccttgtttttcatgtctgaaagactgtcacagagcagaatgtggagacatgatgattacatgtaacactgaatcctggcacagaaaagacattaaaggaaaaattagggaaatctgaataaaatgtagagtttagttagcaataacatatcagtgttggtttattggttgtgacaaatgtatcatagcaatataaggttacaatagaagaaactgcaagaaaggtatacaagaactcctctgtactatctgtaatttttctgtaaatctaaaactattctaaaattaaaagtttatttaagaaaaccaagccatgcataattttatatacatattctacaataaaatgacccaacaaatcaaaatggaagagaattagatcctaaactaatccagatttttagaaaaataaccaagctaataagtgtaataatacaggaagataaaatgtaccaaagagaattaagaggctcttatctcaattcttaccatgggaacaatttttcatttgtgacaagacctgaattatatgttagtccatttagtacaaagtaaccatcaaaatagttaaatcctcaactgttgtacactcctatggatagcaatatttctagaataatgaaccttgtcctccctttttctgataacccatcataactctggatgtcttgggtttccaagaaagacttgtgggaaaatatgtgaaacaagtcattaaacttgggcttcaactgctatacagctcataaaacaaatagaactaaactgatttatttgagccatctgattttttgctcaagagacagggtcaaaaccaccctttagggttcaaatggtaatattctttctctgtatgaacatgagcagtgtagtcaacaattgctatgtagtctaattccttaattgactaaaaatactgtcaggccccaacttataatcaaattgtgttttaaactgctgtcatatctgttatgtataatttataacacatgttctcaatgacaaaattcttataaaggatggctaaatgcagtctagttcagaaaactttttaacccgtaaaataaaagatgttcacagcaatgtaaccaaggtgactactgccctgaaaatagactatgagccaactctagcagaaagcgagccccctccaaacaaacaaacaaacaaaaaaacatatcctggattattccctattcagactccacctcatgttttctaaagaaaatggaaagtaagcatccagggtaagccagttgcagtgtttcagagagtggatagaggtggaaagcaggatttataatattagatagaaaggaaggatagctaatataagaaatactctgtgaacaggatttttccactaactgtcagcagcactgaagtttcaagaaaaactgtggacatttccaaggtcctggatgaaaaggtatggacagcaatccccaaagccaaagttatggccaagaagagctgaagatgctttgcataaccaagcaaggcactcagctaggaaaaacactagaatggcccactaagacaggcaagaaagtcttgagcccagggcctgccaaggacacctgaaggattccaagtaacagtggaaggccacacactaaatagagtgcaggctttggaaataaatctgaatttgaatcctctgcctttaattagacctgtgaccataagaatctttcttaactgctctaagacgcagttctttcattcatcaaatcagaataaaaaatatccatttctgaatttctaacagttttatattgatgttctaacaaattatcacaaatttggctgctgaaaacaacacaaattatcattttacagttctggaggtaagaagtctgaattaggccgcatgggctaaaatcaaggtgtcagtaggactgcgttccttctggaggctttagggaagaatctatttctctgccttttccagcttcagcaggccacacacatccttggctctttaccccatttctctgttctcaaagccagcaacatggggccaagtccttctcatgctgccatctctctcctgcctctctcttccatgtttaaagatccttgtgattacaccggacccacccaggtaatccaggatcatctccatattttgcaggtccattgattagcaactttaattccctccgccatcctaattccctttgccatgtaacacatttcatatttatagtacagaattagagcatagaaatcttgggggttggggggtctattattatgctaccacatcatcatatagagtgtgagaattatatgccataatgtatataaagcagttggcatgtagcatgagtccacaaaataatagttttctcagcctccccagcttccctccctcatttaccatcagaaatcttcctctaataaatctcttgcatatctgatactgtgtgaacatcttcttcttggatgacccaattaaccagttacatcaactccagcagagcttccatactgtcaagaatcatagtattagaatcaaaagacacataataaatgctctattccaatcacttcattttataaatgagggaaacaagaccagaacaaagagtaacttgcccaaggtctaaaatcagtaggcagcatagcttgtacaagaatacttgtagcaccattaggattattctatgctgcctgtgggattctggggcaggaacaagctcttttatgactacaaaagttgatattccagtgtaaaacttctggaagtagaaaagaagattctaacagtgatgaatctcaagggaacagagaaaaggagtcctcttctagaagaggacaggccaggcacgatggttcatgcctgtaatcccagcgctttggaaggccgaagtggtcagatcacttaaggccaggagttcaatacctacctggccaacatgacaaaaccccatctctactaaaaatacaaaaagaggtttatgaaaccatcagatctcttaagaattcactcacttatcatgagaacagcatggaggaaactgcccccataatcgaatcacttcccaccaggttcctcgcttaacatgtggggattacaattcaagatgagatttgggtggggacaaaaagtgaaaccatatcaatccccaagaacgtggattatttctcatgtgactttctcaaacaacactttttctccaactccctagcaatggtgctaaaagaaggaaagtacacaccatggcaatagcatcaaacaatagttttaagaaggtgaagcctagaatagaacaaatttgtgagaaaagagcaccactattaatatatgaatattgagcactatgtctgttttaaccatatattccatgttcaatatatacctacaacagtgccatcagtagaaactcactgtccttgctctaatacactcaatattttcacccaaataatagaatcctttcccccaattagtatgagtgtagaagaaatgacaatgatctacagtgcaacttctcatgtaatcagaaattggtagagcatgcaaatccaaggctgatgtattcacatcatgtccgaatatcaggctttgcattagtagtggggatggggtaggataatatcagtgtctgatttctgcccacgtggtcagccaccattagtatgttttgcaggaaagtggataagtgaaaaccaacttaagcttcttctgcttcaaataggatattttcatcttttcaagccatgtattttttctttgatgaatgttttataagtcttctctattttctctccttcatagtaacacttctgttggacatgaataagatttagaattcatgactgtctgtgacatgtcctgaaaactagtttcactatctcagatcataaactgtacttgtctcatgtcatggagcaaaagcaaaatgtcttcatcactttttaaaatcaccatgtaagtaaattactcttttgacatatgccttaaaattatcttttacctcttagcaaagattaaatgccttagctttgccctacaacaatataacactacttcttatacttccatctctgaacctgaagaatctacattacagccaagcatgctccaagaatctacactaaaaccaagcatgctccaaagtcaatctgatatattccttttctctcttgaaacattgtatattaactttcatttttatgacttgcttttctcacattgttatcgtagcttctacattctttatccttcaaatacatttttataattccctgattttacccaataataagattaaagcatgtgagtgctctaggcaggctaatgacatggtattccttcataccaatattctttaaatactgtacatattcaacataggtttatatacttaacactgtccaggagataggcaaagaatgaagaaagcactttcctatggctttgttttcattctaactgttgaattagagctttgacttccagatatagggccactggttggacctgaacccaaatgaattgatgttatttccaggacatagtccctgggtgtggaaaccagttgtgtaactgactaatactggtaatatgtaaagtgtgtaatggcagcacattgtttaaatttgccaaagtctggctcgtttggtttaagagaattttttaaaaattaaataaatttgcccaagtgattttttgtagttgacaatccagcttttctatctaccaatctcaaaaaaagagacatactgcaattagtaaaaattatttgagaagttttcaagacttatagattattatttcaaaacgaaacagcataaatagcttactttttcattttattacttttctatgatagtaatctgttttaagattttctttacatttattcatttattttgctgccaagtgtcctgagactcttctggcattatttttgattacagggagtaggaaaaaaaagactttaaaaaggccatttatttttccaatacaaatttcattatggaggtaatattaatcataaaagaagatactaaccaaaaaaaggagaaaaaagagaaatgaaaatatattgtgtccaggttagaaggtctctgataaaagacaatctaaatctcccaatactatacagtaaattactaaggtaataatgttctgtcatgtgaatatccattcctattgtactttatatgatttgtgagttggtgatgtatgaagctggcattgaaagcaagatcagtgagtaatttgattaaacatgctgaatttacagaatttacactacttggatactaaaaattatcaggctttctgtctcactaaaatttactaggaaaagaggcaagttcttcctagaacagcaattctcaagctatggtctagaaacaagcactttcctgaacatttggcttggtagaatagaatgaacacactatagagggaaatatcccaagaggacattgagagaacactgatatattaggttatttctctttttcagtgagtcttcagagtagaacatttggagtgccactaaccattaaaattgtattccaagatcttagaagggtactccaagatcttagaaggatatcccaagtacctgtcttatgcccctatcagcaatgtgccccaaaatccccattcctgacctacttagcttgtagtctatgaaaaggaaccacagtaagataaagaaaagtgaaaaattgtcaatgttcaatatacaacctatatttttcaatcagatttatttatatgaccacacttaggacaatctcactatttgcaattttctgaatcaccaaaaagaaataaatagggaagcaaaaaggttgtataaaatgaccacagaagaatcacaattatttcaaaattttgccaaataaagaaatcataagacatgaagaaatcataaaatctctattcctctttgagctctatttaatgcaagtctttcctagtcaattaacctccaggctttatatcattaatctaatatttatatcattggccattctgtcttaaaaacatcatgtatgtttcattaaacatccagcaacacaaacaacatgatgcattaggagatggccagtcctagaaagagaagctctgattaacctttcattatttattcacataagaagtatgaattcacagaagaaatctagatggccatcaatcaactccagaaaagaaatgattttgtttttaatcacagctacttatgtttgcattagccaaattcctcattatatttgtagtcaccagttttgtaggtatgaaaggaagttgttgtaatatgttggtggtagcagcttcctgacctctgaatctcagctctggatctcagtttcatgatatcccttctggcttccactgccccagccattctagcaggtgttataagcacctaattctctctgttccctcaattccaagtgaaaatgtctagagtggttgctatttccagcactgaactcattgacagatgccttctctgactcctcttccacagcaggagatgctgtaagtcagcaccttgttactactcaacattcaggtaattaatatcctcgattaacacacactttcaaactccttaccatctttgtcttgcctgttaaaaacactcacagttatctgaatctgtaagtgtgtttttcattttaaaaacatttaacaagcaagacaaggaaagggcaccttctagtgcctgggaaaatgacatcacaaatttgcatacttcctctcttcaaaaagggaaagaaagaagcagaaagtttagtgtcttatacaaaatcccagggcaagactctgattggctcagcttgaatctggctctgacatgcatccctggaccaatctattgtgactagaatgaagctcacataataaaaaggtgtctgctagaaaccactcctctaacaatgagtaaagggaagacgtggtgatctgagaaggtgagataaacagatattctagtagatttttattatacctgtgttcaaatcctagctttgctaattgccagctgttgacctagggattgttatggaatctcactaacacagagttttcttttccatcaagagaaaataatttttaaaatttacatcgtaagatttctgcaaggattttttttctttttcttttttttttttgagatggagtctcgctctgtcacccaggctggagtgcagtcacatgacctcggctcactgcaacctctacctcccaggttcaagcaattctcctgcctcaccctcctgagtagcggggttacaggtgtgtaccaccacacccggctaatttttctatgttcagtagagacggggtttaaccatgttggccagtctggtctcaaaactcctaacctcagctcatctgcccaccttgacctcctaaagtgctgggattataggcgttagccaccacacccgacctctgtaaggattattttacataatacaaatgaagcaatgggcacggcatccaatatattgtaagtgctcagtaaatctgagtagtttgtttttatcattatcaggatgcttcagctaagtgggaacaatcaccatcagttttcttggcaaaagaaaccaaaatttacccttgatttcatttgcttgatgtctagaccctacacccaaagaccatctgaaaaaactgaccacacaaactcatatcaggttatcagctcaaaaaggacatcgcctttctagctgaacttaaatgacacaaaggcaagataaaaggaatccatgattacagtcatgtcctctggagaagggagcaatgcacattcacctcaatacatgtgttcaatttaatctaatacataaaagatctggttttctgggagccttttgttaccaaaccagcatctacaactataaataaggtttatttaaatgatttatcttgaattacctaataatttcagacaggggttagtaaattttctctataggctttgcaggccatatagtctctcttgtgaatattcaacttttcaatgaagcacaaacacagccatagacaatacattttttataatgagcatggctgcattctaatacaattttgtttacaaaaacaaacagagatctgtatttggctgataggctgtcaattgccaattcctagtttagatacaaaagtccttccctcccttcctacctccttctaccccttctcatgatcctcaattatgctcctacgaatgctctaaccccagttcatcaccatcagatgaatcattctaaaatactgttgtgtatgccattttccagctcaaaatccttcaagcatttctattacctaaaacaaaacattgaaactcgatcctgttatttaaaacattctataatccggctctaactgattttcccatgttatattcctcttctcttttacagaaatcatcccataaactgatctattcatgcttgcccttggatatttccttcttaattcttttcctcatgttttccccactatagcagtctttcgctcccctatcttcttcaccaattcaaattttttatattcttcaaggtccagaaacaaaaataataactcgcgaataaaaagtaccttgatccctttagatcccaattatctttcttgtgacttttcaaataaaagctattgttcatatcactcctgcggcccttatcacatactatttactcatccaacttgtgttggttgtgttgctgctgctgatgtcattttattggaagagcagacagcctgtatgtttcttgaaagtagtggctgagtattaaacctctttgaagagcccagcagaccttttggggtactttgtacatacactgaatatataattcattaaagctaaaggacaaaaagatatccatgtatccctttttgcagtaagtgcctttcagcaattagtgggccttttaacaaaaaaggagtttgaaatgattctataaagaaaaaggacactttgtccccaagaaagaacccagggaatgattattcaggatgtataaaattctggacttttgtttttgttttacctaaaaccttccacattgaccgtttcttatcatcctcttcaaaactgtaggtaagaaaaaaaaaaaagaaaaagaaagtacagatcattcagtattcttccttcttagaggcttcgggggagaaaagtttaatgggggagaaatagtaacaaatacctaaaagatttttaatgctttatgaaggcaattgcctgtgtttttgctgtctctcataaccatagatgggtaattgagaattagcgttgcttctgtcaagtgccatggaagcattttagtttcaagctggaaagattcagtgacattttgcatcatttaaaataataaagtcttatgcatgtggtgtcattataagcagtaacttttgatatctgaaaaatgttgcattctatttataaaaggaccctgtttttacacagaattttatttttttaaagtaattctgttactctcattctccagtctaacaacaaaaccattttcagccttaatcgcccaactcaaaataccagctataatactctcatgcaatagaaagatggtttcaaagctgccctccccaagtatttcacaataagagagtttgtatattctagattatagacgaggaaaggaaaggaaaagagaggaaaacgatgaggctagaatcaacttttctagtaaagttttatcaatttatgatgcctgctgttcaaaggaaaaaatccaaaacaagcaaataaataatagaggtttcaagtaaagagcacatttcaaaaaagggtccacagccttcagggaaagatgtaccataaaacaattatccttgataatactgtatgcccttgtccccagctatggttataactcacatggaggtcaactcagcacccaggggagagaactactgcctatcagaaaaataaacaacaagaaaataaaacacagaggagactgtagaatgttcttttatttggagaaggtgaaaaacagcctctgtactgcacatgcacaaaaaattaataataaccacatgaaaatcaagcatttagttattttcccccacatcgaaagacactgccatttaccttgtcaactgagaacaattcctctcctcccaaagtcatatttttgtttcaatttgtatagtattttcacttgcatggttttatctctatagaattcctgcaggtatgttttctacctgtcaggttattttttatttgccattttagtttgtatctaaaattctatatatgcttccaaagaagaatcaaaacttattttggagttaattgtacacaattatcaaatgttctttggatctaaagacatactaatatgcaccataatttgtttctgccaaaaaaaaattttctctcttcatctgtacaatgctattttttctaattatatgtgatgctttattaatggtatctcataggggaaatatgcccagattcttttttaaaatgtaagcaatctaaatatgttcaaagttgtgccacaaaattataaaatagagttggaaaacaatacaacaagtttttttgtgagattaacccagcaatagctttctacatgcagtcaaataatcaaatacaacaatgaagtagcaatactgtggtataatcaattgttttcttctctttctacgtaattataattgttctactatagaaaagtttaggtgctaccattgcttttaggataatcagatatgcagagccaaaaactgagacatatttttctccctaggaagaatttcagtgttggctgtacattcatgtgtgaacaaagccaaagaagatggcaagagtaaaatatgggtttgctatatccaaagcgggacaaaatgagcttccggggaaatgagggtagagaaatatcacaaactatgagatgtcaagcggtgtttgaaaatctaaataatatctgatggtagccaagacatgcctataaaattgtttcttacatatgacaaacagttgtttgtctttctggatttgtaccactttcccactgattcttcatcataacttaataccagactctaacctacaagcactttaaaagatcatagctatgttatggtgaagatccacaattaaggtagcaatcaatagatgctccctaaatttcaatgtggaataacgagggagcagacagaaaaccaaaaggcacactgaacaaaaagaataatgttgctgggcacagtagcgcacatctatagtcccactggctagggaggctgaggtgggaggatcacataagcccaggagttcaagactgaagtgaactatgatcacaccactgcacttcagcctgggagacagagtgagatctcctctcaaaaaaaaagaaaaagaaaattgttgaactggaaccaaatctcatagtaacaaagtttcacattttaaaatttcagagggaaaacctactttaatcactaaaaatctacagtctgagcatggctagttaagtttttgactacacattattgtcttggtaaaccaaatattgacagaatcttccagcttttttcatgctcaataaccacactaaatttgaaatattatgatattagccctacataagtttggatgatcttagtccttcacagttttccctacttttagacttcgttctctaatagactttcatgccattcaaatattgctttttttaaaaaaaaatcctttattatctacccctaggcatcatttcacacatcctttacacctaaaatgataaacatctgattcccatttattgaacaacatattttcattctaaatactcatttaatctaacatcttagagaacatgtgtttaaaaacataggctctatggttgactctctaggttgtaactcatgactatgtgactagtgtgactgtaagtttctttattttattttatttattattattattattatttttgagatggggcctcactgtcacttaggctggagcacagtggtgcaatcatggctcactgcagcctcgacctcctgggctcaggtgatcctcccacctcagcctcctgagtatctgagactacaggtgtgccccaccatgcctggctaatttttgtattttttgtagagactgagtcttgccatgttgcccacgctggtctcaaactcctgggctcaagcaatctgccatcctcagactcccaaagtgctaggattataggcatgagccactgtgcctagcctccaactttcttttttttttttttaactttaagttcagaggtacacacgtgggtttgttattaatacattggtaaacttgtgtcatgggagtttgttgtacagattatttcatcacccaagtattcagcctagtacccgttggtgtttttcttgatcctctccctcctcccacctgccatcttctgataggccccagtatgtgttgtttccctctaggttaataaagtagggaataggccagttgtggtggtttatgcctgtagtcccagctactcaggaggctgacgggggaggattgcttcagcctagaagtctgaggccagcttgagcagcatagcaagaccctgttccttttaaaaaaaaaatggaaaagaaaggaagaaaaataatttaaaagttttttaaaaaaattagtgtatgcaccgccattgtagacatgtgaccacatatattcagccacagagtgtcagtatagaagtctttaaaagactgaacaaatcttatgtagcatggattgcccctccagggtacagagatgtagcttggaggcactcaggccccctcacatctgtgtacaagccttctaactagttctcatcaaaagaacatgtgaacgtaagtgatatatgccgttttctgctggtgctattaagaagcaggtagggatttttctctctttccccttttactggttagaggcagatgatacagaagtcacacaatggaatcagctttttattcctggatcccagaattaccaggtagatgaaagctgcccagcaaccgggaacacacacattggattatcaggtgactgagcaaaaaattttttattgtgaatacccccactgaaatgagggggtttctttgtcacaacagcaaatgacagcttacctaaaacaatcacttctcctatttttattttcatttgttttgatgagaacttgcattcgtataaggaagcttaagcttaagttcactgctttgaggcagatgggtacatcttactgtctactgtcagaggtagttgggaaataagaaagggttggaagagtgtacctgggaccaatgctaattttttgaaaattctgtgagctgaaaactctaagaacaaaaaacagtcttttctgttcacttaaagctttaaaaagcactgcataaaaaatttcatgagagttactaaaaggagacatacagtgttattcattctatccaaaatcattctgatttcctgatttttctccgtactttcaaagtcctaacacccttaaaaatatactaaatgaaataatagaaatgtaagaatctcttatgaaggacacataaatccccctaaagttgaaatcaatttaatcctttttgaagctgctttgttcaacctctgaaaaacatatgcatgtttaggaaaagtgggtttttttaaggatgagttcatgtccttcacagggacatggatgaagctggaaaccatcattctcagaaaacgaacacaggaaaacagaaaaccaaacaccgcatgttctcactcataagcgggagttaaacaatgagaacacatggacacagggaggggaacatcatacaccggggcctgtcggggggtggggggctagaagagtgatagcattaggagaaatacctaatgtcaatgatgggttgatgggtgcagcaaaccaccatggcacatgtatatctatgtaataaacctgcacattctgcacatgtaccccagaacttaaagtacaataaaaaataaaaaaaagaaaagtgatgttctttaatttttaattttaatttttgtgggtacatagtaggtgtatatatttatggggtacataagatgttttgatacaggcatgtaatgcattataatcacatcatgtaaaatagggcatccatcccctcaagtatatatcctttatgttacaaacaatccaattatactcttttagttatttttaaatgtacaattaaattattattgactataatcaccctgttgtggtatcaaatactaggtcttattcattctttctaactaactttttgtacctattaaccatcctcacctcccctgccaccctcctactatccttcccaacctctggtaaccgttctcttgctctctatcttcatgagttcagttgttttgatttttagatctcacaaataagtgagaacatgtgatgtttgtctttctgtgcctggtttatttcacttaacataataacctccagtcccaaccatgttttgcaaatgacaggatctcattcttttttatggctgaatagtactccattgtgtataagtaccacattttctttatccattcatctgttgatggacacttaggctgcttccaaatcttagctattgtaaacagtgctgcaataaaaataagagtacagatatctcttcaacatactgatttcctacaaaagttctttttaaaatcagcttctcaaagccaatccagccttttaggtaaatacgttactgagtttatttttttaaaggcacattatatatttgatagatcacttgaatcttgtctagacatacagactgccttagacaagtgatgtttccttattcaacagactagaatttgtgttatttggcaagtttgcaacacacacacacacacacacacacaccgcagtgagactataactatgacccaaatctgtgttactttaacacagaattcctcaaccccagcactattgagtttttggggccagaaaaaaactttgggttaagattttttgtctttttcttttctttgacacagagtcttgctctgttgcccaggctggagtccagtggcatggtcacagctcactgcagtcttgacctcccaggataaagtgatcctctcacctcaacctcctgagtagctgagactacaggcatgtgccaccacacccagctaatttttgtcttttttatttatttatttatttatttatttttgtattttttgtagagaccaggtttcaccatgtcggccaggctactctcaaagccctggggctcaggtgatcttcctgcctcagcctcccaaagcacgggggggtggggcaattaccggtgtgagccactgcacccagccaagacctttagtcttaacaagtaattctgtgttgtgggggttatcttttgcattgcaagatgttctcacatccctggcctctacatggtagataccaatagcactcacttccccttttaaacacaatataacaaccaaaaatgtgtctaaagattgccaaatgtcccctctagggtaaaactgcccctagttgaaaaccactgcaccagcaaaaagcttccatttctcttggaatatcagaacgtaaggatgtactaagcttacaaagcaagcatctattatgaagctaaatctgaacttcaatggcttaaacttctgctgaagcagtggtgctagactatcgtctacagcttttactttacggattcagtaattccttcccaatctcaagttcctcttttaaaaatttcattaaaagaaaacttaattctgtttaactcttcagaaactgaagaaaaaaagaactggattcccctaataagagttgcaaatccttcttgttgaggatagtaagaaaaagagaaaacaggtttggtacaagaggggcaaagtgaaagttaaatcgggagtggatgtttttagacatgcctgcatcttgccaaagatgagaccatgtacattttggccttaattatgtatgcttttgtctctgtgaaaaggaagacattttagtcagtgaaatatttattatgtaactattaagggccagaaactgttctagggtctttctgcaaaaagaatgagaatgtttgctccaaatataaaaaaataaacaactataagatacacagatcaatgatggaaaccattgctctttagtctcctacaaactctttgctaaagcaaagtagcaaaattgtgtctttcttaaatcaaatcgtaccaaaaattataacctcacaataagaatactttccaaaatcatcacaaaacttgattcaatgattatttagttatttactagttgctaggcaatgtggcaaatgtgtaagtttcactgcatagattcactcataaaggaactcacaaacttttgagagaagtttgatttacagcagcctacactccagccatattaaagtatttgtacttcctggactttcacctatatttcatatctctgcacttctacacagagatatgaatactaatcactctatacatagaattacatttcccctcttatctgttctatcttagataaaaatgcagcaggactagtttccaagacaacaggtcacaagacatcactggtaaaacaagagacagtgaaggaaactggccaaaaccagctagaaccaaaatggcaatgaaagccatctccagttaccttcactgctcattatatgctaattataatgcattagcatgctaaaaaacactccttccagtgccatgacaaatgtcatggcaatgcccaaaagttaactctgtatggtctggataggggagaaaaccaccgttctgggagctccctgctcctttcccagaaaactcatgcataatccaccccttagtaagcatatgtaatcaagaaataaccacaattataaccaatgacgagcctgggactggggggatagggtgctctgcctatggagtagccttccttttgttcctttgttcttccaataaacttgctttcatttctctctgttggctcactcttgaattctttcctgcacaaagccaaagccaaggaccaacttggccttctgagttgagccccaattctgcatttcaccttgcaacatctccaccttcaaaatgtaaagcccttcatgaccctttccccaaatggagttgatcacgttccccttttacctttctccatagctgtacatgtttactgaattatcactacgtaaggcaatcacttgctcatatgtttctctctcctcctatacctagtttcatgaatacttgaatgctatctttaaatgttgtaaccttgtaaaacagtacaacaaattaatgttagatgtatgacaaaatgaatgaacaatatatgaagtgaagactattattacatgatgaaatgcttaactattacaatctggctaagatcatccttttctttaatatccagataaaatgtctcaagccctcatcatacatgctttccaggattttcaaagattcccaggagctttacactctcaggacacctctcatggaattctcactcactgtcttctatacttgccatgcttttcatatatgctcacgctatatgtctccaccacacctcctctactattctccatacttgactaaaaaaaatccataacatttgtactaaatattagcgataacagagaaatacacaacaacacagaatatgaaactaataatatttcatgtcagatatccatgttcagcctattactttattatgcagagcaattagctatcactttccatccaagactagagtctaagtatacctttgcataacttaagaggctcattaaattacactgtaaatacagtgggccctacatattcacagattccaaatccacagactgaaccaactgcagatcagaaacattggaaaaaaattaaaaataaaaaataacaatacaacaattaaaaataatgcaaattttaaaaatgatatattataacaactatttacatagcatttacattttataggtataataagtaatctagagatgatttaagctctatatgggaggatgtgtataggctatgtgaaattaaataattcaaatttaaatctattggaactttatattattctgagccttgacaggaatgtagctatgtagcccgagtcacatggcatatgcagctgcaacttctgactttttttcctgtaaatattaataattaggaaggccacatgacaacagagataagattcccttagatctttacccctcctcattgagtaataaagtaaacttccttggaatatagcaatctgtaaccaaacaaatcattgtaattggtcttatatggaaaatgctttaactctgccaaaacttctctggctttgtctatatacttcaggtatatgcaaatactatgccattttatataaaggacttgagcatccatgattttggtatccatggagggtcctgaataccagaatgtgactgtattttgagataaggcctttaaaaaggtaattacattaaaatgaggccatcagggtggaccctaatccaatacgaccgctgtccttataagaagagaaaatttgaacacacagagtcaccaggaatgtgtgtacacagaggaaaaaccatgtgaggatacagctaaaaggtgactgtgtgcaagctaaggctttggaagaaaccaaacttgttgactcctttatcttagactcctagcctccagaactgtgaagataaaaatttctgctgtttaagccacccagtctgagttcttttattatggccatctagcatactaatacacctcccctaaaaaaaggcaaaagactttaacagatacttcactaaaaaaagatctatggaaagcaaataagcacatgaaaagattattaacatagtcattagggaagtacaaattaaaaccacaatgagataccactaaattcttgtaagagtagctaaaattaaaaacattttttaaaagtcttactacaaaatgcctgtgaggatacagagcaactgaaactcttattcattgctgctgggaatgcaaaaaggtacagccactctgaaaaacattctggcaatttcttataaagttaattatatgctaccatatgacctagaaatcctactcctggatatttatccaagtaaaatgaaaacttacattcatgtaaaaatcagagcatgattatttatggcagcttttttcatcataatcaaaaattgcaaacaactcaaatatccttcagctaatgaatagaaaagcaaattgtgacacagccatatattaaactattcagccataaaaataaataaactactgatacaaacaactggatgaatcctaaacgcattatgctaagtgaaagaagccacacacaaacagccacattattacatgattccatttatgtaacattctgaaaaaagacaaaactacaaggatagcagacaaagcaatcattgccagatatcaggaagaggagttaaccacaagggacagaagtgaattttgtgggtggtagaactgttccatatttttattgtggtggtagatacacaactgtatgcattttcaaaactcatagacctgtataaaacaaacagttaattttgctgtatgcaaattatacctcaaaaaaatctgtcataaaaaaattcctacctatggcttcctccttcaaaaaacacagcatacctaggaagaaggtagggaagatgatgggtttaaaataccaaattaccaaagactatatccctatagtacttcagtgaatataaataatttaaattaaaaagcatggatatatagaggtatttaatttttaagattccagtcaaaaacaacaaaaaacgttaacttccaatattagaaatagtcacttatctgaaactcttaatttcaaagatttctgtaattttgattattcattatcatgactttatattcattatcatgagttactgaatggtgaaagttcaataaatacagatgaaagcaatgaataaaagcttccattggattttcaaagatcagaagaagtttggatttaatctgaatggaggtaagaaatcactatcgtttctttagaatgagggaacatgacaaaatattatgttaggaaaattagtctagtaatcatatatgagattgagttgaaggaaaatattaaagcaaagatatagaagatagctgcagtgatgaagagggccggggccaggatgatagccagaggattgtaatcattatattcaaaatgtgtatcttttccatatttaactgaatacccagaaatgatgtcacatttgctacacaaagttcatttgaaattgaggctcaggtggcaacttggcctataaaatttaaacccgcgagtgcacttgctcacccagactgcagcctgagtcgtccccacccacccttcctatgcagaaaccgtggtacagcgcagaaaccgtggtactgctccatgcccaggcagatctccaggcactaaagcacctgctcacctggattgacagcctgagccatcccattagtcctgtgcaaaaatccagccatcagggggcactctctgctggttcagcagccagagacacccactgttcttatgcagagagagtggtgcagtgggtccctctccaccccactcccagacagatctccaggcagtcggagcacccactcctccagcctgagctaccccacccttcctgcacaaagatcatggtgcagcaaggccctttccaatccatacccaggcatatctccaggcattgaagcacttgcttgcctggaacagcagcctgagctgccccacccttcctgcaaagagatcgtagtgcatctgagccttctttgcaccatgccgattaaacttcagatctccaggtgtttggagaacccactcacccagatcaacagcctgagccaccctacacttcctgtgcatagatcgtggtatagtggggccctatgtactccatacccctgcatatctccaggcattcaaagcacttgctcacacagagttacagcctgagccaccccaccctcctgtgcagagtttcaggtacaggggagcgcctctccactccaccctcaagcagatctccaggcattcagagtacctgctcacctactcagcatcctgagccgcctcagccttgctgtgcagagattatgatgaagtagggccctctctgtcccatgcccagcgatacctccaggcagtcagagcacctgttaatctgatttaacagcctgagctgcccaacccttcctgtgcagagactgtgtggtgcagcagggccctttacactccacacccaggcagatctcaaggaatctagaacactcactttcctggactaagagtttaggctgctccctctctccctgtgcagacaacttggatccaaggaggtttccatctcaacacctaggcacacctctcggtggatgctcactacattctccctcagtccagatgtttgtacctgccatcaggaaacctgtaggtgggcctaccccgtatggccccacccatcttgctcccaccccacccccgggggcaaagcagggagctcagaccactgtgcactccatgaattagcccactgcctgaagcaacagagagcttctcccagtaaacaatgatcaaatatatacccagctgcactgaccatagccagcttgtaggtcaaactgcacagcccaatataaaacctgcatagcccaatacaaaacctgccagtaaagtgcagccctatagtgcgtagggctataacagaaaagccaaaagactacccatcattgtctacagtcacacttcctaagaagcggggaaagggaaagggagagaaaacaatattacaaggaaagaaagcaaagaaaatatcctccctgcaagaaaataattacaaaaattagaagtaccagtgactacagatgagaaggaaccagctaaagaattctggcacctgaaaaacctggatgaagcaacaccactaaaagatcacactagctctccagcaatgatacctaaccaaaatggaaacatagaagttacagataaaaaattcaaagcacgaactgcaaataagctcaatgagatggaagacaaagttgaaaatcaacacaaagaaactgctaaagcaatgcaggacatgaggaaagagataaacatcttaaaaataaatcagtcagagcttctggaattgaaaacttgcttaagaaatttcaaaatacagttgaaagctttatcaattgccaagatcaacatgaagaaagaatttcagagcttgaagataggtctttttgaattaactcaatcagacaaaaataagaaaaaactatttttaaaaatgaacaaagtcattgagaattagggaattatgtaaagtgaccaaaaccatgaattatcaaaatttctgtgagaggagaaaaagtaaacaacctggaaagcatatttgagagaatacttcaagaatatttgcctaatcatgctagagagctagacatctctagcaagatgtatagtccggtgactactcaaggtcaatgttataaaaaaaatcttaagggcagctgggaaaaaacatcagatcacataaaggggaatcccatcaggctaacagcagacttctcagcagaaaatttgtaagccaggagagattgggagctcattttcagcattctaaaaagaaatttcaaccaagaatttcatatcccactaaattaatcttcataagtgaaagaaaaaataaaatcttgtccagacaagcaagcactaagggaattcattaccactagaggagcctaacaagagatccttaagggagtcttaaacatggaaatgaaagaacaataactgctaccacaaaaacatacttaaataaatagctcacagaacccataaagcaatcacacaatagaaactacaaaacagccaggtaacaactttgataggatcaaaacctcatatatcaatattaaccttgaatgtaaacagtctaaacacccccacttaaaaggcacaaattggcaagttgaattaaaaaaaaaaaaacaagacctatcgctcacacacacataatgacacccataggctaccaagtaatgagttgggaaaagatctatcatgtaaacagaaaacaaaaaaacggcgggagttggtattcttttatcagataaaaccaactacagtaaaagaagacaaagaaggttattacacaacgataaaaggtttgattcaacaagacttaaatatcctaaatatatacagactcaacagtagagcacctagatttatagaacaagtacttctagacctaccaaaagacttagccacataataatagtgagggacttcaacatcgcactgacaaaattaggcagatcactgaggcaccaactaagaaattctggacttgagattgacacttgaccaattggatttaatatacatctacagaatattccactcaacagccagagaatatataatacattcttttcacctgtacatggaacatactctgagattgaccacatgctcagcaataaatcaagtctcaataagttcaaaaaaatgaaaatcataccaaccatactctcagggcacagtggaataaaaatagaaattaataccaaggagacctctcaaaaccacacaagtatattaaaattaaacaacttgcttctaaatgacttttgggtaaacaacaaaattaaggcagaagtaaaaaaattatttaataaaaacagagacacaacatccaaaattttggggatgcagcaaaagcaatgttaatttataatactaaatgcctacatcaggaatttagagagatcttaaattaaccatctaacatgacacctagaggaactggaaaaacaggaacaaactaaccccaaagctagctgaatgaaagaaataaccaaaatcaaagcagaactaaatgaaattgaaaccccaaaatacatacaaaggatcagtgaaaccaaaagttggttttttgcaaggatagacaagatcaatagaccactagctagattaacaaagaaaaaaagaaagaagatccaaataagtgcaatccaaaatgacaaagatgacattactaccaatcccacagaaatacaaaagatcctcagagactattatgaacacctcaatgcacataaactagaaaatctaaaggaaatggataaatttctggaaacaacctaccaagattgaatcgggaagagattgaaaccctggacagaccaataacaagttccaaaattgaaccagtaatacaaagcccaccaaccaaaaaaaaaagccctggaccagaagaatttacagtcaaaattccaccagatgtacaaagaagagtttatagcaatcctactgaaactattctaaaaaactgaggagaagggataggactcctttctaactcatgctacaaaagtagcatcagcctgacaccaaaacctggcaaagacacaaaaagataagaaaactacaggccaatatccctgatgaacacagatgtaaaaatccgcaacacaattgctaggaacaggcctcaagcctggccataaacaggccatgagaaacaagccataaacaaaatctctgcagccctgtgactgcagagatttcttgctgctatgatggcttgatggctatgatgcccatgctggaagttgccggtttaccagaatgaggacaaggaacacctggcccacccagggcagaaaactgctcaaggcgttcctaaaccacaaacaatagcatgagcaatctgtgccttaagaacatgttcctgctgcagataacaagccagagcctgtccctttgtttcctgtaaggaatgcttttagctaatctataacctatagaaacaatgcttatcactggcttattgtcagtaaataggtgggtcaaactctgtttgaggctctcagctctgaaggctgttagctccctgattcccactttgtactctatttctgtgtctttgtcttaattcctctaacgccgctgggttggggtctccatgaccaagctggtcttggcaacgatactagcaaactgaatccagtagcacatcaaaaagttaattcaccataatcatgtaagctttattctagggacgcaacgttggttcaacatacacaaaaaaataaaactaggcctagtttgttaggagttttttatcatgaagcagtgttagattttattaaaaggtttttctgtgtccatcaagatgatcatatggttttggttttaattctttttatgtggtgaatcacattttttttgtacatgttgaaggaagagacctcaaaataataagaaccatctatgataaacccatagccaacatcatactgaatgagcaaaagctggaagcactcccctggagagctgaaacaagacaaagatgcccactctcactactcatcttcagcatagtactggaagttctagctgcaacaatgaggcaagagaaagaaataaaatgcatccacataggaaaaaaagaattcaaatgatctctcttcactgacaatatgattctgtatctagaaaaccctaaagactctatctaaaggctcctgaaacagataaacaacttcagtaaagtgtcaggatacaaaatcaaagtacaaaaatcagtagcagttctatataccaataatgttcaagctgagagtcaaatcaagaatgcaatcacatttacaactgccccaccccaccaaaagaaaagcaaaaaacataggtatacatctaaccaaggaggtgaaagaaagatctctacaaggagaactacaaaacactgctcattgtagattctggatattagccctttgtcagatgagtaggttgtgaaaattttctcccattttgtaggttgcctgttcactctgatggtagtttttttgctgtgcagaagctctttagtttacttagatcccatttgtcaattttggcttttgttgtcattgcttttggtgttttagacatgaagtccttgcccatgcctatgtcctgaatggtaatgcctaggttttcttctagggtttttatggttttaggtctaatgtttaagtctttaatccatcgtgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtagatatacggctttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcggcctcttttttggttccatatgaactttaaagtagttttttccaattctgtgaagaaagtcattggtagcttgatggggatggcattgaatctataaattaccttgggcagtgtggccattttcacgatattgattcttcctacccatgagcatggaatgttcttccatttgtttgtatcctcttttatttcattgagcagtggtttgtagttctccttgaagaggtccttcacgtcccttgtaaggtggattcctaggtattttattctctttgaagcaattgtgaatgggagttcactcatgatttggctctctgtttgtctgttattggtgtataagaatgcttgcgatttttgtacattgattttgtatcctgagattttgctgaagttgcttatcagcttaaggatattttgggctgagacaatggggtttctacatatacaatcatgtcatctgcaaacagggacaatttgacttcctcttttcctaattgaataccctttatttccttctcctgcctgattgccctggccagaatttccaacactatattgaatagaagtggtgagagagggcatccctgtcttgtgccagttttcaaagggaatgcttccagtttttgcccattcagtatggtattggctgtgggtttgtcatagatagctcttactattttgagatacgtcccatcaataaacaaccccatcaaaaagtgggcgaaggatatgaacagacacttctcaaaagaagacatttatgtagccaaaaaacacacgaaaaaatgctcaccatcactggccatcagagaaatgcaaatcaaaaccacaatgagataccatctcacaccagttagaatggcaatcattaaaaggtcaggacacaacaggtgctggagaggatgtggagaaataggaacacttttacactgttggtgggactgtaaactagttcaaccactgtggaagtcagtgtggagattcctcagggatctagaactagaaataccatttgacccagccatcccattactgggtatatacccaaaggattataaatcatgctgctataaagacacatgcacacatatgtttattgcggcactcttcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaattgaacccatggacacaggaaggggaacatcacactctggggactgttgtggggtggcgggaggggggaggaatagcattaggagatatacctaatgctaaatgacgagttaatgggtgcagcacaccagcatggcacatgtatacatatgtaactaacctgcacattgtgcacatgtaccctaaaacttaaagtataataataaaaaaataaaaattaaaaaaaaaaacaaaaaaaaaacaaaacactgctcaaagaaatcagagacaacacaaacaaatgggaaaacattccatgctcatggataggaagaaatcaatattattgaaatggccatactgcccaaagcaatctacagattcaacaatattcctatcaaactgccaatgacatttttcacaggattagaaaaagagtattctaaagttcaaatggaaccaaaaaaagaatttgaataggcaaaacaatcctaagcaaatagaataaagccagaggcatcacattacccaacttcaaactatactctaaggctacagtaaccaaaagggcatggtatttgtacaaaaacagtcacatagaccaatgtaacagaatagagagcccagaatcaaagctacacacctacatccatttgacaaagtttacaaaaacaagcaatggggaaaggactccctattcaataaatagtgctgggacagctgactagtcatatgcagaagaatgaaaccagacacttatctttaaccacatataaaaattaactcaaaatggattaaatatttaaatgtaagacctcaaactataggatttcctaggaaacaccattctggacattgactttgggaaataatttatcactaaatcctcaaaaccatttaccaaaaaaaaagtgagaagtgggatctaattaaacagaagagcttctgcaaaggaaattatcaacagagcagacagacaatctacagaatgggagaaaatattcacaagctaggcatctgacaaaggtctaatagctagaatttataagaaacttaaacaattagataagcaaaaaccaaataaccccattaaaaagtgagcaaaggacatgaacagacacttctcaaaagaagacatacaggtggccaacaaacatatgaaacaatgctccacatcactattcatcagataatgcaaaataaaaccacaatgggacaccacctcacagaatggctattatgaaaaatgaatggctattatgaaaaagtcaaaaaaacaacagatgctggcaaggctatggagaaaaaggggatgcttatatattgttggtaggaatgtaaattagttcaacccctgtggaaaggagtttggagatttctgaaagaacttaaaacaggactatcatctggcccagcaatcccactactgagtatataaccaaaagaaaataaatcattctaccaaaaagacacatgcactcatatgttcatcacagcaccattcacaatagcaaagacatggaatcaacatagatgcccatcagtggtggactggataaagaagacacagtacatatagaccatggaatactatgcagccataaaaaagattgaagttgtgtcctctgcagcaacatggatgcagctggaggccattatcttatgcaagttaacacagaaacagaaaaccaaataccacacgttctcatttataagtgggagctaaacattggatactcatgggcataaggatagcaacaagctttcttggggactagtagaggtggggacattgggaactactagaggttagaggaagaagaggagtaatagctgaaaaactacctattgtgtactatgcccactacctgggtcacaggatgaatcttagcccaaaccttagcagcttgcaatataaccatgtacatgtacaaacctgcacatgtaccccttgattctaaaattaaaattaaaacagaaagaaagataaaaacctccctagtgactatgctgacccatttaaggtcacagcaagagcagcagtacccaagttaggtggtgataacacagtggaagttagacccagtgatgatagaaattaaacccaattttactttctcatccttggctttttgttttctactagtaacaagtgttaatctcccctttgaacaggagtatgtggcttcactgcagcactttcagtcagagacagaggctaacggcatacctagccaaagcacaagaaacctaaaaggcctcagctttggtctgattccactcagaaaagctttccttcaaataagtcaactagacgtctcttccttttaaagccaacagtgatcatctgataggaaacacttctttgttggttttcttttgtttcagtgaaattcatattttccctacagggatataaataatgccgtatcttctgctatttaaaaattcctaattagaagccttttatgttataaagctgctaaaaagcaacccaaacctaagggaattttaaaagataagttattggtgacatagatgttacaacttaagctatgaagtcaaaagtgttgattgatgaggcacagaaggagtcttgttcacactcattcacctgtttcatttttgagactgtccatgccctgggaacaagaatctactttagccagaaatacataggcgtgctggatgaagttgaagtttgcctccagaattaaggtctttttgtatatgtcacctcatatctgataaacagaccacttatctggattctgatcttcaccatcttcttttactatatgggttcatgaccctccacccttcacctagtactcaattccaatagatcttctagttcttgatagtctagatatttaaccactacttttgcttcactgtgtcttcctaattcctgtatttttgcttcatttcttacctgtgactttcacatctagtatttgtatctacattcaatttctgcttccctaccatactttggtaggtccccaagtttaacctctatgtgcctcagttttctcattcatagaatgagaaaaacagtaagattattgtaaaagtatttcaaggattacaggaaataataagtaaagtgattagcataacctgagatagagaaagtgccaaataactgctagctgcactcaagcatatttatgcctgaataagagctttgtcctctgattttgttctacatttgtggaaatagataatagccatttgctaccttaagagaaattcctttgttttatatatgaagaattattctcttcttacctttctcttctaagggttaagtaaattcattttctttctaatgaatcatgttttctcacactttagtcattttactactttcttccaaggtctccaatcttattttagttgtagaaaaaaatacaaatctccagtaatattgataccaatccaaaaagtatttaactaaacctatcatcccaaatgattacctggcacccccagccatgatgaggccccatcagtgtcccaggcaatgctccccattctgcccaatgcttcagaggaaccaagatgctactgactgcactaagcaccaaagagccactccagcacttggatccaggaagaaatagcaacaccaaaaaagcctgcgaaagtgtcagttttctgtgcatagttcagttaacagctagataacaccaatcatccaaggcataactgttataggttttgacagtaagacatcccccttggcaaaaaatgtctcctccactggctgccaaggctcctgatcatcctaggatcacctcctgtgtgttgattaagcttttgctggctgagacgcagctggcctttacagcaggaaacccacggaagagtgtgtacgtgtgtgtcctctctcaacttctggctgagtcactcaaatcaaatagtcactgaaacataaagggggttccctacacctaattttggtggtaggggaaaaaatgtaaaatcatctggggcaatcaaggactattttcaggaacatttgtctttaaaatctaaaattaagccacctcacaacctgggtggttccccatggaggaaaagaggatgagctctgaaaagctagagttgtaacctgtatccttgggaacacggctataggcagtgtgaagagctgtacatataactgataaagggtccagcaggttgtcccattcctgcaggaagagcagagccccaaatcccatttcaacctgctttagcactcacacacctcaccaagacagtggtgactgccagcttctctcttgaccttcctcacccctaggtaccacaggatgtctaatgggaaggcacaagagcataaaacttgttgctctcagagttctatggatgaggaaactctgaaatatgaggacagatgtgagagaatctctagaaaccttaagcttaggacagaaggaggagagcatcccgctcacactgtctaacaatttaatagggattcatgcatctaagtatgtttgtgagggaggtagatgttaagaaatcatacatacagaacctcgttgagtttcgaaattggaggttcttgggcaacaagggacagcatggggtaacagactgtttggggaggagaggaagggaaagacaggaaatgaaaaattaagcacctggctagaacagtacagggatacaaggatggtatttgggaaatataccaaaataattaacttttgaaagcaagaaatgaagacattgaaaggaaataaatggctctccaagaaccagaaagacaagtatgaaatgggcaagactctatgggtcagagatcccttgcatcagctgatttctttcttctttttgagacggagttttgctcttgttgcccaggctggagtgtagtggcgcaatcttggctcactgcaacctcggcctcccaggttcaagtgattttcctgcctcagccccctgagtagctggaattacaggcacatgccaccaagctcagctaattttttgtatttttagtagagatggggtttcatcatgttggccaggctgttctcaaactcctgacctcaggtaatccacccacctcggcctcccaaagtgcagggattacaggtgtgagccaaagtgcccggcctcttttttttttttttttgagacaaagtcccttctgtcacctaggctggagtgcaatggcacgatctcagctcactgcaacctccggctcccaggctcaagcaattctcctgtctcagcctcctgagtagctgggactacaggcgcatgccaccgtgtccagctaatttttgtatttttagtagagacagggttttgccatgttacccaggctggtcatcgcatctggctaattcttgtatttttagtagagatgtggtttcgccatgttgcccaggctggtctcgaactcctgagctcaggtgattcgccagcctcagcctcccaaagtactgggattataggcatgagccaccacgcccagatggatcagctgatttttttatagtacttgattatttttccctaacatgtatcagtacagctagtatcacataggtaaaaaaccaaactaaattcctttttatagaacaattatttctatatccctgttaatgtatcttttacagatttccctgggagtcttttctttatgtacctaagatttaaatttcacttgcagtagtaaattatttaaactcaattcaaaatgaaatgtgttttcatttaattatcggaaatgcatttcataatgccaagtgctggttaaaagtaagtaatttcccccattcctcacccaagccacctctgcaccaccacccacaaaaacaaattagtctttttggttgagaaaaatgaatcattacttctcaacctaagttgcaacttgtcatttttcatttgagcatgtattcactagaagcaggtgctctttgctcttttgacagtaaccaaacatttaagcgtggaaagagaccaagaaaagcaccttggcccaccttctcaggggcttagataagtatctggaaaaaaatcaatatcatggaaatgaagtgccaaattgttttaaaactgcttagctctcactattgctcctaggactgaatgcaacaaaaccaattagcaggcattcactgaggcaggaaatagagtggaaagaaagggtagaaatggagaaaatgaggaaataaaaatatattaaatttatatatacttaagtatatttataatacatgattttatatatatatatatatacacacattaggtgtgtgtatatacatatattcattcattcatttaaattttggacatgttgagcttgaaaagcccattaagtaactagataaagttgctttgggttccacatttaagtgagatcatgtaatatttgtctttttgtatctaggtcatttcattcctcttgaaaagaaaactcatcacaggtatctttaacacaaagcaccaatcttaatgtaattttattctcatgtattttcccactggtcataaattttgaaggccctaatttgctttccattgcccatgttctaatctgaattcatccaagagtgaaactgatgcgaaatctcatcttctatttctcttaatgttaagcactttgtttcttaaattgatgctgtagacaatttatgtagccaaacagaaatgtcacaacaattttgggaaacatctcaagttatttgtttcaaagaaagaaaataaattattttaccaagagataagtgaaaacattgtttttcaatccctttaaacatttatgatcgaattctggatagccaaggtgatggcagctgcttaagtctgaatctcccagcacatactccaaaaataaaaataaaaaataaataaaactacagaaaacctatgctgtcagcataactagaaaagagagaacaacctagatttcaaattacacgtgaataaaaaattaacaccaactcttagcatggaatttctcacccttctggtgcaagcctacctggggaacaagggcaagatggggccagagtggagggatggtgggagatgggggagaaccatactgaaaacagaagagagaacctagcaatgaaatttaaaattgatctaaaatcacagctataaagagaaattctactctcattgcaaaaataatggaaaaagagtcctggtagatcagagcctactagaaggaggaatgagtatgtggggctctaagaggtggtcttagaaaggccttgggagagagaagggtaacaaaggaatggagaagcactctggaaactacacagtgaacataagaagaaataagaaagggaaaatcagaatccagtaagacaaaagaatttttcttaattgaagaaagctactgaggaaataaactatcttttacaaccttaacagaagagttctaaccagggatcttgtaaaccatcccaaaccatcacagaattgctgaggcttaagcaacctacaagtattctaaaaagaaaaaaaaactaatatgacaggaaaacagaaataaaaattttaaaaactcagttgaaaatatcccctcaaaaaaaccaatagtgaatcaaaataaaatagtagcataatatcccaaagtgaatcaaacagcctcaaaagattatgaagactttcaccaaaattacagacagatatagatagaaataagaatatagatatacacaaaactgtgcaaccatagttcatttggcaaccatttattaaaacattaaaaatcaactttgtccctggcactgtcctagttgttggggaatagagaggaaacattctctatgacttcaaggagcttattacagtagaaggagaaacacatacagtatgacaagtgatgggataaaagtatacaggaaatcctttcgaaacaccataaagtagtatctacctccaaattaggagccatcacatatgcaactgaagtacaagtaagagccagatcagaaaattccaggaggaaaataatcatgcagctgtaacagtatatgcaaaggcatgaagtcagaagaaatgtgatgtattcaaagaacggaaaatactctgatatggctgaaaacaaagctctgggaaaataaagggtcacagttgctttatacaatttagatttcattctaaaggcaacagagaaccagaaccattgaaggatttttacttgaggatatgttcagattttcattttaaaataatccttccagtaataatatttaggctgaattagaaaggggtgaatttgaatgcaagataaccagttagcaggcattcaccaacaaggaatataagtggaaaaaaagtataggaatggaggaaagaaaagataatatattaaatgtatataaaaatgtatttacaatatatgatatataatacgtttaaattttggacatcttgagcttgaacacctcattaagtaactggataaaatcttgaattgaagagaaatatatggggtagaaataaagatatgggaatcatccaattgttagattaaaggcagttattgactccgtgggtgtatatgattttactctatagagtatacagagggtgtaggggaaagaaagaaaaatgagaaggagagaaaaggaagagcaagttatgttctgggcaatatcaacatttactctgacaggaactgggaagagtccagacatgtaggagaaaaattgggagaaaaaaaaagaaaattaagatttacaggaaaaaagaacagttgaagttaaaaggtctgaaaaatgtcagttggataagtgatcataataacagtgtttgtgcaagtgaaaggcagaaatagattactgagaagtgaaaagtcaagttaataaaaaatagtatatacaaacctctccttagaaatgtttgacttctgactcacttgtatacttaacctttcatatcattcatttctccaacaagtgtttattgagtgccacttaatatcaagagagacaatgtgcttatgtcccaatggagaagccaggcaataaacaacttaaagatcaaatgtgcaagataatttcctacagtgataactgctatgaagaggcgaaagtctacattagattaatcagagaaatccactgtaaggaagtgatacttaagctgaaccctgaatgataagaaggaattgtcctgtgagctctaggggaaaatcattccacgaagagggaacagcaagtactaaggacagattagcaagcacataattaaaacatccacagtaataactatactgatacttacatccacccaacaactgctaataaaaccatgccttcactgagtctgctggcagggctgttgagctggtcacaaggaggcaaataagctggctcatattgaaataagagaggaaggaatcatagaaaaagaaaagaccatggaaacctcccctcctctacaattaacaattttaaactgttgggagtatttcatgttcattgaatgaacaaaaatgttaataatagattgccctaaatcttgaattttagctgcattttgaagatccttgaagcaataaaaatgcctgtgctttttaaaggtagttttgttttgtttttttaaaaggcgggggttgcctttcaggccagatttctttgatttcctgtttcagaagcttcacctagctcaacgtgggggaaaaaaaaaaaaaagctcgcaaaaggaatatttgtacagcatagcttttatgttaagagtttgattttaggccggacacggcggctcacccctgtaatcccagcacttgggaggccgaggcgggtggatcatgaggtcagggaatcgagaccatcctggctaacatggtgaaaccccgtctctactaaaaaatacaaaaaattagctgggcgtggtggcacgcacctgtagtcccagctactcgggaggctgaggcaggggaatggcgtgaacccgggaggcggagcttgcagtgagcagagatcgcaccactgcactccaggctgggtgacagagcgagactctgtctcaaaaaaaaaaaaaaaagtttgattttatatgcttaacatgtattttttaaggtatatattaacatttctttttaattattttcatgattaactggaatttttgtggcatctgatacttaatggaaatagaacaccagttaacaaaactagctccaggaaacattcgactccctcgcttctgtccaaaaatggatgtagttagtaagcaggtcagcgcacctaaaatctttcagaaacttagcatgaggaaaagaagaaagacaggactgtcgctggatggggtattgctttgaaagaaggttaccattgctgctgctgttgttgccagcatcgtcatgtcgtttggatcaaactttaacaggttaatatgctgaaaaggaaaaatgagtagaaaaaaatgaaaagttgacagtaaaggcaaaatacaacttcctataaaggaaggtcctcaggggacagaagaaaatgggattcagaatacaggattattctgggcacaagagaaaactaagtttaaggatagcatactttttgtgactctgggatctcaaaatagatgctgaaacccagctatccaaaccagatgaaatgcttcatacaatcactatggattccactgaagaagaaaactgagggtttttttaattgctttataatttgaaagttgctgataattagagctatttaactcagcacaacattcttctaaatggcatcattgtgtcactgtactattttggttaaactcccactggtttaatttcagaaacatcctttgaataaaatgccaagttaaaaagaagtaatatctcattatttctttaaaataattcaattaatttcaaaaggatgtttcctgggaaagacttgtaaggtttcttttgtaggcctgaccataacacaagagtacattatagaaaatagcagcagctacctaccagtcagtttttaagagcacctttctttacacaataaatatgttcctgaggagctttttaaattttgaatgtgtattgtggaggctatttggacctgcaaaaacctgatgctgccatttactatttgtgtgttctagaacaagctactaaataggttaccctctcgaaattttctagggattaaatattttccattctatttggcctaattgggctgcctcagaaagacagactaacccatcaagaattaagaattacttcttgaactgagaattacttcttctatgaaatgtaatattaacacctgttgtggggcacccacctgttgtcaaacttcaaagatggataaagcacaggatagtttgattccttcactggctcagggcaccaaagagttgtgttgccagatttagcaaataaaacattcccagttaaatttcactttcaaaaagaataaatatttttattagcataagtgtgccccatgcaatatttgagacataattctactagaaaattattcatcattgatatgaaattcaaatttaactgggcattctgtattattttatctggcaaccctaaccaaagcaacagcttgtctcccacctggctatggcagaagtggaatacaaaagtcaaagtacatgataaagtgctgtacccacacacaccgccatctaaacctctgtatacttccaaaattacaatgtttcctgactgaggcctgcttcccctgctctcctccatgtgatcaagctccctgacaccctctctccactgacttctacccacactctggacctaagacaaaatttctgatgcccctacacactatcccagaactaaaaagactccaaggttacaacatggcagaaacattctctccgtttccctaagactcctagaagcattttttagagtcataggtccatacagggcctgagattcactggccatctcagatctcccaaatttcattgcagtaaattctatcatgtctcctaccctggaggaatgggcgggtagtggcagacagtagtggtagaccagcacaaaaacaaaccatgtctaagtttattctattcctatccaactctcctcttctccccaagttggagggtatttgctcaggaggcacagaagaggtgacatggaagaggcagtataacaacttggttatgcctattgtctctcattccaaaatatcaagaatttgccattttttattacttaggcctgatttgaaacttacatcctgtgtgagtggcccaataggggagaaaattgatattcccattatatgggaattataaggggaaaataatattcccattatatgattattgtaagaattaagtaaatcaaagacctaacctgtatagtaggcacttccacagcttcagagatggaaaatctgtattactaaataatgtccagtaggcactatctcctaacattccaacctctctgtcaataattcataaatgaatattcacatgctctaaaagttcctgttattatgtgaataatcatcacatattttctgtgaaagtgaaatgctgtgtagtatatttcttatatcgagcaccctagtagaaagtatttacataatgcgggaagagtctaccttctttccataaattgactttctttataattgtattattttttacaacccttctaaaacaaaatgatatccatgcataaagaacacagctttcatcttgcggtgtgacagactcctatgtgcctttttatttttaatagactggcctcacacactggtgggggttgtattcatgaatatatggcttatgtttacggttaggagaaagataggtttaaaaataataataaaggactttctgcctttactgaagccacgttcccagcctttcataatttactacactatctcattattttttaatgcacttgcctttttaaaaaaaatccaaaccttccaaattgttgcatgataatttttcttccttttcaacaggaggttctcacccctctgttgtctactccagcactggcccaagagaacctcttgtacaacccagttttaaagaatgattaagaaggatttcatataggtaactgaatatgaaattagttataattttgagagcatggttatctcatatgaataaaattttaattgcttataacattaaataatgaaataaatttgtagcgctgtcctaattccatcaattttggaatacagttcaaaatgagatgtagcaagtaagaaatacaaattgtatttctcattaataatcataagccatatataatatctgttgtctataattccaatgataaacacttactgttttcagagaagttctaggtaatacacactcaaccttctataagctatcttaacttttttatttttctggcataaactatgtgtctatctttttttaaaaaaattacactttaagttctgggatatatgtgcagaaagtgcaggtttgttaaataggtatacacgtgccatggtggtttgctgcacccttcaacccgtcatctacattaggtatttctcctaatgctatccctcccctaggcccccacccactgacaggccctggtgtgtgatgttcccctccctgtgcccatgtattctcattgttcaattcctacttaggagtgacaacatgcagtgtttggttttctatccctgtaatagtttgctgagaataatggtttccagcttcatccatgtccctccaaaggacgtgaactcatccttttttatggctgcatagtgttccatggtatatatgtgccacattttctttatccagtctatcattgataggcatttgggttaattaccagtctttgctattgtgaacagtgctcccataaacatatgtgtgcatgtgtctttatagtagaatgatttataatcctttgggtatatacctagtaatgggattgctgggtccaatggtatttctggttctacatccttgaggaattgccacactgtcttccacaatggttgaactagtttacatacccatcaacagtgtaaaagccttcctatttctccacgtcctctccagcatctgttgtttcctaactttttaaagatagccattctaactggcgtgagatggtatctcattgtggttttgatttgcacttctctaatgaccactgatgatgagcttttttgaatgtgtttcttggccgcataaatgtcttcttttgagaaatatctgttcatatccttcacccacgttttgatggggttgtttgtttgtttcttgtaaatttgtttaagttccttatagattctggatgttggccctttgtcagatggataggttgcaaaaatcttctcccattcagtgggttgcctgttcactctgataatagtttcttttgctgtgcagaagctctttagttcaaattagatcccatttgtcaattttggcttttgttgccattgctttgggtgtttcagtcacaaagtccttgcccatgcctatgtcctgaatggtattgcctaggttttcttctagggtttctatggttttaggtctaacacttaagtctttaatccatcttgaattaatttttgtataaggtgtaaggaaggggtccagtttcagttttatgcatatggctagccagttttcccaacaccatttattaaatataaaatcttttccccattgcttgtttttgtcaggtttgtcaagatcagatggttgtagatgtgtggtgttatttctaaggcctctgttctgttccattggtctatatatctgttttggtaccagtaccatgctgttttggttactgcagccttgtagtatagtttgaagtcaggtagtgtggtgcttccagctttgttctttttgcttagaattgtcttggctatgcaagctcttttttggttctgtatgaaatttaaagtcgttttttctaattctgtgaggaaagtcagtggtagcttgatggggatggcattgaatctataaattactttgggcataatggccattttcatgatattgatttctcctatccaagagcacgaaatgtttttccatttgtttgtgtcctctcttatttccttgagcagtggtttgtagctctccttgaagaggtccttcacatcccttgtaagttttattcctaggtattttattcactttgtagaaattgtgaatgggagttcactcatgatttgggtctctgtttgcctattattggcatataggaatgcttgtgatttttgcgcattgattttgtatcctgagactttgctgaagttgcttatcagcttaaggagattttgacctgagacaatggggttttctaaatatacaatcatgtcatctgcaaacagagacaatttgacttcctctcttcctatttgaatatgctttatttctttctcttgcctgattgccctggccagaacttccaatactctgttgaataggagtggtgagagagggcatccttgtcttgtgccagttttcaaagggaatgcttccggtttttgtccattcagtgtgatgttggctgtgggtttgtcataaatagctcttactattttgagatacgttccatcaatacctagtttattgagagttattagcatgaagcggtgttgaattttgttgaaggccttttctgcatctattgagatattcatgggttttgtcgttggttctgtttaggtgatgaattacgtttattgatttgcatatgttgaaccagccttgcatcccaggtatgaagccgacttgatcatggtggataagctttttgatgtgctgctggattcggtttgccagtcttttattgaggatttttgcattgatattcatcagggatattggccccaaattttcttttttgttgtgtctctgccaggttttggtatcaggatgatgttggcctcataaaatgagttagggaggagtccctcattttctattgtttggaatagtttcagaaggaatggtaccacctcctctttggacctctggtagaattcagctgtgaatccgtctggtcctgggctttttttggttggtaggctattaattactgtctcaatttcagaacttgttattggtgtattcagggattcgacttcttcctggtttagtcttgggagggcgtatgtgttgaggaatttatccatttcttcgagattttctagtttatttgtgtagaggggtttatagtattctctgatggtagtttgtatttctgtgggatcggtggtgatatccctttatcattttttattgtgtctatttgattcttctctcttttcttctttattagtctggctagaagtctatctattttgttaatcttttcaaaaaaccaactcctggattcattgatttttggaagggtttttcatatctctatctccttcagttccgctctgatcttagttatttcttgtcttctgctagcttttgagtttgtttgctcttgcttctctagttcttttaattgtgacgttagggtgtcaattttagatctttcccactttctcctgtgggcatttagtgctataaatttccctgtacacaccactttagctgtgtcccagggattcttgtatgttgtgtctttgttctcattggtttcaaagaatttatttatttctgccttactttggttatttacccagtagtcattcaggagcaggtttttcagtttcctcgtagttgtgcagttgagtgaatctcttaaacctgagttctaatttgattgcactatagtctgagagactgtttgttaagatttctgttctcttgcatttgctaaggagtgttttacttccaattatgtggtcaattttagaataagtgtgatgtgatgctgagaagaatgtacattctgttgatttcgggtggagagttctgtagatgtctattaggtctgtttgttccagagctgagctcaagtcctgaacatccttgttaattttctgtcttgttgatctaatattgacagtggggtgttaaagtctcccactattattgtgtgggagtctaagtctctttgtagggctctaagaacttgttttatgaatctgggtgctcccgtattgggtgcatatatacttaggatacttagctcttcttgtcacgttgattgctttaccattatgtaatacctttatttgtctttttttatctttgttggtttaaagtcggttttatcagagactaggattgcaaaccctgcttttttttgctttccatttgcttggtaaatattcctccatccttgaggaatgtgtgcctctgcacgtgcgatgggtctcctgaatacagcacactatgtgtgcctctgcacgtgagatgggtctcctgaatacagcacactgatgggtcttgactctttatccaatttgccagtctgtgtcttttaattggggtatttagaccatttacacttaaggttaatattgttatgtgtcaatttgatcctgtcattatgatgctagctggttattttgcccattagttgatgcagtttcttcatagtgccgatggtctttacaatttggtatgtttttgcagtggctggtaccagtttttcctttccatattagtgcttccttcagaagctcttgtaaggcaggcctggtggtgacaaaatctctcagcattttttgtctctaaaggattttatttctccttcactgatgaagtttaatttggctggatatgaaattctgggttgaaaattcttttctttaataatgttgaatattggcccccactctcttctggcttgtagggtttctgcagagagatccactgttagtctgatgggcttccctttgcgggtaacccgacctttctctctgtctgcccttaacattttttccttcatttcaaccacgatgaatctgatgattatgtgtcttggggttgcttttctcgagaagtatctttgtggtgttctctgtatatcctgaatttgaatgttggcctgtcttgctaggttggggaagttctcctggttagtatcctgaagagtgttttccaacttggtttcattctccccatcactttcagatatatcagtcaaacgtaggtttggtcttttcacatagtcccatatttcttggaggctttgttcattccttttcattcttttttctctaatcttgtcttcatgctttatttcattaagttgatcttcaatctctgatatcttttcttccgcttgatcgattcagctattgatccttgtgtatgcttcaggaagttttcatgctgtgtttttcagctccatcaggtcatttatgttctcctctaaactggttattctagttagcaattcctctaaccttttttcaaggttcttagcttccttgcattgggttagagcatgctccttgcctcagaggagtttgttactctccaccttctgaagcctacttctgtcaatttgtcaaacttattctccgtccagttttgttcccttgctggtgaagagttgtgatcctttgaaggaaagaggcattctgagttctggaattttcagcctttttgtgctggttttttcctcatcttcatggatttatatacctttattggtctttgatgctggtgaccttcggatggggtttttgtgtggatgtcctttttgttgatgttgatgctattcctttctgtttgttagttttccttctaatggtcaggcccctctcctgcagtgcttctggtgtttgctgggggtccactccagaccctgtttgcctgggaatcaccagcggaggctgcagaacagcaaagactgctcctgttccttcctctggaagcttcatcccagaggggcacctgccagatgccagtcagagctcttctgtatgaggtgtctgtcaactcctgctgggaagtgtctcccagtcaggaggcatgggggtcagggacccactagaggaggcagtcttacccttagcagagctcgagcgctgtgctgggagagctgctgctctcttcagagctggcagatggaatgtttcagtctgctgaatctgtgcccacagccaccccttcccccaggtgctctgtcccagggagatgggtattttatctataagcccctgactggggctgctgcctttctttcagagatgcctgcccagagaggaggaatctagagaggcagtctggctacagcggctttgctgagctgtggtgggctccacccagttcaaaattcccacagctttgtttacattgtgaggggaaaactgcctactcaaacctcagtaatggcagacatccctccccacaccaagctcaagcatcccagtttgacttcagactgctgtgctggcagtgagaatttcaagacagtggatcttagcttgttgggctctgttggggtgggatccgctgagctacaccacttggctccctggcttcagccccctttccaggggagcaaacagttctgactcgctggcattccagttgtcactggggtatgaaacaaaattcctgcagctagctcagtgtctgcccaaacggcctcccagttttgtgcttgaaacccacggccttggtagcataggcactcaagggaatctcctggtctgcaagttgcaaagaccatgggaaaagcatagtgtctgggccggaatgcaccgttcctcacagcacagtccctcacggcttcccttggttagggaaggtagtttcccaatcccttgcacttcccgggtgaagcaatgccccaccctgctttggctcaccctctgtgggctgcactcactgtctaaccagtcccaatgagatgagccaggtacctcagttggaaatgcagaaattacccaccttctgcattgatcttgctgggagctgcagaccacagctgttcctattcggccctcttgcccctatatgtctatcttaactatttttttttattattctggtgtgtgatttctctctttcgtttaatggttttcacaataaataagccttaatgccagatatcttaaaaataatatttgtagtgtcattcacttaatctaaaaatactcacaattgttcttcagtgttgccaagtttttcagtctactataagagcttgatcttagagtgtgttcactgacctcatattacatatagaatgtatacaaaaaagacctttaaaatgtagggtgataacatctattccatatatgccaacattcttagatattctcaactttagtcttctctcaaattgatcccctactgacattaaaaaattactaactttttatagcagcactgtgcacagctcttatatcaagagtaagaaataaacttttccaaaaccgcttaaaaacagagtaacattcagccaggcgcggtggctcatgcctgtaatcccagcactttgggaggccaaggcgggcggatcacaaggtcaggagatcaagaccatcctggctaacatggtgaaaccccgtctctactaaaaatacaaaaaatcagctgggcatggtggtgggtgcctgtagtcccagctacttgggaggctgaggcaggagaatggtgtgaacccagaaggtggagcttgcagtgagccgagatcacgccactgcactccagcctgggcaacagagcaagactccgtctcaaaaaaaaaaaaacaggtcggtgccaaggctcatgcctgtaatcccagaacttgaggaggctgaggcgggtggatcacaaggtcaggaaatcgagaccatcctggctaacacggtgaaaccccatctctactaaaaatacaaaaaaattggccgggcgtgatggcaggcgcctgtagtcccagctactccggaggctaaggcaggagaatggcaagaaccactgcactgaaatcgcaccactgcactccagcctgggcaacagagtgagactccatctcaaaaaaaaaaaaaaaaaaaaaaaaacagagtaacattcattagaagaacatagaagaaagaaaaaaaaatagagtaacaaagatgtcaagacattctctatatccactaggccaggtgtttggagtagaagaaaaatgcatagtgactgatacaagttactcatgagcaccaaccacatgttcacaagtggtaccttacttatcacacattggttaataccaagtctaacttaagattccttccctggataaacatccgatcatttttttatggatccaattctagcccactattttagcataacaaaggtcaaacatgttagatatcttaaacccagagttatttactctctgtttttaagacaaaaatgtttcctgatagatttcaaagagattccaaaaagacagcttcctctaaatttaaaataaagttcaggtacgcttaatttatttgcttctgtttcatctttggatttaatgttttccatcccaggtaaaataaattcccccagttgttaaatgaatttgatcttaactatgcccaatcttaatatatggtatagatgtatgtttatattagaatgggcaaaaggccaacaaaaacttcctgtctgatttttttcttaacaaattgtacactgctgcctaccaaaacttctgtttattcacataatgctgtatcatattcccaggacttgctgctctgacccaaggtgagaagaaatgcctttgtcctacaaacatgagcatttagcttaagttcaaacactgacaaagaagactgaaattggatacttaccagaataatctcccatatttagtttctctaaattcacagatgatcattatcaaactttcaaaaatatcataactattctcaatgactttaacattaaagttgggaaaatgactaaaattcagttacctttaattttaaaaatgcaaatttaacatgaagacataaatgtgtcactatcagtaatgacacatgtggtggaccattacattctgcaccaaaagtaccaagaagggcttcagtaactcccaatgtttggatggggagcttagaacaatagagataaataccaacatcaaaatgagagggaggaaacattataatttcttcattaagcaaacagtaaggttaaaacaaaatatgtaacttaaacttcaaagcacaaaaataattcttcaaaatattctaaacattttcatccaataagtactccgtatcaacaatcagcacctcacttggaaaatcagtcacaagtcagctgttaatgctgtgtggatgcaaccacagatcattacctacttaattgtgtatacatctaataggctcatacagctcttttagaacaaaggttttataatggagtagatgataaatactgaactgtagtgctaccaggtgctatactaatatgagcagaatttatatagagaattttagcctgtattaatgctgtaactaaaatagaaaaaaatgatttaaaatcaggtttgtaataatacagttaaaaaagaaatgcaatattacaagttcatattgtggcatcttgctaaaatcccataagtgatactaaaaatgttaagctaaatatagtttatctggtcaatgaatgcaactgtcagttgaccacagaagagagaaaagcaatttacattgtaaaaatttaaagacatccaatctaaaatttaatgttgactctgaagaatatcaattaatttatattttctgtcatttgaaactagagtgtatgaaagtaaacctgtacatacacatactcttctaaatcattgaacaaaatatggagcaaaccagcaacactactccatcttctggtgacattttccctcacctagatgtatttcagtgtaagtgtttctactgctgtcacatttggagcatgagatagggtataaaagatgattagcttcttcctaaatagcaaacatgaaattgtccaaacatgatagtttagagagcaaaaataagtacgccttaaaaaaaataacagaacaaactaaacttctcattacatattaaattagccctcaggtaatcagcccctaacaaacagcttaacatctacaaaaggctgcatgactggtgtgtgcctgtttaaagctctgctgtaagctgaactgttggtctcagctaggcatcctcaacatttcctttgaattttagccaacagtgccctaggcatgctcctagcactactattaacaaaacagctgtagttgaagcagtagtctttttgcctgacaaggacaccgtaacagtcattgtgatgtcttctgattgtgaacacaggtagagatgtacagcttggatacaaaaatttaatatgagtgtatttgagattataatttttactagttgtatagtaaatatgtgactaagcttgcttttctgaaacaaatgctgctgagtcaataccagacagtcccatgatcagtttggccaagtcacagtggacaacccagagctaaagtatgacatttttactcttcttcagctccctgtaccttagtctcagctgttcccatattcagtctctttagctagactaacaaaaaaagaatggagactcaaataaaaccagaaataaaagaggaaacattagaagtgataccacagaaatacaaagaattaaaaaagactcctgtgaactattatatggcaagaaattggataacttagaagaaatggataaattcctagacacataaaaactaccaagataaaatcatgaagaaatggaaaatctgaatagaccaataatgagtaagaaaattaaatcaaggccgggtgcagtggctcacgcctgtaatcccagcactttgggaggccgaggcaggtggatcacgacgtcagcagttcaagactagcctggccaacatggtgaagcccagtctctactaaaaatacaaaaattagctaggcatggtggcacacgcctgtaatcccagctactcaggaggctgaggcaggagaattgcttgaaccaggacccaggaggcagaggtttcagtgaactgagatcatgtcactgcacttccagcctgggctacaaagggaaactccatctcaaaaaaaaaaggaaagaaacaaagaaaaaaaaaaagaaaattaaatcaataattaaaaagtctcatcaaaggaaagcccaggacctgatgacttcactgctgaattcaactaaaatttaaagaactaataccaattctcaaactcctccaaaaaactgaagaggaaggaatactacaaactcattttatgaggccaacattacctgacaccaaagccagacaaggaggctacaagaaaagaaaattacaggccaatattcctgatgcacaaacatgcaaaactcctcaacaaaatactaacaagctttaaaagaccattcaccatgatcaagtggtacaccacattaacagaatggagaacaaaaatcatataaacaactcaatagatgcagagaaagaatttaacaaaattcaacatgctttcatgataaaaacctctcaacaaattagatatagaaggaatgtatttcctttttttgttgtttgtttgtttgtttgtgatggagtcttgctctatcacccaggctggagtacagtggcgcaattgtagctcattacaacctccacctcccaggttcaagcagttctccttcctcatactcccgaatagctgggattacaggcccacaccaccacacctgctaatttttgtattttatcagaaacagggttttgccatgttggccaggctggtctcagactcctgacctcaagtgatccacccacctcagcctcccaaagtgctgggattacaggtgtgagccaccgtgcctagcagaaggaatgtatttcaacacaataaaggccgtatttcacaagcccatagttagtgttatgctcaatagtgaaaagttgccaaaaatacacaatgtggaaaaaatagtctcttcaataagtggggttgggaaaattgaatatccacataccaaaaaacaaatttatttttatcctacatcacaaacaaaatttaactcaaaatggattaaagctgtaaacataagccctgaaaccataaaactactataagaaaacaaaggggaaatgctctatgacattagttttcacaatttttttaaatatgatgccataagtaccagcaacaaaggcaaaaataaataagtgaaattatatcaaactaaaaagtttctgcacagaaatggaaataatcaacaaaatgaaatagtaacctatggaatgaaataaaatgtttgcagaccatacatccaataagaggttagtattgaaaatctataaggaagtcatttaactcaaaagcaaaaaagaaaagaaaagaaatgacccacaaataacctaattaaaaatgagcaaaatacctaaatagacatttttttttttttgagacctaagtctcgctcttgtaccccaggctggagtgcaatggcatgatctcagctcactgcaacctccgcctcctgggttcaagcaattctcttgcctcagcctcccgtatagcagggattataggcacctgccaccacgcctgctaatttttgtatttttagtagagacggggtttcaccatgttggccaggctggtcttgaactcttgacctcaggtgatctgcctgcctcagcctcccaaagtgctgagattacaggtgtgagccactgtgcccgaactaaatagacatgtttcttttttttttttttaaatcctttaagttctagggtacatgtgcacaatgtgcaggtttgttacataggtatacatgtgccatgttggtttgctgcacccatcaactcgttatttacattaggtatttctcctaatgctatccctcccccagccctccacccaccgacaggcctcggtgtgtgatgttccctgccctgtgtccaagtgttcccactgttcaattcccacctataagtgagaacatgtggtgtttggttttctgtccttgtgatagtttgctgaggataatggtttccagcttcatgcatgtccctgcaaaggacatgaactcatccttttttatggctgtatagtattccatggtgtatatatgccacattttcttaatccagtctatcactgatgaatatttgggttggttccaagtctttgctattgtgaatagtgctgcaataaacatacgtgtgcatgtgtctttatagtagcatgatttataatccattggatatatacccagtaatggggttgctggatcaaatggtatttctgcttccagacccttgaggaattgccacactgtcttccacaatggttgaagtaatttacactcccaccaacagtgtaaaagcattcctgtttctccacatcctctccagcatctgttgtttcctgactttttaatgactgccattctaactggcgtgagatggtatctcattgtgattttgatttgcatttctgtgatgaccagtgatgatgagcattttttcatgtgtctgttggctgcataaatgtcttcttttgaaaagtgtctgttcatatcctttcctgactttttcatggggttgctttttcttgtaaatttgtttaacttctttgtagattctggatattagccctttgttagatgggtagattgcaaaaattttttcccattctgtaggtttcctgttcactctgatggtagtttcttttgctgtgcagaagctctttagtttaattagatcccatttgtctatcttggcttttgttgccattgctttgggtgtttgggtaatgaagtctttgcccatgcctatgtcctgaatggtattacctaggttttcttctagtgtttttatggttttaggtctaacatttaagtctttaattcatcttgaattaatttttgtataaggtgtaaggaagggatccagtttcagctttctacatatggctagccagttttccctgcaccatttactaaatagggaatcctttcttcacttctttttttttttttggtcaggtttgtcaaagatcagatggttgtagatgtgtggtgttatttctgaggcctctgttctgttccatcggtctatatatctgttttggtaccagtaccatgctcttttggttactgcagccttgtagtatagtttgaagtcaggtagcatgatgcttccagttttgttctttttgcttagaattgtcttggcactacaagctcttttttggttctgtatgaaatgtaaagtagttttttccaattctgtgaggaaagtcattggtagcttgatggggatggtattgaatctataaattaccttgggcagtatggccattttcatgatattgattcttcctatccatgagcatggaatgttcttccatttgtttgtgtcctcttatttccttgagcagtggtttgtagttctccttgaagaggtccttcacatcccttgtaagttggatccctaggaattttattctctttgtagtaattgtgaatggaagttcactcatgatttgggtctctgtttgtctattattggtgtataggaatgcttgtgatttttgcacattgattttgtatcctgagactttgctgaagttttttatcagcttaaggagatttggggctgagacaatggggttttctaataaacaatcatgtcatcttcaaacagggaaaatttgacttcctcttttcctaattgaataccctttacttctttctcttgcctgattgccctggccagaacttccaacactatgttgaataggagtggtgagagagggcatccctgtcttgtgccagttttcaaaaggaatgaatgcttccagtttttgcccagtcagtatgatattggctgtgggtttgtcataaatagctgttattattttgagatacattccatcaatacctagtttattgagagtttttagcatgaaggctgttgaattttgttgaaggccttttctgcatctattgagataatcatgtggtttttgtagtcggttctgtttatgtgatggattatgtttattgatttgcatatgttgaaccagccttgcatcccagggatgaagcctacttgattgtggtggccaagctttttgatgcgctgctggattcggttcaccagtattttattgaggattttctcatcgatgtttatcagggatattggtctaaaattctctttttttgttgtgtctctgccaggctttggtatcaggatgatgctggcctcacaaaatgagttagggaggattccctcttttactattgattggaatagtttcagaaggaatggtaccagctcctctttgtacctctggtagaattcggctgtgaatgtgtctgatcctggactttttttggttggtaggctattaattattgcctcaatttcagagcctgatattggtctattcagagattcaacttcttcctggtttagtcttgggagggtgtatgtgtcccggaatttatccatttcttctagattttctagtttatttgcgtagaggtgtttatagtattctctgatggtagtttttatttctgtgggatcagtggtgatatcccctttatcatcttttattgcttctctaaatagaaatttttcaaagaaagcatacaaatggccaatagatatataaaaaggtgctcacatcactaatcatcagagtaatgcaaatcaaaacaaaataagatatcacctcacacttgataggatagctactaccaaaaaacaaaaggtaacaagtgttggtgagtgtaatcagaaatgggaatgcttgtagagaaatgggaaccttggtgggaatgtaaattggtacagccactatgaacagtagtatgaaggttcctaaaatagattttaaaaaaatagaactattatatgatccagcaatcccacttctgagtatatatccaaaggaaatgaaatcagtattttgaagaggtatctgcactctcatgttcattgcagcatcattcatgatagtcaaggtatagaaacaacctaagtgcctaggatatactttaaaggtttagacgacacgggattctagaaattgtcaataaatcaaaattccattgcagtagaaaactacaaaatgatgtactttctgtattgtttgtgtatccacgataaagtggctgaaccagatgatgcttataagtctttcctttgtctacagtgttgtaatattattgcattttcttctttaaaaaaaaaaaagggccaggagcggtggctcacacctgtaattccagcactttgggaggccgaggcaggcagatcacaaggtcaagagatcgataccatcctggccaacatggtgaaactccatctctactaaaaatacaaaaattagctaggcatgatggtacacacctgtagtcccagctactcgggaagcggaggcagaagaattgcctgaacctgggaggcagagattgcagtgagccaagatcgcgtcactgactccagcctggcaacagagcgagagtccatctcaaaaataaataaataaatatttaaaaatttaacatttttaaaaaggcactactgaattattttcatttactggcacctcaccgcctaatacagtatattcgcatgtatagataaatgttaaaagcatctttgttgttcctgcagtttgatatgaaacccaatttcctggattattccatagtcccaatgcaacaaggttcctacagactcaagaaagtccatacccattctggtactcctttcatcctggtagaaaattctgttctacttcagattcctagggctcaatctgaaagagcagaactcccacctggaggacaagcataatcagaaagaagtggacttcactgaaaagtcaattgtgctgcatcctcatttcagtcctttgttgtacatttctgtgaacactcaaagaagttcactcctttcttcttgagtaggaaagtggaaatgtagagtggctggaggcttgcgttttagagaagactgcacccacatcttttattaaggggactatgaggggctcctctattccacatgtccctgaatacaggacagaatgtcactactcgaccacctagcaagtgtccagcaaaggaaatgctcctcaagacacaggaggtagcagaagtatgtttttccctggagagaatggggctcacttccacaaaggctgccatcagagcctttcattatagccatatataagcaaggcctcccaaaccatgaaccccagtgaaataaactgaatgtcctggctttgttttaacattagaagagatttctgcagccagtccaatctcagcatcatgcagcttttcaaacaggaaaagaatgcttttcatactataggtcctctcttggtttcaggatacaaaccagataccaaggatcaatagagggctcaccaaagaaccaaaggttgtgagaatatatcatttcctgttattgtcccaactcttgtcattagcaaagtatgtggccttgtacaagatatttaatctccttgcaactcatttttttcatctttaaaataaaacagttggggccaggcacagtagttcatgcctctaatccttgcactttgggaggctgagacgggtgaatcgagttcaagaccagcctgggcaacatggtgaaaccctgtctctacgaaaaatacaaaaaattagctgggcatggtggtggatgcctgtaattccagctacctgggaggctgaggcaagagaatcacttgaacccaggaggcagaggttgcactgagctgagattgtgccactgcactccagcctgggtaacagagcgagattgtctcaaacataaaaaataaaataaaataaaacagttaggttagatgaattctaaagattctttacttggtttaaggttctctagtatagcatagcctctgtaatttgcatcttaaaccaccaaaagtcataatcttagtagtgaaagattaccttcttttcatgcacagatcactttcaaagtgcaaaacagactaaagaagacattttcagagttaacttgtctatttttttttattattatactttaagttttagggtacatgtgcacattatttctcctcaataccaacttttattgacaaccttatggacttaggtatgtcaatataagacatgcacaaataagcaccatattgatgcaaacactgaagttgttttttgtttgtttgtttggttggttttgggtttttgttttgtttttgttgttttttttttttttgccatctctggaattcctatcagcattgtaaattttgaaacaacccataacaaagaattaacttgtttcaataaacattccccacataaagtagctataagctgcccacaacgcaaactactgtatagcaaacaaccttgtaaaaattaataaatcttctctggtgcatgaaaatcagctaacgcttgactcaacagctttctacctaagtgccaccaataaactgagccccagagacaacagacggaaacagaatagcaaaccttaggaattaaaagatgtctctataatgtttttactttgctaatttaatagaagacacttagttatcatgaccattaactatccaatgtggaaatcaaattttaggaggacaaatgtataatatgcatcattttcatcattcattttaaaataaaggcaagtttcttacattaaaaaatccataagattttttcttcagactgtaactatagaaaaacaaatcaccctataaagatctgtagtttatgaagtagtgaaaatgatcaaatggctattgcaaaaagctggatattaggaaatgtgaatattaattctgaatttgttactgactcaggatgaccttgcatgatgcatccaaccttcttttctctatatcagaaaactaaagaataaatgtaacatcacattcttttctcctttgggacaaacaactatgtacaattgaataaaaatgaaattgcataagtagtggatagaatatgtttgggttggtttgaacttagcacactgtttaataattcaacattttttatacctgtgcaataaatttttaaatgatgtctgaaatgctttgaaatcttcagaaacaggtttataaatggcataaaaaatcattttatttgatctggtaaataagaaatagaataccacctaagacagacatgaatattttagtatagcagtccttggttcacttacccttaaaaggaataattcaatcagaattctttcaggacagttagattaattacagaagaaggaaaaaaagaatcttctcccaattgagcaattaacatacttcatcttacaaaggtcactgaagttaatccatggctatagaactattgctctagaagcttagcacctccccttagtactcattcagtccagctcccacttacacccttccttagactgcatctaaacaattccagatacacatgttctttatcttttattttattgatttatttattttttgacatggagttttgctcttgtcacccaggctggagtgcaatggcatgatctcatctatctgcaacctctgcctcctatattcaaatgattctcctgcctcagcctcccgagtagctgcgattacagttgcctgccaccatgcccggctaattttttgtatttttagtagagacggggtttcaccatgttggtcaggttggtctttatttttaaaggtcttaaagaaaatatatttacaattccattttaatgttagccccaatggaaagttagtccctaccttataaggtccttgtagataagcaattcccagtgcaatattattctagctgattcactacttttttcttgctataagtccttacatgattgaaggatattatcggaactcatcaactttttcttctctatatgctatagtacaaccacaagcctagcactatttagtttcattttctaagcatttcttccacaggatccctacattgttttgttgtatcctcagagttctcaagttcccagagtaagcctaagagtattttctatgtggtcagtcattatctatctagaattttattttttgttttgaaatatttgattgacaaagattgaatatattcaaagtgtgcaacaagatgattgagagatatatacacattttgtaatgactaccaccattaaattaacacgtctatcatcactcgtgctgtttattaggtccccagaacttgttcatcttataagtgaaaatgtgtacctttgatcaatatctactaatttcctccacccaccaatccctggaaagcactcctctaccctctacttctctgagtttgacattttcagattccacatataagtaagaccatacagtatgtgtatttctgtgtctggattactttgcttagcaaaatgtcttccaggttcaaccatactattgcaaaggcaggatttccttcctttttaaggctaaataatatttcattgcttatatgtataccacattttctttattcatctgttaatagacacttaggttgtttcaatatcttggctgttgtgaataatgctgcaatgaacgtgggagtgcagctatctcttcaagatactgattccattttctttggatatatacccaaaagtaagattgataggtcttatgatagctctatttcatatgtttttagcaacctctatactttttccgaaatgactgtaccaatttacattcccaacaatgtgcaaaggtttccttttcttcacatcatcactaactcctgttatctcttgtcttgcacacctgttaggatggctatcatgaaaaagataagagataacaagtagaattttatttttcaattgaaaaatattaacccgcagtcatttttatcaaataaattttatctaacttatttttatttttcttctgtttaataaaagtttgttttaaattcaatttttatcctacaaggtattatgtacccttctggctttggaattacctaaaaggggtcacacacccagtttagtaaaagaaaaaaaaagcagttgttcactcctgagcatcgtcactaaaaaagtaccatgtgctgaacaatacctgaagcataagggaagcttggatatatagaatgtattattaacctgaattggacgttagccagaacactgaacctacttcccccaagagattgtcatagtacaagtcctcagtactttaactgcccatcaagagatatcaccttagaaacatattagaacaaaatgttgcagctcccttcttgagaggtgtcagcatgttctttttgttacatagatcaccaactgctagactatgtatgtccaaaaacattctatcccatatgttcagaacagtgctggaccctatgtacagcacagaagtatacaaaataaagaacatatccatatccttatggaacttacaacctatttaagaaaatggcttatgagaataacagaaaacatataatagctaccaattatactaaacacatgtcaggtgcaatgttaagtcctttatacatatttcataggacttactttatacttgatatattgtttcctcaaagcaagctatttaagttagggttatttttccgatgctttttaaaaagaaactcaggtatccagtacaaacagtctaaccaggtttgggtaactacaaagctcacactctaatcactgtactacatggattctcaatgagtatatcatcaatcaaatgctaaattgtatgacacaaataaaagctaagaatggcaaagagtgaagagttatattgactagaggtcacaggaggaggtgttatgagggaggctagacttcagtttgactttaaagaatgatttaagtatgtaaaatgaaacgggctgtacattctaaatacgaagttatataaaccttgtgcacaggtcagaaggcaagaatagtatgccgtgatcagagagacaagaatcagatacgtgatgtgttccaacatgcatgcaggtctgaagtacaataatttaattttacatatttttatatcaatgtctaaatgtgctttagtctatataatgttcaactcaataatgtcaactttaatttatatcaaaagacttcagaagcctctggaaatggatgtgttttataatgttattataagttttaagggtagataaagagaggaatgaattacattagagtccacattatcaaaccttattttgttttacttcacaaaacgaaagctctaaggaaacctcttgatttataagcactcaaattaatacataaatctgagatcgatataatagctggaacttgttattaccattcctatgtcacaccaactagaaggatgaaaaccaagtagtccaagcagataaactccaagactgtacctgcctttcgatagtaagaaccaaaagagtgtccaaattctccggttaatcctgctttgtcatccgtttactttaggctgattcatcccagtaaacccaccacctcacctatcacagcctcctctcacaccttttccaatcaaagctatttcaacattagtctttttgaaagtaggaaaatgtagagatgttgtgccctgacccaaggaatagctgatgtgcaggcactcactcttttaaataaataaatactaagttcagacctaggaaagaaagcacagtaacctcagaaaaacagaagtgagagaatggagcaaagaactccagtagtcttatcttgtgccgagaaagaaatctctcaaagatgatgttaaaaatatcatagaaggggacagaaaataaaacctaatggatgactccaataaaataattatagtcaattcattggacatccataattcagagttaacactggcattttctgtttgttttaaaaaatggatagaagaataaaatatgttaggagaaaacctcaataatacataggggcaagggaaaatctctcagcccttggtatccaggaaaccaaaggcttatgctcttttgaattttaaatgtgtagcaaaacacattgattttaattgcctataatctgaggtcaaaccttttggcatggttctttgttcatagcaacaacaccaccaataatatttactgaggatttgccatgagtcagatactgttaggagcactggagaggatacagcattaaaggtgacagacgaggccctgtccttttggagcttatgttctgtcccagtgcggaatgataaatatggttggaccagggaacaaaccatgactaattctctaatacaaagaataccaccttataaagaggaaactttcttgctaaactggcaattttacagaggcctgaatcttttccattagaagaaaaacactttctggcgtgtgcttcatcaggttttggagctttaaaggaatagaatgcgagataaaagataaatcccatcaagctagagaagagctgatgttctgaccctttgaccctgcccatcaagaagacataacactccaggtttgaagtcagacttgatttagatttgaagcccagtttcacgccttattagctccatgaccttaggcatgttacttaacttccttaacaattttctcatctgtaaaatggtgctaacaaaagccacctcactgtattgttataagcatttaaagattcaattcataaatgtttaaatcataccatgtgccatatgcttttcatttaataaatagtatagatgatttatataggcatatatgtatacactccatgtgctcatcttttctttatgcacatataatttacccatctatcctcaatgccattctcccagagttctacccttctgcccctgaggcatttacattcttccaaattcacaattagctaataaaagaatccaatcactgaaaatgtgttaatgagaaacgataacagaagagtacagtgactactgcctgccagctcaaatacccctccatggtaaaatatggttttggaaacaaaactgtactaaaaattgcataggccggaggagtgactctggtgtgaacgctaagcagcatcctctgggggtttgttatagtagcactcagtaaccatcaagtgctaatacctagatcatcattaatttttttaaaaaaacaaaacttaaatggacattgtatcctttttcatgtaaattaatgtgtctgcaaaaagaatgtatttgccctggaacattctataaaacaaatataacccctaggaaaataaggccatagaaaggttaaatgtccatgtaacatctgtgatagagcaatacctagaacacaattctctttttggcccagtaattctagaccatatcatgttgacttaatgagatttaactaaaaatagaaaattctgctttgaaaaccttcatccaaaaggatccaaaacttgtgaattaggcaatggtgagaatgccacaccctttgctactctaagaggaaagtctctcaagtgatcgactcgaggcctggccatgcaagtcagacatttagtcatttttctagactctatccatcatggagcacattaccgaatttcatgcaacctcatttaaacatttaactggctgttctgatcggaataaacctttggtggaagtaaaagcttgacaacgctgacacctagtggctgtgaagaaactggagcagattcagcctaggaagagtagtgagctactgtggcagtgtctccaaaacacacagcatttaatcatgatgaatattaggttataaagtaccagttctaaaacaaaccctataaaagtttatttcagctctctatttatctaggggcctacaaaaggaggcaattaaaaaccttgtatttgaaaagtaaatcttccttcaatcttccacacttagcaaattactcatcttcaaagatcaaagaaaactaaagatcaattcatattttggcatatttatgactattttccttaatgttgcatgtacacccacaaccttatcctggtcttcaggtgatttttctccccaggtcaaatataaaagccaactggccaagccattatagagactccctttatgcctctgaagcgtccctagtcaaagggtagttggattttcacaaaccagcaggaattttctttaagagaggtataaggacacatgtggaaacccctaaagtacacatctaaaagcaaggaccacattgaacactgtgggaagccatatgaacacagcagatcagcacagcacaacctgtatctgctctaaccattagaagataagtttcctcagacccacctgcacctctgacaggcaggatggcaggaagcctaaagtgttcatctcctccaccaaggagagctctgactcctacctgctgacgtttgaaggctaaataatccaaattttccagctccttcccaagcttctggtaggttttctggaggtcagatttgttggcaacatttttgagagactcaaatgtcctttgaaactgaaattgaaaacaaaagtagatcattaggatagcagcagatttttctcaaattctcaacttgctaacacgaagagtcgataatgagcctcagtttctcccattcataatacagtgataacaaatgctagctaattatctttcaatgaaataattagggacacagaaagagttataaaccatattctaagtataaccaacattactgcatgcatgagaagcctgttcagtcctcattctaacaaaagagcatacttcatttaaaaaaaataaaaaagaaagttcatcttttaggatatacttctgctttaaaattttttagaaagcactgtgaatgtataattttaaatcataatgaggaagcattaaagagtgctcacatttcaatcatggaaacaaacaaatttatgaaaatgtagttgcttacacgatattttgctataatggcatggaatctggcttgcctctataataatatctatgcagaataggtcacccaacaaacttcagcaagaaagatctctcagagcttgtattttgagaaggaaggaaaacttaacattttgatgatcaaagcatatgtggcatgttcagcaaacatttattcatttctgctctataacacagatgagctatgagcagatgagttatgatcagaaagagagttctgatcagttctgctgaatcagaatgctcctattctttttaaatcagatactagataaatacaaaggtgaaaaattgcaacgaaccacagaatactgtctgctactaataattaattaagcaaaggaagctcacaagaaattggattcttggtttattttcataaattagaacatactttggagggttagtgattgaaaatgtcaagtaatgtaatttgcaagacatttgcatttgctctctctttatgtcatttatttcccatattctcactctgtgccattagacagatttctacagatagagacttgaccatcttaaacacaccagaactccactgtgactatgatgccatgagacaggctaataagattttatagaatataattaagtttccagggaaatgatttgacccttactatatcaaactctatgaaataagtcatattaaaatggcattctactgaattaaatccctaatttcatgaaagcaacatgtttatctcaatccaaggtgacagagggaaaagaaatgggaaataacagtgctaagcttccatgacaggacagtaaattaaattcaacaaataatcatttagaacctactatgcacaaagcactatgaatataaaagacatttcctgccctgaaggaactcataccactggagaaactagacatgaaattcggaaatgagatggacactgacacttactgagtgcccactcagccccaggtacttgatgctttccaatttaatcttcacaagaaccacaggagttcctatttctcttctcattctataattgagtaaactgggtttcagaaagtttgattgaactgggtttttattacaacattcatgttctttctactctatccttaactctaacacaaggcaaggtagtaaagagagtgcaaaaaaagagagataaaggtaacattggtgaaaactcggaaaactcactgatactgacactgacggagggactcagaccacgtagaagacgtaagacaatttgagttgggccccaaaggacaggaagtcttttaagagtctgacgtggaaaccaattctacccaacatattaaacacagccaaaatcagttcattttcccccacttataacaataaacaagttcctttcaacataattttaatgacctttatatgaaatatttattatattgtataatcatttctgtgccttgcccatttcttggttcattctcactatgttcaaatcaaaataaaaccttatctaagattctaaaaaatttaagtaattttatctatgatttaattaatacaagctattttactgacaaatccatttaactctaaagcatgttttagcccctgcactttgtcttccctaagaaatattagctctacttcttaaaatattttttcttcatatttatctctgtaaacattatacaactccaaatgggaactttagagcaaacacacttgtaaagagtgttcaaaatagccgggcgcggtggctcacgcctgtaatcccagcactttgggaggccgaggcgggcggatcacgaggtcaggagatcgagactatcctggctaacacggtgaaaccccgtctctactaaaaatacaaaaaattagccaggagaggtggcgggcgcctgtagtccccgcgggaggctgaggcaggagaatggcgtgaacccggcaggcggagcttgcaatgagccgagattgcgccactgcactccagcctgggcgacagcgagactctgtctcaaaaaaaaaaaaaaaaaaaaaaaaagagtgttcaaaataagaaacacagaaaaccaacacttcaggtaatatgcccatggccaaaggagaaatggagaaaatccagtaacaatacatgatcacaagaatgttttaactaaaggtcggactttgtataatatggagatttcagcttgaacttttgttatcaggaattatatcctccatttattgataataaagagttcaaaatactgtaaaaccatgataatttcattcatttaagcagttttttttgcttacaacaataattaattgtcaaggagaggtcatatgaaagctgtggtatagctctggcttagctccctattaaacacaccccatccccacctgcacacatgtacgcttaaagatactaaagagtgaaagcaataatcttactttccaagtgatgctgaagtacagaagataaaagttaggttgaggcctaggttttaaagagtattcacttggcttgaagatttttctaataggccacaatggttaatcattgaaacaaacctccaagattttctatatttgttcagtacatgataattttcttatattgattatttctccaaataaatgatctcccagttggagacaagttggggaaaggaagcacaattaattgaagagatttttaatactgctggattttacttattcatagttttgagtgggaatttaaaatgagccaaaaaccccagaataatttgttgaaccttgaatttatcctgtgtttttttttttaactcgttataaaccaaactcaaactttaaaaagctcagtgaattagactaaacccaaaacaaaccttggacatacaagataagaatgggtagaggaaaacaatatccctaagcccagcacttgctggaaaagtaagcactgtcaacactcccagagtgtgttttctcatcaaattatttctgctcagaaataataatagtaatccatcaaataaaacagcagaaactataattgctcatctcacattaaaatagctgacaaattattttgcaagaaagagaagcatagaaaaggcaacaggaaaatgtctactttgtctcagcagtcccttttcccagatacattttttctcctttttcctgacaatacatatataaataaatctaagccagtgttctatacaaattatgcatccaatgagttcatgtaaattatgtagatttgtggagtaatttgagaaagacacgaagaaataggctgaaacagcaggaaaaaaaaatgcagccaaggctctggcaaataaagttttcctctccctcactgccaacgccctggcttccttttgtagtcagatcgattgattcaaataactctagagctccagcagcctactaattcccataatttaaaaacatcaagtagcattgctccaaaacaagagccagctccacagtcatcatgttttcttatttaatatttcatgcatttatacgaggtgctgggtgctacctgtaacatgaaaagaaatcccatacccgcagcgttatgtgtacaaaagggtatacagtaagtgcctgatggaaagcattatatcaccaagtgtgatcttagtgtccctaaatcatctgtttaaaacaatgctaaaagtttctggagcctaaagcagaaggaaagaatagtcaaaaaaataatatattgatgctctataaatattaatacctagagtaaaaagaaattgttttaagcataagaaatagctaatctaccttacttaaatatggcaaccacagagcaatcaaaaataaagtattacagagaaagaaattatttaatgtttctgaatttaatccattgactttcatattttccaaatgaacttacaagatgataataccactcaataaaaagaagtttacaactgaagcagaaaattaaagctcacatacatatctcaaatgatttttttttttttttttttgctgtaaggaatgactataaaagttaagaacatagagcaaaattgggcttgagatctaaattagaaatagttctatgtaggtgaaggcacactggccttgaggtctgaggttcaagtccttgctatgccatttaataactgcatcactttggacaagtcattattattccaattttgattgtgttatctataacacaggacaaattgtctttgcctgcctacttcactcagttgttgtgaaatcagttgaggaaaaataaaagacattcattcaacaaatatttatcaatgagcaacataccagacatgtaagaaacagaggaaaacaaaagagaaacaactcttaccctaacagattttacaatctagctttataggttactgctttataaacttaaaagttccataaaattgaaaagaccattgtcattaagatcatgacacctttcagtagtgaataaggactgaacaaaagggtcattcaataattgtttatagagcagcatcactgtgcaaagcactgggcttgacgctgtgagaaacatcacatttatggtgaggcttgggtggaaaaatgacgaaatcattgatgctttatgaaaagtttggccaggtacagtggctcacgctgtaatctcagcactttgggaggccgaggctggcagatcaattgaggtcaggagttcgagaccagcctggccaacatggtgaaatcccatctttattaaaaatacaaaaattagtcaggtgtggtggcatgcacctgtaatcccagttacttgtgaggctgaggcaagagaattgcttgagcccaggaggcagacgttgcagtgagccgagatcgcaccactgcactccagcctgggtgacagaaaaagacttcatctcaaagataagataaaataaaataaaataaaaagtttatgggcaatgtccccaaagaaatcagcagtttacaaatggataatccattttgagaagggtcaagatgatgttgaagacaaaacccacagcagcagaccatccacatcaatttgcaaggaaaaaattaatcttgtttgtgtcctaattgaagaggaccaacaattaacaccagaagcaatagccaacatcatagacatctgaactggttcagcttacacaattctgactgaaaattttcagttgagcaaagtttcccctggatgaatgccaaaattgttgcacatagatcaattgcagataagaccagagctttcaatgaaatgttttaacaattttaatttcatcaagctccttaagtattcctttggagaaatctaacaaaagatgaatgtggatttaccagtatgatcctgaagactgagcacaatcaaagcaatatctaccaagaggtggaagtggtcctgtcaatgcaaaagcaagctagtcaagagcaaagatcatggcaatagttttttaagatgctcaaagaattttgcttgttgattttctggaaggccatggaatgatagtatctgtttattatgagagtcttttgagaaagctagccaaagctttagcagaaaaacactgggaaagcttcaccagagtccttctccaccacaatgctcctgctcattctgctcattctgctcattaaacaaagccaattttgcaagtttcaatataaaatcattaggtatccaccttacagtcctggtttggctccttctgactctttttgtttccaaatctcaaaaaatatttaaagggcactcatttttcttcagttgataatgtaaaaaagactgcattggcacggttaaattccaggacattcaattctttagggatgaactaaatggctagtatcattatttacaaaagtgtcttcaacttgatggagtttatgatgagaaataaagtttatattttttatttttttcttttaattccatttttctatgaactttgtgaagtcccctcatcattaccctgcttaaaattctttcatggtttccccttagctttcagactatagttcaaactttgtaacttagcacatagacctttcaaattaggtctatgcctacctctccagcttcaactcttgttcctctcacacagttcacccttcatctcagccattcaggactattacaagtctttcagcatacatcctcttctgcaggtaaaatgccctctgccccactaccttctttctctagtcaactctccaaactcagccacacagtattcatttaacataccctctcttaatacaattccaacctccataacactttgtaccaacctctaccataataacatattgttaatttactttttatctagtctgtaaattccaagagagcaggatcatgatggtatttttagaaatttgaatccctagcacatactagagtgatggtgactgccacaaagtaagcacacaaaaataaccatttgctgaggtaatccattaattaatcaaatcagagataactggaaagatgctgattccttcttaaaaaatgaaaattttacatggtttaaatttgtatggtcaaaggtcataaaatttcaattaaacaggaggaataatctcaagagatctattgtacatcatggtgactgcagttaataccaataaattatatacatgaaaattgctagagtaaattttaagtgttctcactaccaaaaattgataagtataaaaggtaatgcatatatattaagtagcttgagttagcgattccagaatgtatacatgtattaaaacatcatgttatataccataaatatatataatttttacttgtcaaaatagggggatatagaagggatggttaatggatataaaaataaagttagatggaaaaaaatctggtgtttggtaacataatagaaagaccatagttaacaataacttatcacatatttcaaaataactaaaagagtagaatcagaatgttcctaacacaaagaaatgataaatgcttgaggtgatggatattccaattaccctgatttgatcattacacattatatgcttttatcaaaatatcatatataccccataaataagtacaactattatgtatctatatgagaacacatggacacaggaaggggaacatcacactctggggactgctgtggggtcgggggaggggggagggatagctttaggagatatacctaatgctaaatgatgagttaatgggtgcagcacaccagcatggcacatgtatacatatgtaactaacctgcacattgtgcacatgtaccctaaaacttaaagtataataataatacaataaataaaataaaataaaataaaataaaatttaaaaaatatacgtttgaaaaaaaaatttcttcttccctaaaatttccaataggaaattcatgacaaatccagcaagtatgccctatttgtctctatttctaatttctcctcttatatcttgatgtggtttggctgtgttcccacccaaatctcatcttgaattgtaactcccacaattcccaagtgtcatgggaggaacccggtgggaggtgattgaattatgggggcaggtctttcctgcactgttctcgtgatagtgaatgagtgtcacgagatctgacggttttaaagatgggagtttccctacacaagctctctctttgcctgccgccatccacatcagatgtgacttgctcctccttgcttccaccatgattgtgtagcctccccagcaaggtggaactgtaagtccattaaacctccttcttttataaattgcccagtctcaggtatgtctttattagcagcatgaaaacagactaatacagtaaattggtaccagtagagtggggtgctgctgtagatacctgaaaatgtggaagcaatttgggaactgggtaacaggcagcggttggaacagtttggagggctcagaagaagacatgaaaatgtgggaaggtctggaacttcctagagacttgttgaatggctttgcccaaaatgctgataagcatatgcgcaataaagcccaggctgaggtggtctcagctggaaatgaggaacttgttgggaactggagcaaaggtgactcttgttatgttttagcaaagagattggtggcattttgccctgccctagagatttgtggaaatttgaacttgagaaagatgatttagagtatctggtttaaggaacttctaagcagcaaagcattcaagaggtgacttgggtactgttaaaggcattcagttttataagggaagcagagcataaagtttggaaaatttgcaacctgaaaatgtgatagaaaagaaaatcacattttctgaggaaaaattcaagccagctgcagaaatttgcataagtaatgaggagccaaatattaatccccaagacaatggggaaaatgtctccagggcatgtcagaggacttcccagcagcccctcccatcacaggccaggaagcctaagaggaaaaagcagtttcatgggccaagcccaaggtccccatgctgtgtgcagcctagggacttggagccctttgtcccagctgctccagccgtggctgaaaggggccaatgtcgagcttgggctgtggcttcagaacgcagcttctgaagccttgccaccttccatgtggtattgagcctgcaagtgcatggaagtcaaaaattgaggtttgggaacctctgcctagattttagagaatttatggaaacgcttgtatgtccaggtagaagtttgctgcaggggcagggctctcatggagaacctctgttaggaagagtggaagggaaatgtggtgttggagccctcacacagagtacctactggggcaccacctagtggagctgtgagaagagggccactgtcctccagaaccaccctagaatgatagctccactgacagcttgcactgtgcacctggaaaagccgcagacactcaatggcaacccatgaacacagccaggaggaaggctgtatcccgcaaagccacagggggagagctgcccaagaccatgggaacccacttcttgcatcagcatgatctggatgtgagacatggagtcaaaggagatcattttggagctttaagatttgactgccctgatggattgtggacttacatggggcctgtagcccctttgttttgaccaatttgtcccatttgtaacagctgtatttacccaatgcctgtaccctcattgtatctagaaagtaactaacttgcttttgattttacaagctcataggcagaagagacttgccttgtcttagatgagatgttgaactgtggacttttgagttaatgctgaaatgaattaagactttgggggaatgttgagaaggcatgattagttttgaaatgtgaggacatgagatttgggaggggctgggggcagaatgatatagtttggctgtgtccccacccaaatctcatcttgaattgtaactctcacaattcccacatgtcatgggaggaaccagtgggaggtgattgaattacagggccaggtctttcctgcactgttctcatgatagtggaagagtctcaggagatctgatggttttaaaaacaggagtttccctccacaagctctctctttgcctgctgccgtccatgtaagatgtgacttgctcctccttgccttctgccatgattgtgaggcctcccctcacaatcatggaatccacatggaatccatgtggaactgtaagtccattaaacctctttcttttgtaaattgcccagtataaagtatgtctttatcagcagagtgaaaacagaatacacatcttaaataccagtcttgacttgctctttttctttacatcttaatatgcttttacatattttgcctaagatcttccacaaaatatacatagcttctaacagctcttaattatacagtaattttccctttatcagctgctgatatcttcagtaataaaaggctttagaaaatctttttgttggtacacatctgccttttaaatagagggtggcctcggagagtctcagctgccaacatggtaatgtgatttttctgtcaatataaatatttgtcatagtcagaattattgtttgtccacaaatgctttataaaattatgtagcaaatgttaaatatacatttgacaaaagttgttaaattctggacccatttcctgtaagacactggtctattacctaatccaaagggatcaacattcccaaaacaagtaaaacatgactatggtatgataaatggaaaaagttagaaaagttagttcaactcaatagtcaaatttcccttcatttttaggaataagtacaacatttcactccaagggccaaaaagtgggagcaagataccaaggagaagaaagatgggacagggaaagaaggtgaaagagaacttataccagttcttgccaagtaatttatgtcatatatcattcagtcttcacaaaaccctttcaaggtattcggaataagttttattctccccataactcagaagaagaaaccaaagctcgcagatttttaactttcccaaaatcacccagctaatcaacaacacagccaggattcaagcaaggtctccatgctgccaaaagccatgttttcttcccacgatgtcctgacccagtaagcagaagccatccaaacctattttcttccaaataaaattgacccttagaaatccagatgccaaggtgggcacggtggcggacgcctgtaatcccagcactttgggaggccaaggtgggcagatcacccaaggtcaggagtttgagaccagcctagccaacatggcaaaacactgtctttactaaaaatacaaaaattagcctggcatggtggtgcacacctgtaatcccagctactcgggaggctgaggcaggagaatcacttgaacctgggaggtgaaggttgcagtgagccaagaccatgccattgcactccaggtgtgcaaaaagagcaaatctctgtctcaaaaaaaaaaaaaagaaatccatatgccaataaaacaagatgtggaatcctaagaagaacaaatagtacagaaaagtctgaaacacttgaacagtatcatagagataaacattttaacttaaattcctataaaaaatttataaacaatggtgacaatagagccaaaatacctttccaagtttctacaattgatgaaatattgaaatatcagcacttttttcctctgtcccctattacctttcatttggacctgtttttccccaaaagaacacacacatttccttaaggaactagacacgtttaaaagtgccatgtcaggaatccttgattatttaatttggcagtacttgtccatttttggttgctcagtgacccatgtttacactagttggtggtctcagactgtgtccttgtaaatgttctattgtaattgcttctcctggggcagtctcagtggaaagagtataatttaatagaaataagaaagctttacaaaatcaggaaatatatagatacatgctattaaaagagagtaacatctcatttatctgacatctaaaaggaaatatacttcaacgggattgaaaaaaatctgttatgtaagaaaagtcataagaaggaaaataagagtaaggccacttaaaaaaaattgtgagctcagaggaattctttaatgctatgaaataaagaacaaaaacagaaaatgtagcaggaacttgtataagtgtcaggagggaaaaaaaaaaagtccagaagcctgaatgaaatagtaaagacaaggagaagaaaggcaggccttggcccattacatgcaaaataagggcaagaaataaaaaggcagtcctctgttttgggggaaaaaaagtgtgttcccaggagaaattcatgtctttaaagtggataccctcctcccaccaaaaatctataatagattattatatagtaggattggggagtgtgatggctgactacagaatgcttcttaggaagggcactacctatactgaagaaaataccttaaggagtaatttaaggtgggtagtgatatcctaaggacagaaataagcaggggccaagtggagtgctagagagataactattctttactgcattccaatgaacataatttagaagtttgagggaaagtagctagagaaaaaatgtggaagggcaatgagatggagttgctatcaatgagattttgaagatttcgaacatacaaattgaagccctttagaatatattgttgcaatatagatatccctcccttccgtcttcctgtaagtttctgtaaggtttactacattcatgtattctggtctgctctggtaggttggagaatgtgtgtatctgtgtgtctattcgtgcaaggggaaaaggccaactccagattctgggtgaatataatgtagaatagagacagaaagacaatctataaatgaaaataattcagtggaagcaaaagcttggagacagagttgaccctgaaaatatgagctcccaaggaatttgcagaaatttgggggagaacattatacttgataggacacagaatgagggtttaaactaattatattgagatcttaagagcaagaagaacccagcaacaagtggttttgcatcataattaagtggattataagtaatttaaaaaatgaaggtcagaacaaaggagaagaaaataaaagcaggcaagcaatggtcacttagagctcttattgggtcattaaaaagtaagtcatgccaaactaacttcatttcctttataactgggattactagactgataaatccacaatgccacaaacagtatatcttgatttcaagaaagtctttcaagaagtgcttgaaaatgaaataaagaagcatggtttatacagcagcccaatgaagcaagcttgaagctcatttcaacaactttactcaaaggatgttcatatttgattggtattatctaaaagaaagatataatactgttttccatgtcattaaacattttttcatgaataaatttgaaaatgatatcaggttaggaaaggaagacaaaatcgagagtcaaaggatgatggactgtaacaaaaagcaggaattaataagataaagttcaatgaatataaatgtaacttctacctttacataattaaaaaaaagactagtatcagaggaggaagacctggattaggagtagtttgagctcagagagttggaggttgtaattgctttcaaaatcaatatgaaccaacaacatgacaaggctactgtgataggtaagatcatgttagacattaaatcagggatgtaattgtccatttatatcatggaatgttcacatcagagagtttgttttgatttcaagacactgatttcaacatttcatggaagttacctacaatctagaatgcatagaaaaggatttacagagatgatttgggggacttctatttcttgtaatagcaaattagaaattcagtctgatcctctgctgaaggaaacgaaggtttgatgataaaataattcatcttaaaaacatcacagagctaataaggcagtgagaaatttcctgaagtgggtttcagaagaggtgatgttcagtatccaatcaaaaatagccattcacattataagacaagacaccatgagtaaaagcaaggaaaatgatagcagaagcaggcacccaaggagtccaaacaccagagttctcaaaccatgaggatcagacagttctgctcaccatgtcgagtagatcaaaataaagactgaaaatttcagcaggaaactaaaagtcatacaaagaaatgtaagccaatttgaaaaatatatagaaattctatggtatttaccatataaagaacatccaaaagtcaaaaaatttttagcctagaaaaggggagacataggtaagtcctaagagtaatcatcagttatttgaaaagagccttttctattgccttgattctgtgttgctccagaaagcaaaactagacgcactgtttgaaatagcagggaggcagttttaagctcagtttgagaaatttgtctccaacaattagaagtgtccaaaatcagcttcactgtctcagaaaattgagattgttatcattgttagtgatcatctattgttaggcagttgcatatgttgcatattatcagagagtctttctacgtcaggtaaaatattaaactgtaagggcactgaagtttctccactatgattcttttgattccaagtagaagctaatattgtcataaacattattagaaaaattccaaactgatatttcccaaagtatggtttcagaaatttccaggattaatatactatggaagagttctggggtcaaaaacatttgggaaattctgagttaagcagagttaaacaggcttcttcatggcaatatttctcaacaattttaacgcgctaatgtgcatcaaaacattcatgggaatttctatgtgcagcattgatcattacaaaaagaaacaacttttttcctcttccatattttcaaagcatgctctacagaatacttttggggaaatgttgggctaaataattctaatcctgatgatctcagaaacaatttagtgattttcattctacatgaagtcttgaaataattgagttgataatgattcatatataaacttttcatgaggatgaaaccatgaaaaactatcacgatttaccacaaaagatgttcccttctctttgataagatgccacttcctttttcataacatataattgttttactacacatacttatatgtgacatataatccagttgaaattcaggctctaacaaggcaccaagtgtgagagaggatggttagaatttaaaacaccttctggtgtatctaacttactttaataactggttgtaggtccatgaatttgcctaaacttttaaaagctgtttgtagttaaagctgttctaaccattagagtagttaagttccaaaagttttaattctttcctgtttccttgagcaagttacttaaattcaatgtgcctcagctttctcatttgttaaatagaaatcatgatcatagggctgttataagaattgaattaaaagaaataatccagcacagtgtttggcacattataaaaacccagcaaatattaactataatttttactgcaagaggtactttgcttttgtttgatctacaatgccatcctgcttcatttgcatggtatgatgtatgtgaattacctacctctgtgcctaactcctagtggacactcaattaaaatggtagtgaaggtggttttattctttatatacagttacctcctaattggttatgaaggtggcaattttcaccttacaaaagccctgcattctgccctatctcaacaaatttagagtctaaaataggaattattgggtcattggaactaggaattacctgccacttaatcttttgtacccatttcttgtttacagcatttgttagtgtctgtattcaaatatgagacaaatgaatctcagaaatgttcagtaatttgtctgtggttattaaacaaaccaagaagcaagtaacagaaatctttgctcaattatgacacctacaaatccactagtaaacagctgctggtgatgagaacaattccctttcctaaaaagctacttaaactaaaaaaaaaagattgaattgctctttttactgtaataaaactatcagttcagtaatttgtctatggttactcaacaaaccaagaagcaagtaacagaaacctttgctcaattatatcacctacaaatcttctagtcaacagctgttggtgatgacagcaattccctttcctaaaaagctacttaaactaaaaaaaaaaaaaaaaaaaaaaaggtattgaattgctgtttttacagtaataaaactatcaaaagaaaaaaatgaaagtacacagagagggtcactctagcgttaaaataagcaatagtgaatacaagaaagatgtggctgggagcactggctcacacctgtaatcccagcactttgggaggccaaggtgggaggatcacgaggtcaggagttcaagaccagcctggccaacatagtgaaacccccgtctctactaaaaataaataatacaaaaaattagccaggcatggtggtgtgtgcctgtaatcccgctattcaggaggctaaggctggagaattgcatgaacccagaaggcagagattgcagtgagccgagatcaccactgcactccaacccaggcgacagtgcgagactccatctcaaaaaaaaaaagaaaaaaggaaagaaagaaaagaaaaagaaagatgcaaagaaaggtttagcttagcagttagagaaaatgattttgacatgaaggttaatcaaataagaccattgcttacttaatagagtagttatattaaaatcacagacactttatgaaaatgcagatttatttatagacagagtataagggtcctatttcaagcagaaaatacaacagatataaaaagagttctttgcaaccttttcatctgaacactactaatgatttggtcaaactctgaaaacaggctttaataaaattctctctctactaaaaatgtgctaagtgggtttgtctgacaaaataaagcattcaggatatcttgctaactttatatcctcctagctaatatacattatttactcatattaaatacatgtctacattttcctaatggattactacagacatcacagactacctgtaaacatgcactctttatcctgaatcaagaggacatggcaaagtagaattcatttacaaaccaggataaatttccaaatgtcttcaactttaaggtttctatttctcaagttatttatactcatatgtttatcatatattatctatataattatgttatttatttatttatagagagcatagttatttaaatgatcaaaagtctagaacttttcctagccatttccttataagcaagccatctcctgtttaatttcccattggctttagaactactctggcttccttattttgaggtatacattagtcttcacaacccagtctagtctgcttctgaaggggtgatgttaagaaatgagagtgaagccaagatgcactaggatcgacgccaggttcagagaatgaaattagaagtgaagacaatgccaaggtaaactaagccatcttttacttacagctgacacatgttgcaagaggcacatgacatcaatcatgtccgcaaggataaggagtctcgtcaccgcagccagcaaggcacgggcagcttgaaccacagcctccctttttgggagaaaacaggggtcatctgtaaatctctcagctgatactttcagagcttcacctgaaaaatacaaccccatataagttatactttaagtttcaactatgcctatttcaggatttatcagctaacctaattccaagtaaattccaagactaagcataatataaaaatattgtcagttgacaattttctctctcaataaacaatgcagtttcaaattaacatttgtttttcacaaatattttggaattaagaagcataatatcattttcctgcaagaaagttgtgctcaactgactaggaacatctagtaaaattgctgccaacttctgcatttgctgaatctcatttcttgtaaaaggttttattactaaagcttcaatcataaacaatcctgcttataaaaacaaggtaaatctttattgagttactttccaaatcaatggatgttaggactgcagctctctgataaaagtttaacataggcaaatttattctaaactatcaatataatgaataaactatatcctaaatttagtcacagaaatagtacttcatagtacctaattgttagagaatattgtgtccactatttttaatgccttttcatttaaaatatattttattataaaagaaatatgtattctttcattgttttaagttcccagttcaaaagggtataaaatgaaaatatttaataaaaaactctctttactcccatccaacaacataattgataattaccacatccactattttttaagtttttaaatctaaacttctttttattataaaagtactataatacgtgtccattacttttaaataatttaccacactaaagaacatcaagtaaaaattttaaaagtctccaaactaatcccccaaagcaccaactattcagctcttgcatatctgtccagaaatttttccatgaatgtatgatttatgtgtataagcatatatagatacatgttttatatacataaatgtatatgtatgttttatacatgtatgtgttttatgaatatattcatatacattcatatatacaaatatgttttataaagacagattttataagaaaacatattttatatgttataagaagaaaatgtaaaaatatagagcctttagcaagtagtatcctactagagagattttctgtaatttcttctttttgcttttcaatttattttcctttcatactgggaaacagatgaccaggaggcaatatagcacagtaattaacagtgtgtactctggagccagactgcttcaatgtctctgtcctagtatctcaatcaagtcacttaacatcattactcttcgttttcttctttttttaataatataaaataataaacctactattttatgagtattaaataagagtacataagttatatttcattgatacactgtaacttattttaccaggcccctattgaacacataagtcatttccaactttttcctattttatataatactataaagaacgtccaggacatatatctttacatgcatgaacaagtttagctttaggataaattcctaaaagtagaattcctgagtcaaggggcaaatgaattttaagttttgttatatattgccccaaaattctccaaaatacagtcatcccatcaaaaatatacaaaagggtctgtcttatccatttatggattacatccataaatattttagtttcattgactcatgaaccttaacataaagaaaactgagtcagttattttattaaataaaataaagaatactgtttcttataatagacaaaacttgtgaggagggtctgagactgtctcaacatgttagtatgtctcatttagatctctttagcaataccaagttaggaactaggactctagacacttctgagatcaaattcatatattccccctctagttctgggaacttggacagtaaatgccttcaatgtccttatctataggaaaggggtaaaaatatgacttatctcatagtgtttcttggatgcttagatgacagcattcatatatttagcacagtatttaaacatggaaagcactcaacaaagattaactgttattttggaggaaatttctaatagagatggtaaatttttaatgccaataagtgggtgattttcatctgcttctctgcaagtcagaattgctgctatgagactgtgaaaagttaaactgacttccagaatttagagagcagatgaatgcccacaaaaaagattaattttttctttttgtgattctgagttggaaagttataatagcctttttagaatactgtctttgacttcacatactaaaactaaatatatatcaaaaaattatgtatttttgactctaaaaatgttggaatgttgaacaactggctggagagccatattcagaaagagatcatttaaacaattagtatattcttgtctttgttaaaggaatataaacagccagtcaggtagctctgttgggaagagaaaagtcactcccaaaatacattaataaagatgctacaacttaaattcttattgctggacttatccctaatttccccaatattcctaacccttttcagctggtttcagcccacactctggtcctaagttaaacatcacttcctatgggaagcttggaccccccattaccaagataggtcttacaataagattctatgttttctagcataaccttcatcataatttattataacaaattgtatcaaaacctgtcttttcttctggatcataaaactagtaagtgcaagagctgcattggccctggtcaccacagcatttccaggatctagaagagtgcctactctgttgcagatattcaatacattgactatctactgccaaatgaatatatgaatgaacattattcaacttttctttgataaacatttgttgttccctctataaaacagctgtatcctaggtatccaggatatagatatcagtatgaaacagtatttttgcagcccaagaagttcagatcaagtgaaagtcaacaaacactgatacaggtttctggtacaggcctgtacaaagtactaagagacacagaggaggatctacctctgcctgaggtgtcagaagatatacaaaggaatgttctaggtaaaagaaacatgttccaactattgataaggtattgacaacgacagctggtttatagaatttagccagttcactgtcatattgatttctgacaggagaaaatggttattttcctaattaaatagaaaaaaaggtacaggtttcctttccatctagaatattagcatctatgttttataaagtctacatgtggagagtctactcttttgaaatatcattcccaatcttgcttataatgcttttactttgaagtttgctgaataggaaatttcacttttaaaatacatacaaataaaaataactacattttttcttcaagaaatcccactctatacataaaaataatttactaaaggtcttgaaaatgccagaagaactaggtttagaaaacttctttctactgagtccatttagttcctttcctaaaaacgggattttttttaatcgttaaaaaaaatcagttatgaaatgcctaggtactagagtatatagtctacaaatatctatagagataacttttacacacctatataagtgtaagagatgacaatttctgaatatacaaaaatctggctgataaactttttatatgatcaaataaataaactccagaagtacaaaaaaattgttggccaaatacacatattaccaaatattctttattttataaagcttcctatatggttattttacaagttcctttgcttcatttaaaagtataattctactttctaaaagtgcttatattgattataaacttaaaagtcaaggaaaacatagtataagaaaaatatccagaggaaaaagagaataaccaaaatgaaaaggggcaggtactaaagataaaaaacttcccaaacttttacttgacattatgtttattattcaattaagatttctaatatatgcatctgtccaagtgatacaaatacatcatggtaaaaggtttatatcatacacatataacatgcattagtacatattcattgattcaatatataatagggttcacagactgagactcaacattcagggtttggttttatttgtttttggttgggaaactgccattttgaatttgaaaactctgaagaggtagaagcttgaatttaactttttagcagacaattattttatttggcagggaagagaggaggatgacctcaattcgatcctaaacttacacagatgttaaaaaaaaatagtaaagactcccctttaaaatgttcaagacagtttgactactaggagcaaacatgttttgtatgataaaagaaaaccttatcatggcaggtggaagggcagcaaagctagccactgctgtgtggacccaaggttgggtgctacggcagggttatagactaggaatgtggctgcatatggttgctattgtaaactattggctatgtcttatttccattttattatcttcgaactcagtaaagtcttattaaaagttataatttgcttccagtcaagggagaataacagagaccagattcctttcctacctgaaacaaaaaaatagaccaaataaatgcaaaaatggttataaggcactggatgttaggcagtgaaggacagtaatccctgagaaatggaccaaaaaaaacaggatgagccctttgatagccccagcttaccaccatgagagactttccaggcaatgatacaggaaggggaaaccaaggcagagcctggcaaactctctgagctggggagacaaagctgagagtcctgggagatcaaggcagtaaatgtataaaacagaatagagaatgataaagggaagagatacacagagaaagaacactgataatctgcacatgctccctcttgagtattcagctgaatactgatcaaccagtatactggaggaaaccacccaaggctagggaaagaaccacccaaaaggatttgaggtaactgtacttgccactcacacaggactgggaataatgcttgtccaaccaccagactggaaaacttcataactcatgggacattggatagaatacaaagaagagtcttgcctcaatagtggggaagaattagccttagactgaacattgccctagtgccttctaacaaagcaattcagagaaaacagaattcccaatttcaagaccagcagcattcatgcatcagagaagagagatagccaggtaaaggcaacagcagactagcataatgatttaatgaaaatggaaggacatgagcagccagtcactgagcgctgcaccattgggaactctcaaaataagctgggaaatactttgattgggctgattctattaaaaaaaattttttcataactaatctgtgtttttttattattatactttaagttctagggtacacgtgcacaacgtgcaggtttgttacatatgtatatatgtgccatgttggtaaaattatataaaatgttttataaaacataaaatttgatggggctagtttctataaaagtaatagaaacatctcccaacatcatagataggatatagtagaagctgtcttaaaagacctcctcttaaccacctctctagattaataaactttttattcctctcagcaacatattaatggtatctcctttccggtatgtaaaatatactgaagaccttctgcttccaataattgaagttaatcaagaagttgaaaaggcttgctccccaatcttttcatgtgagttgtaattataattatatagttttattaactatataaacctatcaaatataagtgtaaaaatatctattaattctttaaaaactaatttttaatgctttagagacattcagtaaagatgagttgttaagttgggtatggaaggaaaaaatggtaaaagttggagcagggcaaggcaaggaaaaggattataaaagatcaagaaagattctgcagttaggtagcttcgcaagtgtcattaagttttcttccatgaagacaccaaaactggaaattttagtcaatatagtttggttgtggtttcggtcaaaacgactatataagttatgcgtttgtgtgtgtacaactaatgaactaatgaactttttacttctaataatgagaacaaatatatcttgaagcaaaaattatctgctatattttaaaacactggaaataactttcagtcacatttagtcaaactttaattatgtacttgtatgtaaaagtacacaactcctaacttaaaactttattaatatctttttatgagcaaaatattttgtacaatgtatctataaactatgcacctaaataaatttcaatattaaggaagattttaaaatagagctaaacatctcttcagaatttcaaagaaaaatgaaattttttaattttcaaaaaattgaccaagtaatttcatgtcatatttaaatttgacaatttttttttctatgcaggctctcactttgtcacctaggctggagtacaggggtaatcttagctcactgcagtctcaaactcctgggatcaagcaatcctcctgcctcagccttccaaggagctgagactacaggtatgcatcaccaaacccaattaattttttgtatctcttatagagatagggtctctttttgttgcccaagctggtctagaactcctggcctcaagtgatcctccctcttcggcctctcaaaatgctgggattatagccatgacccaccccactgagctaaatttgacaataattttaagataataaaatacacaaaatatattcctgcaacattattatcatctcctggggttagaagtttcatatacctaaagtggtttacagtaaaacaaactgacaaaggaacaaagcaatccatattgtaaaccagtcaataaaaagaaaatagtatggatttataacttaaataaatgtttaaactttgagctgaaatagctgcccataattattctctattgaatttctttcccaacaacctattgactgatatgccacccaccaataaacacttttatattattcttgatgtaaatttaattcttttgaggtgaaaaaataaaccttataactaagatttccgactaaagttaatttatcattttttctaatatttccttttatggctaaatgtagtaagcttagccatgaatacacttaaattatactatgatgaattggcaaaaactgatatctttgcttttttgacatctgctaaaagaatctcattctagtgctttgaagttgaaagttaatttttaataaatgatacctaacccttacaaacagttcattcattcatatatcaactattcagcactaaaatacgcaaagcactatggggtatacaacaacgattataacatggtctccaccaggtaccctcaaataggaaaatgaaccacttcaatgagaagattcttctgtttggttttaaatgtcagcatcttcagatacacctaccttaaagtatattaagacataattccatagcacctcccccccaaaaaatacaagtataataattcttcatatgcacaattcctagatttcaatattttatgtatgatttaaaagttctctgagaaaaaatgaaaaacgagagtgactacatcaaaggatcactcaatcattttaaaataaaattaccagttatcaattatcacttataatcagcctcaacaaagttctattcatcaagaggttaagtaataaagtagaattcaggcttcaccttactagaaattcaagtcccacagctgtgatcagagcaataaatatttaacaaatttattctttcatatatcaccccattcagagtactacagctgttaatcagtaaggtcaaatttggccctattgatatgctccttatgcagaaatgacagaagttattttagggccccattataaagtcttagttcacaagctcacacaaaacttgcaaggaagtcaatgtggccaactgtacatactgaaagtacagagtgaaacccaaaggagcataaaaatttagtgaagataaacatccaggattctgaaccattacaaaagtaaatacattccattcacaagagcatccaacaaataaaacatttaggaataaatttaacaaagaagtgtaagacttgtacactgaaaactgcaaaacattgctgacaaattaaagaagacctaaataaatgatcatatctcatgctcatggattagaagacttaatattgttaagatagcaatactccccatatcggtccacagattcacaataatccctgactgatatcgcttagatgtttatccccgccaaatctcatgttgaaatgtaatccccagtgttggaggtgggacccagtgggaggtgtttgggtcatgagggtgcatcccttatgaatgtcttggtgctgtcctcatgataacaagtgagttcttgctcagttcccatgagatctagttgtttaaaagagtctgggacctcgcactcctcttgctcccactctcgtcatgtgacaatgctagctccccctttgccttccaccatgattggaagcttcctgaggccctcaccagaagcagatgctggtgctatgctccatgtacaatctgcagaaccataagccaattaaatctcttttctttataaattacccagtctcaggtgttcctttatagcaatgcaaaaatggactaacacttttaacaaaatccttactggctctttcaaagaaattcaccagctgatcctaaaattcatacagaaatgcaagggacccagaatagccaaaacaatcttgaaaaagaggggcaaagttatagaaatcacacttcccaatttcaaaacttactaggaagctataataaccaatagaattgctatctcagaaataaacctttacgtttatggtagatcatagacctacttgcaagagctaaaactataaaactcttagaaaaagaaaacaggaatacaactttataatcttgagttaggcaacaatgtcttatatataacaccaaaagtacaagcaataaaaaaaattgatgaactggacaatcaaaacttaaaccttttggactccaaaaaaaaaatcattaagaaggtaaaaagacaacacacagaatggaagaaaatgtttgtaaaccctatatccaataaggggcttatatccagaatctattaaaaaaaaacttactacttaataataaaaagacaatcctgtttttaaaataggcgaagagtctaaatagacatttctccaaagaaaaaatacaaatggtcaataagcacataaaatgacattctatcataaatataatctaaattattaaagcataattaaagatgtacagaggttttagtaaggacctttgaataagttttttttattatttaaaaataggcacatttcttgtgtagtcaaaaacacaaggctaaaaacatacctgcagaggggaccaaaaaaaaatcaatgtgtatgtatatgtactggaaactgtcactttaataactgtaaaaactagtgagtaattattataatgaagcagtagaaaagtaacatttacatacattgcagctaacttctctccttggggggaatatcaagatcattaaaagggtgggggtagagggtgtcgatcttgttcaccatgctgccccaaaaccatgagcagaatgcatctctctcggaaatccctggagaccccatagagctcattttgtagctaaaagcaaactctgagctataaatattagttgtcttttgcacaaaaattaacagtagctttaattgtcctttctttttacttttcccaccaatgatacattcagtctgagaaacttgagattcttaacaagtaagaggtcaaatatttttgaaattccttgtattcttagttcctttacttcagacagagtcggcaaactatggaaacaagccaaatccagcctgccctgtttatgtgcagcctacaagctatgaatgttttttatatttttaaaggttgggaaaaaatcaaaagaataatattttatgacatgaaaaattatataaaatgtaaatttcagtatacataaataaagctttattggaacacaaccataactttttgtttattgcttacatatttctatagctattttcattcttcaacacacagagttaaatacttgcaacaatgtacggcccacaaagcctgaaatatttactttctggcctttcacagagaatgtttgctgatccctcatctgagataaatgaactaataaaattcataatctgtttttttaaaaagcacttcatttttaaaaagttcatacaactaacaagggtctccattttgatatatataaatgtggccctaaaaattctttttcaaaaattatttagttggctttcatatcttaagctgaatacatggaccttgcctgaaaatcccagacaacataaagttgagtttatcccttaaaagaataaaatttgacccagcagtctttcagcttcagtattcatatatctaataatattagcatctcaggaatttcccatatgcctcagttaaatagttccccgaagaatactcagccagctctaaataatgctcccagtgtaatatcaaaaggaggtatgaattttctcctcaccccaaagcataatagtgaaaaactatactgcaggagtcaacagccagctcatctaccttgttcgctacctttcaatgaaatcctgagcaagtcacataattttttggtatcaatatccttattatgcaaacacaaagattatggaaacacatagaataaagaaaataggtgaaataaagaaataaaggtgaaatgaagaaagaataaagaaattatttaaagaataaagaaattctttttttaaagaataaattatttaaattaagaattctttatttaaagaataaagaaattcttttattaaagaataaagaaatttctttaccgtagaataaagaaatttctttattcatagaataaagaaataggtgaaataaagaaaataggtgaaagcctttagttctcagagaaacatactaaataaacatggagtttttaaaaggcaaaagtatcctcactgctgtgttcatattttatatattttagtgtgaagatttatcacgtcaaaatcaaggctactcccatgaaacttacagaagaatttcccatggagcttcagcaaactttcgtgtctcagtctatcataaatctcagcttgctattgacagggaaaggaggcagagaagagctgggtagaggagggtgtggttcctggcgagggctccacctccaggcctgtgcccacagacctaggtgaggacaggcactcctgactttgcacccaaatgttgcatttcccaggactgtcctggcctgccactccccagtcctgtgcctgtaaaaactcccgagactctggcaggcagacacacaagcggctgcacgtggagagaaacacatcttggtggaggaatacacaagcagctgaacattgagagggcgtcgagaggaggagatcggtggaagaagacacaagtggctggacgtgaagaggacatcaagagcagacccgcaggccatcgaccggtggaacgacgtggagttttactgggcagtcggagaagagtcaggcagttttctaggggaaaccatctcctttctgtctcccccacctgctgagagctacttccactcaataaaagcttgaactcattctccaagcccatgtgtgatccaattcttctggtacaccaaggcaagaaccccaggatacaaaaagccctgtccttgagataaggcaggggtctcattgagctaacgcaagccgtctacggatggctaaactaaaagagcaccctgtaacacatgcccactggggcttcagagctgtaaacattcgcccctagacactgttgtggggttggagccccacagcctgcccgtctgtatgctcccctagagatgtgagcagcggggcactgaagaagcgagccacactcccatcacacaccccctgaggaggacaagggaacttttcccgtttcactatcaatcacactattttaggggttcaactgtccataaccagtggactatcaatagaaactctcacttccaaatgcctccctcagggatgtttgaaactggtatttattaaactgggtaaatgccatagactaaagaggaaagaagaggtcaaaaatattgggtaaaaaaaggagcaatgaaaaattttggaatagaaggaggaaacggtgaagcaagtaagggaaaataagagttgctaattctttcttttgggttatcagtatagactgaatatttgatgaggaagataaaacaggagatctcattgatagccgctagtgtccaaaagcaaagaaaaatgagaagtattatctcatataatgtgctagcacacagaaaaggataacaacgcacattcaagaatacaatacgacaattcaaggatgcatttgatattacaggtccatgcatatttaagtacaatcattccttattttatagtttcttataggttttttttcgttgttagaggttagacctgaaccagccaaatccttgagccaacttggaataatgattatatgattttcatgcaatactattttttttcttcaacttttaagttcaggggtacatgtgcaggatgtacaggtttgttacctgtacatcgacgccctctcaatgttcagctgcttgtgtattcctccaccaagatgtgtttgtctccacatccagccacttgtgtgtctgcctgctagagtctcgggggtttttataggcacaggactggggagtggcaggccaggacagtcaggtaaatgtgtaccatggtggtttgctgcatagatcatcccatcacctaagtattaagcccagcacccattatcaattattcctgatgctctccctccccaacccaacccctgacaggacccagtgtgtgttgttcccgccttgtgcccatgtgttctcatcactcagctcccacttatatgtgagaacatgcagtgtttggttttctgttcctgcattagtttgctgaggataaggacttccaattccattcatgtccctgcaaaggacatgatctcatttctttttatggctgcatagtattccatgatgtatatgtaccacattttcttcatccagtctgtcattaatggatgcaatactattttgagtggattcttcatcaatttttttctttggcccttttttaaccccgtttttttaccacccaatctctttcattgccagaaacttctcttgttctgtgatcttaaattttcactgatttgggggcactggtgcaccttttagttttgtctttcaactgtgatttcaatttgagcaggaatttagtatggaatgtgtgtgtgataaaaacagttttgctgtaaagaacatgctcttcaataaagttcaacaactcctttctctccataatagaccctcaggcacttagacacactagctcctaaaaatcgtttgtaactataccccttaaatctatatttaataataatatattatgtacaaaatttaattcattttacctaggtttatacatactaactggtactttgaagtcaagtcattctttctaaatgcttcttttattagaaatgagttcataagctgtgatcctggaaaaacatcttgagtcactatcgaaatctaaacattttaaagtcctcttaaaatgttactaattaactgagagagtctttagcccaaagcgtctcctattagtgtgggagaaataatagtaatctggacattaagaaacctgcattttacttattagcagcatttgaggaatggcatttaaaaatacgggaaataagattattctctgggaattaaactgcagtcatcacttacacaatggatggaagagatatacaaaaaaagaaaaagaattttcttctcacattcaagaatacaatagaaatgaattatattttgagggtcaaatgaccagtcatctttttttcttttcttttttttttaattatactttaagttctagggtacatgtgcataatgtgcaggtttgttacgtatgtatacatgtgccatgttggtgtgctgcacccattaactcatcatttacattaggtatatctcctaatgctatccctccccgttcccccaaccccacgacaggccccagtgtgtggtgttccccaccctgtgtccaagtgttcccattgttcaatgaccacctatgagtgagaacatacagtgtttggttttctgtccttgtgatactttgctcagaatgatggtttccagcttcatccatgtccctacaaaggacatcaacccatccttttttatggctgcatagtattccatggggtatatgtgtcacattttcttaatccagtctatcattgttggacatttgggttggtttcaagtctttgctattgtgaatagtgccacaataaacatacgtgtgcatgtgtctttgtagcagcatgatttataatactttggatatatacccagtaatgggatcactggatcaaacagtgtttctggttctacatccttgaggaattgccacactgtcttccacaatggttgaactagtttacagtcccaacagtgtaaaagtgttcctatttctccacatcctctccagcacctgttgtttcctgactttctaatgatcgccattctaagtggtgtgagatggtatctcattgtggttttgatttgcatttctctgatggccagtgattgtgagcattttttcatgtgtctgttggctgcataaatgtcttcttttgagaagtgtctattcatatccttcacttactgtttgatggggttgatttttttcttgtaaatttgtttaagttctttgtagattctgtatattagccttttgtcagatgggtagattgcaaaaattttctcccattctatacgttgcctgttcactctgatggtagtttcttttgctgtgcagaagctcttcagtttaattagatcccatttgtcaattttggcttttgttgccattgcttttggtgttttagacatgaagtccttgcgcatgcctatgtcctgaatggtgttgcctaggttttcttctagggtttttatcgttttaggtctgacatttaagtctttaatccatctggaattaatttttgtataaggtgtaaggaagggatccagtttcagctttctacatatggctagccagttttcccagcaccatttattgaatagggaatcctttccctatttcttgtttttgtcaggtttgtcaaagatcagaatattgtacatgtgcggtattatttctgagggctctgttctgtttcattggttgatatctctgttttggtaccagtaccatgctgttttggttatgtagtcttgtagttcagtttgaagtctggtagtgtgatgcctccagctttgttcttttggcttaggattgtcttggcaatgcgggctcttttttggttccatatgaactttaagtagtttttttccaattctgtgaagaaagtcattggtagcttgatgcagatggcattgaatctataaattaccttgggcagtatggccattttcacgatattgattcttcctatccatgagcatggaatgttcttccatttgtttgagtcctcttttatttcgttgagcagtggtttgtagttctccttgaagagatccttcacatatcttgtaagttggattcctaggtattttattctctttgaagcaattgtgaatgagagttcactcatgatttagctctctgtttgtctgttattggtatataggaatgcttgtgatttttgtacattgattttgtatcctgagactttgttgaagttgcttatcagcttaaggagattttgggctgagacgatggggttttctagatatactatcatgttatctgcaaacagagacaatttgacttcctcttttcctaattgaataccctttatttctttctcctgcctgattgccctggccagaacttccaacactatgttgaaaaggagtggtgagagagggcatccctgtcttgtgccagttttcaaagggaatgcttccagtttttgcccattcagtatgatattggctgtgggttttcatacatagctcttattattttgagatatgtccaatgaatacctaatttattgagagtttttagcatgaagggttgttgaattctgtcgaagccttttctgcatctattaagataattcatgtggtttttgtctttggttctgtttatatgatggattacatttattgatttgtgtatgttgaaccagccttgcatcccagggataaagcccacttgatcatggtggataagctttttgatgtgctgctggattcggtttgccaatattttattgaggatttgtgcatcgatgttcatcagggttattggcctaaaatcctctttttttgttgtgtctctgccaggctttggtatcaggatgatgctggcctcataaaatgagttaaggaggattccctgtttttccataaattggaatagtttcagaaggaatagtaccagctcctttttgtacctctggtagaattcaggtgtgaatccatctggtcctggaatttttttgtttggtaggctcttaattattgcctcaatttcagagcctgttattggtctattcagggattcaacttcctcctggtttagtcttgggagggtgtatatgtccaggaatttatccatttcttttagattttctagtttatttgcttagaggtgtttatagtattctctgatggtactttgtatctctgtgggatcagtgttgatatcccctttatcattttttattgcatctatttgattcttctctcttttcttctttattagtcttcatagcagtctatcaattttgttgatcttttcaaaaaaccagctcctggattcattgattttttgaagggttttttgtgtctctatctccttcagttctgctctgatcttacttatttcttgccttctgctagcttttgaatgtgttcgctcttgcttctctagttcttttaattgtgatgttagggtgtcaattttggatctttcctgctttctcttgtgggcatttagtgctataaatttccccctacacactgctttaaatgtgtcccagagattctggtatgctgtgtctttgttctcattggtttcacagaatatctttatttctgccttcattttgttatgtacccagtagtcattcaggagcaggttgttcagtttccatgtagttgagcagttttgagttagtttcttaatcctgacttctagtttgattgcactgtgaccagtcatcttaaagtaacagaatggatcccaggcttcaatggctaaccttgactataaattaactaaaagttttggtatatctaaaaaaaggaattatcaatcaaaaagggactgtgtcaaccatggaaaaaagaaagttggtgatattcatccaaacagtttccaacagagtaagagctttatataataaaccatacatagtagaaccccattggtaagattatctctacagaaaggatagatgaatctgatgatttttaactttcaccattaagcattcaatttatccagcctcctttgttctatctctatgctcactaagcaatcttctgattattatttatgttgcctatattgatccatctacagtgagagaacatattggttgtgtgggtgtactttgttctgcataactttttcattataaatttaaaataggttctgattttacatcttagcttcatgatcttagttaatgtgagtatactcctgagagacaaatctggtcttggcatatgtatctgaaagggatctcagtttcaaataacagaatctattctaactaatttaaaaggtaaaggaatttgttcagggttattgggttgtttacagaatttctgcaaggcccagaaaagccaggtttgaatgatattaaggcaggaacatcaaccaagaacaacttctaatgccaccatagctctattttaggtagaaaccccactactaccaccactcattactcaacacctatgatactaggaactgggcctgagaaactctgtcagggctgccctaaaagaacaaatgcttctgccactagattgcaacaagaccctatctctctaaacatggccactctcatactgcttacctcatccttccaagtttcacaggtatgcatcttttttgcagaacctaagccatattcccaaatgcaagaagagtcttggaaatgtatctttttatctttccaacctttctaaacatggccactctcatactgcttacctcatccttacaagtctcacaggtatgcatcttttttgcagaacctgagtcatagtcccagatgcaagaagagccttggaaatgtattttttatctttccaacctctgtagtatggtccctcccaaatatactccactagaaaggagctggaataggtcaagtgaatcttaccttattaaaactattatactgcttaaaacacttttaaaactgtgtcatgtttgacacctcttccacccacccctttttctctcagttctaccatgcttaaaaataggcttttaatatcaattctattcttcactgagattgctataaagatcttgccattgatatatgtcaaagtgttctgaaaaagcatgaaactatctgaatgcggctggcagccaagatggccgaataggaacagcgccggtctacagctcccagcgtgagcgacgcagaagacgggtgatttctgcatttccatctgaggtaccgggttcatctcactagggcgtgccagacagtgggcacaggacagtgggtgcagtgcactgtgcgcgagccaaagcagggcaagcattgcctcactcgagaagcgcaaggggtcagggagttccctttcctggtcaaagaaaggggtgacagatggcacctggaaaatcgggtcactcccaccctaatactgcgcttttccaacgggcttaaaaaatggcacgccaggagattatatcccgcacatggctcggagggtcctacgcccacggagtctcgctgattgctagcacatcaggctgagatcaaactgcaaggtggcagcgaggctgggggaggggtgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtgcttctcccagcacgcagctggagatctgagaacaggcagactgcctcctcaagtgggtctctgactcctcacccccgagcagcctaactgggaggcaacccccagtaggggcagactgacacctcacacggctgggtacccctctgagacaaaacttccagaagaatgatcagacagtagcattcacggttcacgaaaatacgctgttctgcagccaccgctgctgatacccaggcaaacagggtctggagtggacctctagaaaactccaacagacctgcagctgagggtcctgtctgttagaaggaaaaataacaaacagaaaggacatccacaccaaaaacccatctgtacatgaccatcatcaaagaccaaaagtagataaaaccacaaagatggggaaaaaacagagcagaaaaactggaaactctaaaaagcacagtgcctctcctcctccaaaggaacacagctcctcaccagcaacggaacgaagctggacggagaatgactttgacaagttgagagaaggcttcagacgatcaaactactccgagctacaggaggaaattcaaatcaaaggcaaagaagttaaaaactttgaaaaaaatatagacgaatgtacaactagaataaccaatacagagaagtgcttaaaggagctaatggagctgaaaaccaaggttcgagaattacgtgaagaatgcagaagcctcaggagccgatgcgatcaactggaagaaagggtatcagtgatagaagatgaaatgaatgaaatgaagcgagaagggaagtttagagaaaaaagaatgaaaagaaatgaacgaagcctccaagaaataggggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacaccacaaagatactcctcgagaagagcaactccaagacacataattgttagattcaccaaagttgaaatgaaggaaaaaacggtaagggcagccagagagaaaggtcgggttacccacaaagggaagcccagcagactaacagcggatgtctcggcagaaactctacaaaccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaacaggcctgccctaaaacagctcctgaaggaagcactaaacatggaaaggaacaaccggtaccagctactgcaaaaacatgccaaattctaaacaccatcgaggctaggaagaaactgcatcaactaacgaggaaaataggcagctaacatcataatgacaggatcaaattcacacataacaatattaactttaaatgtaaatggactaaatgctccaattaacagatacagactggcaaattggataaagattcaagacccatcagtgtgctgtattcaggaaacccatctcttgtgcagagacacacataggctcaaaataaagggatggaggaagatctaccaagcaaatggaaaacaaaaaaaggcaggggttgcaatcctagtctctaataaaacagactttaaatgaaaaaagatcaaaagagacaaagaaggccattgcataatggtaaagggatcaattcaacaagaagagctaactatcctaaatatatatgcaccaaatacaggaggccacagattaataaagcaagtccttagagacctacaaagagacttagactcccacacaataataatgggagacttaaacaccccactgtcaacattagacagatcaacgagacagaaagttaacaaggatatccaggaattgaactcagctctgcatcaagtggacctaatagacatctacagagctctccaccccaaatcaacagaatatacattcttctcagcaccacatcgcacttattacaaaattgacaacatagttggaagtaaagcactcctcagcagatgtaaaagaacagaaattataacaaactgtctctcagaccacagtgcaatcaaactggaactcaggatcaagacactcactcaaaactgctcagctacatggaaactgaacaacctgctcctgaatgactactgggtacatgacaaaatgaaggcagaaataaagatgtcctgtgaaaccaatgagaacaaagacacaacatactagaatctctgggacacattcaaagcagtgtgtaagggaaatttacagcaataaaagcccacgagagaaagcaggaaagacctaaaattgacaccctaacatcacaattaaaagaactagagaagcaagagcaaacacattcaaacgctagcagaaagcaagaaataactaagatcagagcagaactgaaggaaatagagacacaaaaaaccctgcaaaacaatcaatgaatccaggagctggttttttgaaaggatcaacaaaattgatagactgctagcaagactaagaaagacaaaaagagagaagaatcaaacagatccaataaaaaatgataaaggggatatcaccgccaatgccacagaaatacaaactaccatcagagaatactataaacacttctacacaaataaactagaaaatctcaaagaaatggataaattcctggacacatacaccctcccaagactaaaccacgaagaagttgaatctctgaatagaccaacaacaggatctgaaattgtggcaataatcaatagcttaccaaccaaaaagagtccaggaccagatggattcacagccaaattctaccagaggtacaaggaggaattggtaccattctttctgaaactattccaatcaatagaaaaagagggaatcctccctaactcattttatgaggtcagcatcatcctgataccagagccgggcagagacacaaccataaaagagaattttagaccaatatccttgatgaacattgatacaaaaatcctcagtaaaatactggcaaactgaatccagcagcacatcaaaaagcttatccaccatgatcaagtgggcttcatcgctgggatgcaaggctggttcaacatacacaaatcaataaaggtaatccagcatacaaacagaaccaaagacaaaaccacatgattatcttaatagatgcagaaaaggcctttcacaaaattcaacaacccttcatgctaaaaactctcaataaattaagtattgatgggacatatctcaaaataataagagctatctatgacaaacccacagccaatatcatactgaatgggcaaacactggaagcattccctttgaaaactggcacaagacagggatgccctctctcaccactcctattcaacatagtgttggaagttctggccagggcaatcaggcaggagaagtaaataaagggtattcaattaggaaaagaggaagtcaaactgtccctatttgcagataacgtgatagtatatctagaaaaccccatcatctcagcccaaaatctccttaagctgataagcaacttcaacaaagtctcaggatacaaaatcaatgtgcaaaagtcacaagcattcttatacaccaataacagacaaacagagagccaaatcatgagtgaactcccattcacaactgcttcaaagagaataaaatacctaggaatccaacttacaagggatgtgaaggatctcttcaaggagaactacaaactactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagacaatcctaagccaaaagaacaaagctggaggcatcacactacctgacttcaaactatactacaaggctacagtaaccaaaacagcatggtactggtaccaaaacagagatatcaaccaatgaaacagaacagagccctcagaaataataccacacacatctacaaccagctgatctttgacaaacctgagaaaaactagaaatgaggaaaggattccctatttaataaatggtgctgggaaaacaggctagccatatgtagaaagctaaaactgaatcccttccttacaccttatacaaaaattaattcaagatggattaaagatttaaatgtcagacctaaaaccataagagccctagaagaaaacctaggcattaccattcaggacataggcacaggcaaggacttcatgagttaaacaccaagagcaatggcaacaaaagcctaaattgacaaatgggatctaattaaactaaagagcttctgcacagcaaaagaaactaccatcagagtgaacaggcaacctacagaatgggagaaaattttttcaatctacccatctgacaaagggctaatatccagaatcgataaagaacttaaacaaatttacaagaaaaaatcaaacaaccccatcaaaaaatgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttaacactgttggtgggactgtaaactagttcaaccattgtcgaagacagtgtggcgattccttaaggatctagaactagaaataccatttgacccagtgatcccattactgggtatatacccaaaggatcataaatcatgcttctataaagacacatgcacacgtatgtttattgtggcactattcacaatagcaaagacttgaaaccaacccaaatgtccaacaatgatagactggattaagaaaatgtggcacatataatccatggaatactatgcagtcataaaaaaggatgggttgatgtcctttgtagggacatggatggagctggtaaccaccattctgagcaaactatcgcaaggacagaaaaccaaagaccgcatgttctcactcataggtgggaattgaacaacaagaacacttggacacagggtggggaacatcacacactggggcctgtcatggggtggggggaggggggatggatagcactgggagatatacctaatgtgaatgatgagttaatcggtgcagcacaccaacatggcacatgcatacatatgtaacaaacctgcacgttgtgcacatgtaccctagaacttaaagtataacaactgtatatatatgcatatatgtgtgtgtgtgtgtatatatatatatatatatatatatatatatatatatatatcactatgatcaggtgggttttatatcgtgatgcaaggatagttcaacatggccaatcaataaaacctgatacattacataagcagaatcaagggaaagaaacatatgttcatctccatagatgcagaaaaagtatttgagaaaatacagtatcccatcatgatacaaactctcaacaaagtgggcatagaaggaatctccctgaaaataagaaagaccatatacgagaaacctacagttaacatcatactgaatgggaaaaagttgaaagcattttctctaagaactggaacaagacaaggatgcccactttcgccattcctattcagcatagtaccagaagtcctagccagagcagtcaggcaagacgaagaaatgtaaggcatccaaattggaaaagagaaagtcaaattatccctgtttgctgatgatatgatcttatatttagaaaaccctaaagactccatacaaaaactcttagatttgataaatgaattcagtaaaatttcaggatacagagtcagtgtacaaaaatcagtggtgttcttatacaccaataatgatctatctaggaaagaaatcaagaagtaaatcttatttacaatagctacaaaaagatatgtagaaataaatttaaacaaggaggtaaaagatctctacaaggaacactagaattcacagataagaaattgtagatgacacaaacaaatggaaaaacatcccatgctcatggatcaaaataattagtattgttaaaatgaacatactgcccaaagcaatctacaaattcaatgcaatccttatcaaaatactaatatcatttttacaggattagaaaaaacaatcctaaaattcatacagaaccaaaaaacagcccaaatagtcaaagcaatcctgagcaaaaagaacagaatagctattattttttttcccacacagttcactgatgtatagaatggctattattaaaaggacaaaaaataacagatgttggcgaggatgtggagaaaagaaaacccttatattctgttggtagaaatataaattagtacagcctctatggaaaactgtatggagatttcccaaaggactaaaaatagaactaccattgcatccagccatccactactgaatatctacccaaatgaagccaatatataaaaaagataccttcacttgtatgtttattgcagcactatttacaatagcaaagatatgcaatcaaactcagtgtccatcaatagatgaatggataaagaaaatgcagtatatatatattatatatatatacacacacaaacacacacacacacatatgtgtgtgtgtatatatatatatatatatatatatatatacaaaacctaggcattaccattcaggacataggcataggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctgatatccagaatctacaatgaactcaaacaaatttacaagaaaaaaacaaacaaccccatcaaaaagtgggcaaaggacatgaacagacacttctcaaaagaagacatttatgcagccaaaaacacatgaaaaaatgctcatcatcactggccatcagagaaatgcaaatcaaaaccacaatgaggtaccatctcacaccagttagaatggcgatcattaaaaagtcaggaaacaacaggtgctggagaggatgtggagaaataggaacaattttacactgttggtgggactgtaaactagttcaaccattgtggaagtcagtgtggcgattcctcagggatctagaactacaaataccatttgacccagccatcccattactgggtatatacccaaaggactataaatcatgctgctataaagacacatgcacatgtatgtttattgcggcactcttcacaagagcaaagacttggaaccaacccaaatgtccaacaatgatagactggattaagaaaatgtggcacatatacaccatggaatactatgcagccataaaaaatgatgagttcatgccctttgtagggacatggatgaaattggaaatcgtcattctcagtaaactatcgcaaggacaaaaaaccaaacaccacatgttctcactcataggtgggaactgaacaatgagaacacatggacacagaaaggggaacatcacactctggggactgttttggggtggggggaggggggagggatagcattaggagatatacctaatgctaaatgacgagttaatgggtgcagcacaccagcatggcacatgtatatatatgtaactaacctgcatgttgtgcacatgtaccctaaaacttaaagcataataataataaaataaaaaaagaaacagatgcaacaactatatttccaataaaacaagacaataaaaataagaaatgagaaaatggcaaaaaaaaaaaagaatgaaatatgtcttttgcagcaaattggatagaactgggtatcattatcataagtgaaacaagccagggacaaaaagacaaatattgcatgctttcataagtggatgctaaaaattgtgtataaatgaatgtagaaagtggaatgattgataatggagacttggaagggtgagagggttagagcggagaggatagtgagaaattggttaatgcgtacaatgtacgttacttgggtgatgaataccttgaaagccctgacttaaccactatgtaatctatgcaagtaataaaattacaggtgtaccccatatatttgtacaaagaaaaatctgtatcctttcatgtgaattatctggagcttgaatgtgcagtctaatgtctatagcctcggtagttatgcctaccagaggtagcaattccaaacagataccacgggcttcatgttcatgtatgtttactgggagaggtcttgcaaattaatggaagcttgccactgctaaactgcctcccatctatttttaattgtaggcctccaccaaggtcatcaagagtcagttggagggctaggaagattaatgtggagctttcgaatctatcagaagctaactatagctctccttcctaaatatggggttatggtattttgtattaaaagaaatgctatggtatttagtatattaatgcaggagcctcccagctgcatgtttgtagagcttaggcctacagtagttgacaacttgccccactttgcatggctcatgaatatgtctggcagggtagtggatgtagccagaaactaggggactttctctctcccttgtgagtagtaaactttgggttaaaaaatgttcacatacctcatgtgcataacatatgtacttgtgtattttttctatttatctctctttctacattttcatagttcttcatctcaatgtttgcaagactccaggctacagactgtttttttttttgcagtaggaattaggagtcaaggcttaccaccatccatattagtcagagaaaaccattacttccagaaatgattattcttggaaagtggcatcctggaagtgtacttaatcttcctatcagtatacttaggtacttaaacaacaaatggcattatagaattttcaatattgaacatttaaaatgttacctatcttctccctgattgttccagtatatatatatgtgtgtgtgtgtgtgtgtatagtacagtacatatttccttgcacgcacacacacacatatatatatgcatatttatatgcacacagacacacacacatatatatatatgcaaggaaataaattttgtcctagggaactagagattagaaaaatttttactggtgtccattttgggttacctgtattgaaagagcttttgaaactcagctatattgaatatttatttataaaagaaaatagcagttcaatttttgttaacgattcctaagtaacgggtcagctccatctacttgttcaacaatgttgcagttaggacttaggtgaaatgtttggtatttaccaccaattgctcacagcctatatatggtttcaaaggcaacagctgctgccctcattacttccatctcttactatgttggtgttgtgtgcatttaactgttattataacttaacaatgtccttagataagcattaagacacaaatgcaatattcttttcaacttggtatagcatgcttcaggagacgcagttcgttcttcatttgaaagagaatgatgaactcttgttctaacacattttaacatgcatgcattgtgtcctgtagctggcagaaagtttatggaaacatttccattgaagactgatgagataattagctacattgcttgtaaactactaattgctaaaaaaacgttcaacatggtattccataatgttctcttgaaaaatcttcagcagacttttcttttagtgcatttgatattttcagcaaactcctcagtgtcaaccattatgaggtgtgcggatgattgggaagtacttaatatgtgtgcatagccattccaatttgagttacttgatatgctggacatatagacaagctgatttaagaaataacagtaattccagtttttaaagtatgagaaattctgtaagctgtgtaccatttactttgaagtataattcaaaggtgggagcaaagatttaatgcatgttaacaggttgatttgtaagtaatgagtcctagaaactaaaatgtggcctgaaatctcagctggtaaagagtctgaaatcagaggtgtgattcttatattagccatggctctgctctccttcacagctatagcgatggcaccacagcgtagccatttcataaatgtgtgcaaaggtaacagagtgacctaaagtttatgttcacagaagatgggtctgaaaattattgttgtgttgcacattctagcattaaagagtgcattaagctattgcagttgctcagggggaggaataaaaatcttaagaatttctgtccttgactgtttcttctcatccctttcttaagtttcaaaagaagtggtgttcctttttgctctttaaaactaatctttccaatcattatctggatcttagctcatcccttctcttctcttctcgagagacttttattctacaattacctttttttctgtagcatgttcatttaccttccttttcattagttctttcttcacacatattagcttgcccctgctttacaactggcaaatattcaataacaattccactttcttttagtctactcttttcttaaactcctaatcctgttttacctgacctgttctgcttggtgtatttgttgtttaatccaattacttttgaacaattttaattctcttcaactcctgtgctgcattcgacatttatttactcatcctgaaactttccgcctttcttttagaatattatatatgaaattcttctattacttccccacatcgtctttctctttcctcattgacttcttcctcttgtctctttttttagtgttagtcttggtcctctctgtcacttcttgtttcctttcctgggagagcttcttcattctcatgatttgaattacagttgctatattgacaacttttagttctcatgtaaagttccactgccaaattctgagtgcttctcaataatttttctacattaatacatagataatcatactcatctcactcccacaaataatggccactcttgggaatgtttgatgttcaacatactagttgaaactgttcatttcttccccagtgagtagtgacacatactgtggacaacattactgctgtaaccttttactaggtggttccacctggctgttttggtattacatactcaccatgtataaactgaactcagcatcttcttcacaaggtctttacaaactttgctatctctagtgtcatctgacttgaactctcagcatatttgacatagttgattattttctctttttgaaatactgtttccttgactaatggagcactgccagtcctggtttctttttcacatctttggtaatttcttttcaatctcctttttggttcatcattttcatactggccatccagtgctggaactcctcaaagctggttcattatgtgggatagatggaaagtgaagttggaaataaacttggaatgataaatttggaataaaccttggagatccttcaatggcaagataaggatgctggggcatccttacaaaattttttagtcaaacagtaacaggactaagtctatgttttaggaagatttatctggcattaatatgtggaagataggttacatctccacagtgcctctctaatattaatgatgataataataactacaataatactgatttgtatttatgtgtcttgatgagataatgcacataaggcaaataaggagactcaaatctagaaagaaaaaatgatttgcctagagctacctggttagttattcacagagttgggattgcctttcaagtttatactaaagaaatatttgttgactgtttgataattgtgtatctccatttccctttattttttctgtcatttaatatatgttactctggtcactctaagtatctttgaaattgcttgagaataattctctagtacagcctcaaactgtgatccttggaaaacaagtgtttctagaaatgttaagaactcttctgtaagaaaaacattaagtaaattcataaaactcaattaaaaattctaagcatgggttcattactagataacttctcagtcaacattcttaaaatgctgaattgtattgcaaatctctgcgagtagattataatagactatagtttatacaggctgggtgcccaagtagcagaacctaagatggaggttcttgtgcaactgatttactggagtcccgtcaagtgaaatctacgagggggtgagggaagcaggagagggcagagaagaagctgagagaagttgaactaaagcttggactgtacgggatggcaaacattgactgcatgtggccgctgagcacttgaaatgtgcagagtgtgactgaggatctgaatttctaattttatctaattgtaacttaaattttaaaaaccaatacttcattcagctattgaaaaactttaaattatgagtatgtgaatcatctttttcaactataagtttttatgacatctaaatacagatcaagtatttctgatgaaaatttagtatctgaattcagatgttttataagggtaaaatacataatggatttcaaatactttgtatgggaaaatgtaaactgtcaataatctttttatattgattgcatgttgaaatgatatattttagatatgttggattaatcaaaatacagttttaaaaccaattttacctttttttacattttaaatatttgatttttttctatttacttaaattttttttgtaaatgctaataatttttaaaatatgactaccaaaatatttaaaatcacatatgaggctcacattagcttttctactggaaagtgctgagctaaagtatagctctaactgatcccataggaggtctggagagtgaatcgcaccagaatgatctccccttaaggcaacaggtcagtcttttgtgtcccagggtcagccagtcattggttgatcctttatcccctcgaagcataacttccaggcctaatgcagtttggaattttcgagagattctttcataaactttaccaccagcctgttgtgtgctatattggatttgatgagaccaccatacaatcagtaagtctcaaaggatggaaatcaccaaactccattgattttctatgtaatattttatttcctaagatgtctgcctttctcaggcagttaagcatgaaactcactacacagaaatagcaacatttagcatatctgttctgatgcttgtttctgagttacctaagtgctaaacaactatcaataattttgatttctcttgagaaagacttctagattaggtgccccaaggagaattttatgatcgaaagctatgttgggccccagtagctcatgcctgtaatgccagtactttgggaggccaaggtagatgaatcacttgagtccaggagttcaagaccagcttgggcaacatggcaaaaccttgtttctacaaaaagtataaaaagttagcttggcatggtggtgcacacctacagtcccagctactcaggaggctgaggtgggaggatcacttgagcctgagaggttgaggctgcagtgagccgtgattgtaccactgtgctccagtctgggtgacagagtgagaccctgtgtcaaaaataaaagtaaaaaaataaatagaataaaagctatgctgctctcctacgccttttagatcgatgtgattatcatgacatcattacgaattggtgtatagacaatgatgggattaggatacagtcaattcattggcattcaaagaaatgggaaaagcccagtgtccctacgaccaacccccaaaaaaaatttcctcaaaaccagagataaaatttgcttcctctttcagtttgcaagcatgcagcctggacagaaaaggaagcaagtgcaaaacttgcttggagaagggtgactgataagtcttgaggtacatggaagagacaacattccatagcttatgttttcttttttcacccccttgaaatcagactatgagacagagaacaggtgccatctccctatcttatgtgaactgacaggattgaacacatattcccgggaatatctcagcactcctaaaaaataatttcagaaacatttgtaaaagctgaaaagaagaataaaacactggcatatgagatgaagacagaaggttagatagactacagaaaatcaagtattatattagataagaaagttgaaagtcaagtccttccctttccttcccttcccttcctctctccctccctcccttcctccctccttccctctctccttccctccctctatccttcccttccctcaacacttaatacattatcacaattaaaaatatattgtactatgtatcaaatgctgataatctcattaaaaataagttctgattactgacttcaaggaacttcagtataacttagttttaggaaagtaaatgagaataattatagcagatgaaaatgttcaagatgttatagtacctttaaatataaaagtgttaagagagtacatgtggaatggtaagaatgaagaaggctaattgataattttccaggagttgaagttcagttcagatctataaaaattttagatcaaaatatgcatatcataaaacattaaacagagcagaagagcttatgatgaaaagcaataatcttttgccctgctccttgctactttcaatccaacaccctaggaaaaacctcctttgcttccagtcccacaatctggaggaagcaggtttgattttagatcttctggtgcttacttcataactttaagtcgtatgcttatatctcttttctttgattgatttatttaaggaattatctatttactccctacaatgaaatatgaaagttttgttcccctacctctgtgtccttaccctttcttccttccaatgtttgataatttgaattattttttgttttattattatccctctgttttgtattctatcatttttaattagtgtcctgaccactctttgtgtatagtaagactaacagcatccattccacttcctccccctttacttctgcattccacctttcccttctgttttctgtcacttcaaattgtattcttacattgacaaggttgttaactttttttttttttttttttttgagacggagtctcccactgtcgcccaggctggagtgcagtggtgcgatctctgctcaccacaacctctgcctcctgggttcaagctattctcgtgcctcagccttctgacaagctgggactacaggcacccaccgccatgcccggccaatttttgtatttttagtagagatggggtttcaccatgttggccaggctggtctcgaactcctgacctcaggtgatccacctgcctcggcctcccaaagtgttgggattacaggcatgagccaccaagcctgaccaaggttgttaacattttaattctgatatgcaaccataatgaagtcatctgcatttgttcgttagctaatagtaaaagttgaaaatcacagtgcaccattaatgttactgtgactctatacattttatttagtacagggtgatgtaggatactgaaatcatatcttcttctccaaggacccaatgtcacaacccctgggccactcagaggggaatgatttatgatgaaggtcaaatagattctcttttctattgcttaaagttgtgctacactgatctagtttatgtttgggttatgcgtttcctatatatattttttgttttctctggaggttctgaatcttgatcatagcctaaatttggtctctctttcaatcataataactattttgtgaagtcttcttctttttttcccccatagagatatttcttctgaaaccgtatgtcgtcctttcaattgtgtgttttgagacatctctggattaggcacaccattttatttatcctatgtctttctgtttctggcattttccctctttcttgccataaaacagcttttctctggggccatactccccagataatttcctcaaattatgttgtgaaaaaaagccctcattttatgacttggggttaagcgttgagctgttggcaaacagtaatagagaaagtgacagggagcacagcatttcacatataggaattcaagtgatcacctcagttttcagacccactgctcatttctgccttgtatcatacttgcctactccaagccagagattctttggattctagtgggcagagtgactctgacatcctctgcagactcctcatatcatattctaaactgtagctttctcttcttgttttcatctgtcaacacccttctgttagctttccttcttcagaaggctctcagctactgttggctccccttaacaatcttgttatggttgtattcctttgctgtagtttctctatttctgtctctgtgaagtctggagaaagacttgattaaaagagctcggggtgccattttgaaaaggactgatacacccagtggacctcctagtcaagggaatggtctgagcaaagatagattagtagagttaaaaggattatggtaaatagttcacctgaaacagagaatgaatcaagtgaaagtaaacactttaggacttgctgattcaaagttgaacccacccttagacagaaaagattgcattgatatgtgaggaatcagggagcaaccttaagttcttaagcagccaagtgttattatacatagactttagcaggctgggcttagttatttaaaagcatgaagcttctgaaggccatttcctgggcaggtttctgtaaaaagtaaacagttgtttacttttacatttcaggtttaattttaagccttgaccttgagagtcatttgacctaagtaaatagatgaattatctgaagtatctgggaatttatttaactactttaaatggccacatacaaatataatgagaggaggcattattgtatagttgttaatagttttccttaccccctctactataattgttgtataaaatctaaagtttttagttccatgagtggtacacggtaagctttcaaaaattagtaattataagagtgttctcttgcattcagatagtttctttattttattttattttattattattatactttaaattttagggtacatgtgcacaatgtgcaagttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcaatagtttgctgagaatgatagtttccagcatcatcgatgtccctgcaaaggacatgaactcatctttcttatggtgtcatagtattccatggtgtatatgtgccacattttcttaatccagtctatcattgttggacatttgggttggttccaagtctttgctcttgtgaagagtgccacaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccaccaacagtgtaaaattgttcctatttctccacatcctctccagcacctgttgtttcctgactttttaatgatcgccattctaactggtgtgagatggtatctcattgtggttttgatttgcatttctctgatggccagtgttttggctgcataaatgtcttcttttgagaagtgtctgttcatgtcctttgcccactttttgatggggttgtttgtttttttcttgtaaatttgagttccttgtagattctggatattagccttttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacgtgaaacacccatgcctatgtcctgaatggtaatgcctaggttttgtatatatatgtatgtgtatatatatacacacatatgtgtgtgtgtgtatgtgtatatatatacacacatatgtgtgtgtgtgtgtgtgtgtatatatactacattttctttatccattcatctattgatggacactgaggttgattgcatatctttgctattgtaaatagtgctgcaataaacatacaagtgaaggtatcttttttatatattggcttcatttgggtagatattcagtagtggatggctggatgcaatggtagttctatttttagtcctttgggaaatctccatacagttttccatagaggctgtactaatttatatttctaccaacagaatataagagttttcttttctccacatcctcgccaacatctgttattttttgtccttttaataatagccattctatacatcagtgaactgtgtgggaaaaaaaataatagctattctgttctttttgctcaggattgctttgactatttgggctgttttttggttctgtatgaattttaggattgttttttctaatcctgtaaaaatgatattagtattttgataaggattgcattgaatttgtagattgctttgggcagtatgttcattttaacaatactaattattttgatccatgagcatgggatgtttttccatttgtttgtgtcatctacaatttcttatctgtgaattctagtgttccttgtagagatcttttacctccttgtttaaatttatttctacatatctttttgtagctattgtaaataagatttacttcttgatttctttcttagatagatcattattggtgtataagaacaccactgatttttgtacactgactctgtatcctgaaattttactgaattcatttatcaaatctaagagtttttgtatggagtctttagggttttctaaatataagatcatatcatcagcaaacagggataatttgactttctcttttccaatttggatgccttacatttcttcgtcttgcctgactgctctggctaggacttctggtactatgctgaataggaatggcgaaagtgggcatccttgtcttgttccagttcttagagaaaatgctttcaactttttcccattcagtatgatgttaactgtaggtttctcgtatatggtctttcttattttcagggagattccttctatgcccactttgttgagagtttgtatcatgatgggatactgcattttctcaaatactttttctgcatctatggagatgaacatatgtttctttcccttgattctgcttatgtaatgtatcaggttttattgattggccatgttgaactatccttgcatcacgatataaaacccacctgatcatagtgatatatatatatatatatatatatatatatatatatacacacacacacatatatgcatatatatacagttgttatactttaagttctagggtacatgtgcacaacgtgcaggtttgttacatatgtatgcatgtgccatgttggtgtgctgcaccgattaactcatcattcacattaggtatatctcccagtgctatccatcccccctccccccaccccataacaggccccagtgtgtgatgttccccaccctgtgtccaagtgttctcgttgttcaattcccacctatgagtgagaacatgcggtctttggttttctgtccttgcgatagtttgctcagaatgatggttaccagcttcatccatgtccctacaaaggacatcaacccatccttttttatggctgcatactattccatggggtatatgtgccacattttcttaatccagtctatcattgttggacatttgggttggtttcaagtctttgctattgtgaatagtgccacaataaacatacgtgtgcatgtgtctttatagaagcatgatttatgatcctttgggtatatacccagtaatggggtcactgggtcaaatggtatttctagttctagatccttgaggaatcgccacactgtcttcgacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccattttttgatggggttgtttgattttttcttgtaaatttgtttaagttctttatcgattctggatattagccctttgtcagatgggtagattgaaaaaattttctcccattctgtaggttgcctgttcactctgatggtagtttcttctgctgtgcggaagctctttagtttaattagatcccatttgtcaatttaggcttttgttgccattgcttttggtttttaactcatgaagtccttgcctgtgcctatgtcctgaatggtactgcctaggttttcttctagggctcttatggttttaggtctgacatttaaatctttaatccattcttgaattaatttttgtataaggtgtaaggaagggattcagttttaactttctacatatggctagcaagttttcccagcaccatttattaaataaggaatcctttcctcctttcttgtttttgtcaggtttgtcaaagatcagatggttgtagatgtgtgtggtattatttctgagggctctgttctgtttcattggttgatatccctgttttggtaccagtaccatgctgttttggttactgtagccttgtaatatagtttgaagtcaggtagcatgatgcctccagctttgttcttttggcttaggattgtcttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtgtcctcttttatttcattgagcagtggtttgtagttctccttgaagagatccttcacatcccttgtaagttggattcctaggtattttattctctttgaagcaattgtgaatgggagttcactcatgatttggctctctgtttgtctgttattggtgtataggaatgcttgtgatttttgcacattgattttgtatcctgagactttgctgaagttgcttatcagcttaaggagattttgggctgagacaatggggttttctagatatacaatcatgtcatctgcaaacagagacaatttgacttcctcttttcctaattgaataccctttatttccttctcttgcctgattgccctggccagaacttccaacactatgttgaataggagtggtgagagagggtatccctgtcttgtgctcgttttcaaagggaatgcttccggttttcgcccattcagtatgatattggctgtaggtttctcataaatagctattattattttgagatatgtcccatcaacacctagtttattgagagtttttagcatgaagggctgttgaattttgtgaaaggccttttctgcatctattgagataataatgtggtttttgtctttggttctgtttatatgatggattacatttattgatttgtgtatgttgaaccagccttgaatcccagggatgaagccaacttcatcacggtggataagctttttgatgtgctgctggatttgtttcacccttattttattgaggatctttgcattgatgttcatcagggatattggcctaaaattctctttgtttgttgtgtctcttccaggctttggtatcaggatgatgctggcctcataaaatgagttagggaggattccctctttttctattgattggaatagtttcagaaggaatggtaccagctcctcctcatacctctggtagaattcggctgtgaatctgcctggtcctggactttttttgtttggtaggctcttaattattgcctcaatttcagagcctgttattggtctattcagggattcaacttcttcctggtttagtcttgggaaggtgtatgtgtccaggaatttatccatttctttgagattttctagtttttttgtgtagaagtgtttatagtattctctgatggtagtttgtatttctgtggtatcaatgatgatatcccctttatcattttttatgcatctatttgattcttctctcttttcttctttatttgtcttgatagcggtctatcaattttgttgatcctttcaaaaaaccagctcctggattcattgattgttttgcagggttttttgtgtctctatttccttcagttctgctctgatcttagttatttcttgctttctgctagcgtttgaatgtgtttgctcttgcttctctagttcttttaattgtgatgttagggtgtcaattttaggtctttcctgctttctctcgtgggcttttattgctgtaaatttcccttacacactgctttgaatgtgtcccagagattctagtatgttgtgtctttgttctcattggtttcacaggacatctttatttctgccttcattttgtcatgtacccagtagtcattcaggagcaggttgttcagtttccatgtagctgagcagttttgagtgagtgtcttgatcctgagttccagtttgattgcactgtggtctgagagacagtttgttataatttctgttcttttacatctgctgaggagtgctttacttccaactatgttgtcaattttgtaataagtgcgatgtggtgctgagaagaatgtatattctgttggtttggggtggagagctctgtagatgtctattaggtccacttgatgcagagctgagttcaattcctggatatccttgttaactttctgtctcgttgatctgtctaatgttgacagtggggtgtttaagtctcccattattattgtgtgggagtctaagtctctttgtaggtctctaaggacttgctttattaatctgtggcctcctgtatttggtgcatgtatatttaggatagttagctcttcttgttgaattgatccctttaccattatacaatggccttctttgtctcttttgatcttttttcatttaaagtctgttttattagagactaggattgcaacccctgcctttttttgttttccatttgcttggtagatcttcctccatccctttattttgagcctatgtgtgtctctgcacaagagatgggtttcctgaatacagcacactgatgggtcttgactctttacccaatttgccagtctgtgtcttgtaattggagtattcagaccatttacatttaaggttaatattgttatgtgtgaatttgatcctgccattatgatgttagctagttattttgctcattagttgatgcagtttcttcctagcatcgatggtctttacaattggcatggttttgcagtggctggtaccggttgttcctttccatgtttagtgcttccttcaggagctcttttagggcaggcctgctggtgacaaaatctctcagcatttgcttgtctgtaaaatattttatttctccttcacttatgaagcttagtttggctggatatgaaattctggattgaaaattcttttctttaagaatgttgaatattggtccccactctcttctggcttgtagagtttctgctgagagatccactgtttgtctgatgggcttccctttgtgggtaacctgatctttctctctggctgcccttaacattttttccttcatttcaattttggtgaatctgacaattatatgtcttgtagttgctcttgttgagtagtatctttgtggtgttctctgtatttcctgaatttgaatgttggcctgccttgctaggttgtggaagttctcctggataatatcctgaggagtgttttccaacttggttccattctccccgtcactttcaggtacaccaatcagacgtagatgtggtcttttcacatagtcccctatttcttggaggctttgttcatttcttttcactcttttttctctaaacttctcttctcgcttcgtttaattcatttgatcttcaatcgctgataccctttcttccacttgattgaatcggctactgaagcttgtgcattcgtcacgtagttctcgtgccatggttttcagctctatcaggtcatttaaggtcttctctatgctgcttattctagttggccatttgtctaatcttttttcaaggtttttagctactttgtgatgggtttgaacatcctcctttagcttggagaagtttgttattcctgatcatctgaagcctttttctctcaattcatcaaagtcattctccatccagctttgttccgttgctggcaaggagctgcattcctttggaggaaaagaggtgctctgatttttagaattttcagcttttctgctctggtttcttcccatctttgtggttttatctacctttggtctttgatgatggtgacgtacagatggggttttggtgtggatgtcctttctgtttgttagttttccttctaacagtcaggaccctcaggtgcaggtctgttggactttgctggaggtccactccagaccctgtttgcctgagtatcaacagtggaggctacagagcagcaaatatggcagaacggcaaatgttgctgcctgatccttcttctggaagcttcatctcagagggtcacccagctgtatgaggtttcagtcagaccctcctgggaggtgtctcccagttaggctactcgcgggtcatggacccacttgaggaggcagtctgtccattctcagatctcaaactctgtgctgggagaaccactactctcttcaaagctgtcagacagggacatttaagtctgcagaagtttctgctgccttttgttcagctatgccctgcccccagaggtggagtctacagaggcaggcaggcctccttgagctgcagtgggcttcacccagttcaagtttcctagccactttgtttacctattcaagcctcagcaatggcagatgtccctccctgagcctcactgtcaccttgcagttccatctcaaactgtgtgctagcaatgagcgaggctccatgggcatgggaccctgtgagccatgtgcgggatataatctcctggtgtgccgtttgctaagaccattggaaaagcacagtatttgggtgggcgtgtcctgattttccaggtaccgtctgtcacggctttccttggctaagaaagtgaattccccaagcccttgcacttcctgggttaggcgatgccccgccctgcttcagctcacactccatgggctgcacccactgtccaacaagccccagtgagacgaacctggtacctcagttggaaatgcagaaatcacccatcttctgcgtcactcatgctgggagctgtagactggagctgttcctatttggccatcttggaacccttaatccagtgtaatatatttttgatgtgctgttgggttcagtttgctagaattttgttcaggatttttgcatctctgttcatcagggataatgatctgttttcttttatatgtgtcacctctggtttaggtatcagaataatactggcctcaaagaatgagttagggagaattccttcctcctcaattttttgtaaaagtttcaggaggattagaattagtgctttgtatatttggtacaatgcagctgtgaatccatctggtcctgggcttttcttttgggggagtttttttattactaattcaatattgctactaattattggtctgtttaggttttctattctttcctgcttcaatcttggcaggtggtatgtttccaggaatttctccatttcttctaggttttctagtgtgtgagtatatcaatatttataatcgtctctgatgatcatttgtatttctgtagttatcagttgtaatctcttcattctaatttctgattttacatgagtcttccatcttcttggttggtctagctagcagtttatcaattttgtttatcttttcaaaaaaccaaccttttgttttgttgatcttttgtattttttttagtctctaattcatttaattctactctgatttttgttatttcttttttcctgctaatttggggttttgtttgtttttacttttctagttccttgaagtgttattagattataaatttgtaatacttctacttttatgatgtaggtatttaatgccataaacttccctctcagcactgctttttctgtatctcacagattttggtatgttgtgttttaattttcatttgtttcaaaaaaatttttatttcaataataatttcttcattgacccagtggtcattcaggagcataatgtttaatttccatgtgtctgtatactttccaaagttcctcttggtattgatttctagttctattccactatggtctgagaagatacttgatatgatttcaattttttttaatttgttgtgactgttttgcagcctaatatatggtctatcttggagaacattccattgctaatgtaaagagtgtgtattctccagttgttgggtagagtgttctgtaaatgtctgtcaggtccatttggcctaaagttcaacttttctttattgattctctatctcaataatctgtgtaatgccaggagtagggtgttgaagtcccctaatattaccatattgctgtctctctctctttagatctagtcatatttgttttatgaatacgggtgctccaggattggatgcatgtatttagaattgttctattctcttcctgaattgatccctctatcattatataatgatcttgtcttttttatggtttttgacttaaattctgttttatctgatgcaagtactcctgcttgctttggcttctgttttgtggaatatctccccaccccatccctatttttagtctatatgtgtcttttcaggtaagtttcttataagcagcatatgcttagatcttttttaaattaattcagccagtctacatatttaagtggagcaggtagtccatttatgttcaaagttattattgatatgtaagggattttttctgtcatattgttaattgttttctagtttttaaaaaaattctttgtacccttctttttctcttattgtttatcattgtggtttggtgtaattctgtagtggttccatttgatttctttctcttcctcctttgtgagcttgctctaccaatgacttacacttttaatgtttttcatgatggtaaatgtccttttcctttcaagtttagtactctcttttttgtgtgagacaggctgtggctctgttgtccagactggagtgcagtggcctgatcacaactcactacagcctctacctcccaggctcaagtgatcctcccacctcagcctcccaagtagctaggaccagaggcatgcaccatgacacccagctaacttgtgtgtgtgtgtgtgtgtgtgtgtgtgtgtgtgtgtgtgtgtgtgtgtagagccagagtctcactatgttgcccaggctggtcttgaaatcctggactcaagtgatgctactgcttaggcttcccaaagtgctgggatcatagattggagccaccatgctcagcctaagttcaggattcccttgggaatttcttgtaggtctggtctggtggtgatgaattctcttagcatctgcttgtctggaaagtgtttatttctccttcatttatgagggttaatcttgctggatatagaattattggctgatagttgatttctttcagcactttgaatatatcatgcaattcttttctggcttgtaaagtttctgctgagaagtccactgatagtttgatggagtttctgttgtgactaggggcttttctcttgctgttttagaatgtgcctttcactttggctttagacagtctgattataatgtgccatagcaaagtcctttttgcattgtatttatttggggatcactgagcttcctgtatctggatatctaaatctcctgttatacttgagaagttttcatctattatttcattaaatgggctttctaaaccttttgatccctttttgcccttatgaacaccaataatttgtaaattcagttactttatgttgtgccaaacttctcaaaggctttgttcattccttttcatattttttatatatttttgtctgactggattatttttaaagatttgtcttccagttctcaaattcttttttctacgtagtctagtctattgtggaagcttttgaatacattttctatttccatcaataaattcttcagttccagaatttctgtttcttatttaatatctgtctccttgatttctcattcatattctgaattgttttcctgatttctttacattggtttcagatgtctcttgcatctcaccgagcttccttaaaatcagtattttgaattcttcatctgggattctgataatttcttttttgttaagatctatcttattattaattattaataattaagaattattgtgttcctttaggtttaggtttcctgaatctttacattgatatctccacatctggtgtaaccgttgtttctatttttgaatttactttttttcatggagggtgcttcttcctgaagctgtgtctctggtattgcttgggtggggccctttggctttgcttgtgtgtgtgtgcagtagtgaagtatgacttctttggctataaaccttagtggtatctgcggtttccttgatacattaggtaaagttattagtggagactgtattgaatttatgggggggggactggattggcagatggacctgtcgtcaggctttagtggtagtagtggtgggctaagcattaaagtatgcatgggtttgattagtgctgtgctccacctttgtaggcatcctggcttctctgagtagtatacaaaaagttgagccttaatctttccctgaacactcttgaaattttaagttaattatccacttataagttaaggaaccattatattcattttattttactaggaatctaaaaatgtgttagatttttagaaatctaacacatttttagatatctaaatctaatgagaaaactattttatactaatatcatttttaaacgtttcaagaagaaagaatctatacactttaagaattaaaagcaaatctctttactttttttcctgtctgtctcccactaaaatgttagtcagctcagtgagggcaagccttatctatctagttgacttttgcgagcccagcatatataacagagcctggcccacaaaaaggtttcaataaataattatttttaaaagagagaaagaaatgtaaggctctggggaaagacagatagtatacagataatacttatctgtattcatatgagggagattcactttcccctacttaataatggaaaatgaaagaactttggaaacactatttggaaacgctatttgattgctttttcctatgtgcctccacagcctttgttcataccattacagtgtcatttatcagacattattacagctatttgcatatctatttttcccaatatactctgggtgcccaggacatatcttatttatttttatatacccagggcccaaaatagtaccaaatataggcactaaatatttaaccaaaataggtaaacagtagacattcaataaatgtttgcaaattaataggaaaaaggcataggaaaatagtataaatagtttcttttgtgatcctcttctttctctcctaacaacacccactgttatactgactaatcacttcctttccataatctttctctctcattataaactcttatttctgattagaacaaatgctgagccaggcttattttatattccactattttttcctgttctttttatattcatcaaagcattaatgaaaaaacaagagaatgccttttctattgcaattaaaatctataattccatgtgaaaagtttttagtagttgaaagcaaaagctaaaacctggataactgagaaccttaccctctgtggggatctcatagtactactaagccacctttcaagtaaatttcaaccaagtttgctctacaactctaaatttgactgacaaatctttaagacttgttacacacagatcattagttatctttttccccaacaacaaaactaaataatatttttgcttactatttgtctctagaatttattctgaaagacaactcatgatgctaaaaaaatctcaaagtcaagttatcccagctaccataataatagatcatgtatcactatgctgactacactgtatacatttttctctatcttagaaaaaatattcctaaatgtttatgaatacaaaatatattaattatctgttacaatactctgttctttgcaatatcatgtataagcagcaagtatcatatactacattacatcacttttgcaaaactggttactcacataagccaaacaaagtactaaggctttactatcctaggggatcccaaagggacaggccatgtgtgtttgcataattcaaatgttttctgctttttaaaattaccattcaaatgtttcatttcagagaaaacatctcatcaagtacctatcttaaaaaagtctattgcatttctatacaccaccaccaccagaaatggaattgatctgagtcaagaaacatagccatgcatatatggaactttggcatttgacaaacgtgacataccaaaactgtttttcaaagtagttgtaccaatttacattcccacaagcaatgtttaaaagatcctattgcttcaaagtctttctaacatatggtattgtcagactttttaatttttgccagtttaattgcataaaatgatacctcatttgcatatctatctcactaatgaggacagacatctctttatattcttattgatgtcatgtgtatactcttctgtgaaattcttttcgggccattttccttttgttcattttgcttttctttttgatttgtgaaggttcgctatatgttcttgttacaaatcccttgttggatttataccaatatcttttctcagtgtatctttccattttcttttaaaaattttttgacagaacaaagttcttaattttgaagtagtaagatttgaattagtaaaatttaaactagttaactttgagctagtaaaatgtatgtcttttcatagctttttgtttcatgtttaacaaatcttgctctactcccaaagcgtaaaaaaaaactcttattttttaaagagtatttaaaattgtttttgacatttagatcctaagtctacctggagttgactttttgtctatagttatgagaagccaagtggtagagagactgaacaacaaagaagtcaaaagaatgttgcagctgattagaggaactgggcaaataattttaagccttttctcagcaagttaggaaggtaaaattggagttctgggcctacctaggaagaaatgtctagccaacattccacattttaaatggtactttaccaaactttaaaaattaattctataattttaatacacaatatccagcatccaataaaaaattatccaacataccaaagacaatattggatacttaagaaaccaaaaggaaaaatagacaataggaacaaacctacaagagagccatattacacaaattagatatggatattaagtataaatgagatgatcaagaaaaattatatcatgatgaaaatttcagcaggaaattataatttgtaaaaacatattaagtggaaattcttgaaccaagtaatataataaagattgaaacagttggattcaatgtcacatagacatagctaaacacaggattattaaccataatatgttaatagaaaatgtccagatagaagcatgaagagaaaaacaaatgtacaaaatacagaaaagagcataagagacctatgagacatgatgaaaaaatattaaatgcataatcataatttgaaaagacatgtaagagaagaagaaaagggatatctgaagagaaaatgatcaagaattctccaaaataaatgaaagacatcaaaccatagacttccaagtgctataaacccctagcaggataaataccaagaaaaccacatgaaggcatattataataatattactgacagcaacaggagacaaattcctctgcagacagggatgggtccccagtgaaacccaaccttcaagcaaaggaaagtctaaaacctgaaaatcgaactgccagttcagcattagagtccacgactggagtgagaactttcatccctatcttaccccctctctctcaactggttccttctgaatgatgtcttttaaccaattgaatggtgctttttccaagaccactcaaggacctatcagcatgcagtcccccattctaagcccataaaaaccccagactcagcctcacagccttacccactttcaggacccctctcattgctgagagttttctttctgtcactcaataaaattttactttgtcttactcaatctccaatgtccatgtaccttattcctcttggtctcaggacaagaatttgctgaactgctggagcaaaatagctgtaacattcctcctcaccaagctgggggcagcaggagtaaaattgctgtaacattccctcccactcaccaaacaaagggagagaagaagctgctggacaccactctcttccactcgccgaactatgggagcaaaaaagccacaatatttctaaaaacaaaagattttaaaaatggtttaaacaagtcagagaaaaaaggcacagtaccttcaaggaagttgcaaaatgacttatagttaatttgtcagtagcaacaatggaatccagaggcaaaagaataacctctccaacttgctttaaaaaagaaaaaaagaactgatttccaacttaaaattatttactcagaggaaaaaataaactcaaaacagaaagtggcagtttccactgctagcaataataagatagaatacatatgactaatcctctcacaaataacagacaaaatatataaaccaactactttttttaactttctccttccaacatttattttaggttcgggggtacatgtgcagatttgttacatcagtaaactgcatgtcactgggtttggggtacaaattatttcatcacccaggtagtaagcacagtacctggtaagtagttattcaatcctaacccttctcctaccctccacctttaagtaggccccaatgtctattattcccttctttgtgtccatatgtacccaatgtttagctcccaagtataagtgagaagatgtgatatttggttctctgttcctgtgttcattcactcaggataatggcctccagttgcatccatgttgctgcaaaggacatgacttcattcttttttatggctgcatagtagtctatggtgtatacatggtacattttctttatccaatccaccattgatgggcacctgggttgactccatgtcattgctattgtaaatagtgctgcagtgaacacatgagtgtatgtgtctttttggtagaatgatttattttcttttggatatatatgtaaattgctttaggcagtatggccattttaacaatattgattcttctgatccatgagcatggaatgtttttccatttatttgtgtcatgtctgatttctttcagcagcattttctagttctccttgtaaagacctttcacctccctgattagctgtattcctaggtattttgtactttttgtggctattgtgaatggattgtattcttgatttggctctttgcttggatgttattgctgtatagaaatgctggtgatttttgtatgttgattttgtatcctgaaagtttgctaaagttgtttatcaggtctaggagcctctgggcagagacgatgaggttttctaagtataggcttaaatcgtctgcaaagaaagataggttgaattcctctcttcctacttggatacatttttttttctttctcttgactgattgttctggctaggacttccagtactatgttgaataggagtgatgagggtgggcatccttgtcttgcaccagttctcaaggagaatgcttccagcttttgcctattcatatgctgttgactgtgactttgtcatagatggcttttattattttgaggtatgtacctttgatgcctagtttgttgagggtttttaaactgaaaggatgttgaattttattgaaagccttttctgtatctattgagatgatcgtgtgttgtcttttagttctgtttttgtgattaatcacatttattgacttgtatatgttgaacggaacttgcatcccagggataaggcctatttgattgtcatgaattagctttttgatgtgctgctggattcagtttgcttgtactttattgaggctttttgcatctatgttcatgaggtatattggcctgaagttttcttttatcattgtgtctctgccaggttttggtgtcagagtgttgctgacctcgtagaatcagggaggaatccctcctcctcgattttttgaacagtttcagaatgatgggtaccagctcttctttatatgtctggtagaatttagttgtgaattcatctgttccagggctttttctgattagcagggatttttttattactgattcaatttcagaactcattactgatctgttcagggtttcaatttattcctggttcattcttgggagcttgtatgtttctggaaatttatcagtttcttctaggttttctagtttatgtgcatagaggtgttcataatagtctctgagggttttttatgtttctgtgaggttgatggtaatgtccccatttttatttctgattgtgtttatttggatcatctctatttttttttcataatctaggtagtagtctatcaatcttatttgttctttcaaaaaacaaactttaggtttcattgattttttattttttaaaaaaattatttccatgagttttggaggaacaggtggcatttggttacatgagtaagttctttagtggtgatctgtgatattttggtgcacccatcactcgagcagtatacactgtacccagtttgtagttttttatccctcaccccacctcccaccctttccaatgagtccccataatctattgtatcattcttatgcctttgcatcatcatagctcagctcccacttgtgagtgagaacacacaatgcttggttttccattcctgagttacttcccttagaataatagtctccagctccatccaagttgctgtgaatgtcattaatttgttccttttatgtctgagtagaattttatcatgcatatacacaccaaaatgtgttttacgtctcaattttattcagttcagctctgattttggttatttcttttcttccattaactttgaggttgtttttctcttgcttttctagttcctctagctaaaatttagactgtcaatttgagagccttctgcctttttgatgtgggcatttggtgctataaactttcctcttaacactgctttagctgtgtcccagagattctggtacattgtatctttgttttcatttattccaaagtatttcttgatttctcccttaattttattgtttacccaaaagtcattcaggagcacattgtttaattttcatgtcattgtatggttttgagagaccatcttggtatttatttctatttttattgcactgaggacctggaatgtggttggtatgatttcagtttctttgaatttgttgagaattgctttatagctgagcatttggttgattttagagtatgtgccatgtgcagatgagaagaatgtatattctgtggttgggtggagtcttctgtagatgtgttaggtctattcagtcaagtgttgagtttaggttttgaatatctttgttagttttctgcctccatggtctgtctaattctgtcagtagggtgttgaagtctcccactattatagtgtggttatctatctttataggtctgtaagaacttgttttatcaatctggatgctctagtgttgagtacatacatttttagaatagttaagtcttcttgttgaattgaaccctttaacattatgaaatgcccttctttgtcttttgtcatcattgctggtttgaagtctgacttgtctgaaataaaaaatatcaacctcagctcttttttgttttccatttgcttggtaaatctttctccatccctttattttgaacatatgggtgtcactgtaggtgagatgggtctcttgaagacagcatgcagttggatcttgcttctttatccaacttacttctctatgccttttaagtggggcatttaacccatttacatttatggttaacattgatatgtgcagatttgatcctgccatctatgttgttagctggtgtttatgtagacttgattatgtagttgctttatagtgcattggatctatgtacttaagtgttttgtggtggctggtaatagtcttttgtttccatgtttagcactcccttaacccatttatacctgaggttgcaatttttttaatttttacaatcagaccttggtgatgaccttgagtagtaggatataaataattcccatatgcttattgttccaatgatggaacactaggtgtaaatgggttttaaggacctcttgaaagacaggtctagtggtaacaaattcccttagcatttgcttttctaaaaagggttttatttctcctttgcttatgaagcttagtttgactgaatatgaacttcctggttggaatttcttttcttcaaggattaagcatgctgaatataggcctgtagtctcttccagattctagggtttctgctgaaaggtccactattagcctgatgggattccctttgtagatgacctgccccttctctctagatgcctatagtactatttctttggcatttgccttggagaatgataattatgtgtcttggggatagtcatcttgtatagtatgtcacaggggtctctgaatttcctgtatctgaatgtcaacctctttacagagattggggaaatttttgtggacaatatcctcaaatatgttttccaaggcattctctctttccctctctttcagggatgccaatgagtcatagatttggtctctttacataatcccatatttctcagaggttttctccttttttgtctttttcctttatttttatctgactgagttgtttcaaagaaccatccttcaagctctgagattccttcctcagcttgatctattctgcttttaatacttccagttatattacaaaattcttttggtgagtctttcagctctatcagatcagtttggttctttcttaaaatggctattttatctttcagctcttgaatcatttgactggattccttagattccttggattgggtttcaactttctcccaaatcttgataatctttcttgccatccaaattctgaattctatgctgtctttcagccatttcagttgggttaaaaaccactgctggtgagctagtgcagtcatttggaagtaagaatacattgacttttagagtggccagagttcttacactggttctttctcatctgtgtgggttgatgttcccttaaatctttgagcttgttctcctttggatcgagctttttgcttttatattctttgatgcccttggtggtttgactgtggtataagttggatttggtcaactggcttcatttctggatgatttcagaaggtcaaggctcagctcatcacttctgtgctgcatgctctaaccctgtgggggctgggaccaagcccacagctttgttctctggccctgctacactggagagaccaagattttcctggtccactggcaacaatactctgatggagggtgctgacaaaagcccttcatcagggtggtgtcagtggggttcatgctcacatgtgtgcacctgcagcaacagggcagtggtagggcggtgggggctgtgcatgcacatgtgctccagtggcaccagggtggcagtggcaaggtttataggaagaggctgcaggtgaatgcacaccagcaaagtggtgggtggaagctgtgagagggtgcacactggtgagggcccatctgcaaaagttatctgacagttatattggatctaccagccaaagagttatggtggtggctacaggaaagtatatcagctgggcgtctgaggctgtactgcaagtggatgcagccagacagagaccttgggagaggctgggcagacagaggagcactcatcagactggctccaccctacagttagatagccctgttctgtctagatctgacagttaagaaaggccaaaaccacctagaggagtatggcaagccttgggggctgggcatccctggccatgtgccactgtgatcattcttgttccaaaccttctgggttccatgcaggctggattcctgtctttgccagctctccaaacagctctccttgtcagttcaaatgtctatggggatcatggggtctcctgcacctaggattcttgaggtccctggtgagagcaggccactctatgcctatttaactcatcccttccctgggagcctctcagggccaggaatgagtcctggtgcttggcaaccccatgcagggttcccaacttcctccccccttcagcccaggatctgcattctccttccaaccactttcaatgccttccttccgaagtactgttcagaatgtgctgattttgacggtgtggtctcttggtgggagaagctcttcctgaaccctgtagtcagctatcttggctcctcccaaaacaactatttcaaggcacctgacaaggacagaaagaaaaaagaaactggagagaatttgactcttgaaatactagaaaccgtagtggttgagagttacatttatatggcatttcctgtaagtacactctccactgggacagcatagggcagttagaactcaagtagaaagctaccatcttactgatttaagatgtcacaggacagagtctgggaaaggacagaatgagcaaaaactgaaggtaaaaaaatctcataaaagagaaaactacagactggggagccctaaaggtacacatgaatttttctaaaattggggagatgctgaagaacccaatagaaaccaatactcataaggaaaaaaaataaaaataaaaatctgtgctgtgatttcaattgctgcccatttcatttcaggaacaacagagtttaaagtttgaatcctgcaagttagatgggttttgtaaacacatcaaactgtccactgaaactccaccaaggccacactatagaataaaagactatgtcccaggactaagaattctctgtaagaataaaaaccgaatcaacctgttaaaaaggctacacaaactcctggttattcatcagtaatttaaccacctgctgaagtaaaactcaacactcttccaaggaaaataaaagaatccgaaacatctctttctttttccatctctaccatttcacccaaacaagaatccaaaatacttatagtctattttctatgctgtcaagtatataaccaaaacttactatcatatgaagaaacaggaaaatgtcacccatagtaaaagaaaaatcagtcaacagaaacaaaacccagttgtagtcagcaaataaagggtgtaatgcaactatcataaatagattttaaaagaggctagtcctaatggatgaatagataggacatttcaggaatggaaactattttcaaaaaacaaatgaaaattcaggaactaaagtaaaaaaaaagttcactggatggattttaaaatagactggagagggcagaaagaattattgtgatatatttaaattaaatgttataaagtaccatttaaaatatcagaagatatgaaatacttggggacaaatttaataaaatatgtgcaagatttgtatccacaataaatgtagagatatataccatgtttttaatcagaagactcatcactgttaaaatgtcagttcagcacaaattgatccatagatctaatctagtcctaaccaaaatctcagtggacttttttgtaaaaattaacaagctaattctaaaatttctatgaggttcaaggcacctagaataacctaataaaaataatttgtatttcaattactatgaggtacagtaattaggactattgtggcattggtgtaagaatagatatataaatcaaagattcatattcatgtaagagcacctaagtagacccatacatatatggtcaactggttttcaacaaaggtgaaagagtaattcaaaagaaaaaaacagtttattcaataagtggtactggaaaaactaaacatctaaatgcttataaatggtactggagcaattaaatttctgtatttcaaaaaaaatatgacctctaattcacacaattcataaaaatttattcccaggtagattataaaacaataaagcttccagatagtaacgtaagaaaatatcttcttgactttgaagtagttatgttaacaaagtttttttttaacagaacataaaagtctctacccataaaggaacaaaataataatttggaatttatttaaattaagaacttctgaatattaaaaaatggttaatattatgaaagggagaagatatttgtaatacctacaactaacaaaaggactcatatctagaacatataaaaagttatcacagaaatacaaattaaaactacaatataataccactacatacatttgaattaaaaacactgacacttgccaacaccaagttcaccaagttcacaagaatgtggagcagttggagctcgtattagaaaattcactttggaaagctgtttggtaatatctactaaagctgggcatatgtataccttatgacccagaaatttcattcctaggtattagtccaaaagaaagtctacattaatgcactgaaagtaatacacaaatgtgtatataatagcaatgctcattaaagaaaaaaccagaaataattcaaatgttcatcagcaatagaacagatagataaattatggtttattatcaatgaatgaatgaactactacatggtgagctctcacagacatacaacattaagcaaaagaaatcagacacaaaatacaacatactgtatagtctcagtatttgaagttcaaaaagaggcaaaactcacctatggtgttagaagtcaggatagtgacagagtagtagctggtagcggggacaaggggccctcttagggttctaataatattctatttcttgacgtgggtggaggttacatgagtgtgttcactatgtggatatgtattgttgttagagataatgtgtgcacttttctgtatatatgttattcttcaataaaccatttaaaacattaaaaataaccacttgtgtggcttagaacagttgtccccaaccattttggcaccagaaaccggtttcatggaatataatttttccacagatggtggatggggggaatggggatggtttcaggatgaaaccattccacttcaaatcatcaggcgttagagtctcataaagagcacacaaactaggtccttcacatgcgctgttcacaatagggctcacactcctatgagaatctaatgccgcagctgatctgtcaggaggtggagcttaggcagtaatgctcacttgcctgccactcacctcctgctgtacggcctggttcccaataggccatggaccagtaccggtccacgacccagggttggggacccctggcttagaagcaatgtctagagattttagggtaatagaaactatataaaggtagtatatatgctacaggcaaaacatgtaatctagacattataaacaactcttacctaattcctgggtaactgctatacgaatattctaaaactatttaaagaaaatgtcaaatttaatactttgtcattgtattggtagtgtaggagtaagccataagatcatgagtaactataagtattacttacaatgtgaaccacctctgctgaatctctacacttctacccacatactacacatactacctttcctttcaccgtctctcctttatactacccctgtttcacctttcatgggcaggttctttaggtaaccaaaatacccacattatttatcacttcaagtctgtaaataaagccacggatagcaataaaacagaatcttgtagtaaggctacataaattatagtatgtctttattggaaggaaaagttttctaaattggtctcaaaattcttaaaaataagtcaataaatatataataaagctatctgtactctcaatatattttcacttttccaaatactttaaccttattagttgttcttcattagtccttcaccttatgccactggacaaatacctttaaaaaaaaaaaaactcaaagcaggaaactacttaaaatatgtttcaagtattttgtagagtttattggatcagaatccattcttcttatacttcaaccccaccactgagcttaaaattccttccaagcttttgggaacagtgctttcactgtcactatccctactatccataggataatcattggctgttccccaaattccagaacgatgtgccattgcattgctttcctcccacactgaagttgctggcggtagctcattttggcagtttgtcaaataaatcacacagtaaagcatttggtgatctttaaccaaatgaatctgttgtgtatacagcatatgacatgtagaggtatttcacacattataatagaacacagtgaaggatataccctgtacagcataatcctagaatcaagacttctctttgagaacttctctttaaaataacatcttttttttgaactaaaaagattaacttacttaaaaacaaagggaaataccatctcatggcaattattgttcccttctgagaatgactgatgacgtacatacttattaccagacagtttatggaaactatgttgtcaaatagatcacattttcctacagaaacaatgtcaggatagggctcatatcccttaccaaagaatcaacagagaaactataattatgagagttaattttccgtaaaagcaaagataagactattacaaaattttataatataaagtgacaaaaggatgcttcaactttttaatttatttaacaaacgtttaacaggtgtctgtgatgtgtcaggcattggtaatcaaataacacttggtacctgccacgctcaataaattaactaacagtcatgatttactaaacaagtacatcaatgtttactgtatggggtggttagtgtcatgaacgagaggtgctcagtctgtaaggacacagaagacagtcatctaaatcagcatacggggtcagtaaacacttcctggaaaagatgacctgggctcagctttgctacatgagcaaaaactggctgaattagaaaagcaatccaagtgacgggaataaggtcatgttttgcataacaacattttggtcaacaacagatgcgtacatgacggtggtcccataggaatatagtagagtcgaaaaactcctattgcctagtgacctcatagccatagtaacattgtagtgcaacgcctgtgggttttggtaacacttccagaagaaggcattgttatcacaggagatgaaaattcccatgcgtgttattgcccctgaagacctttcagtgggacaagatatgaaagtggaaggcagtgatattgatagccctgattctgtgtaggcctaggctaatgtgtgtatttgtgtcttagattttagtaaaaaaaactttaaaccgtaaaaaaaaaaataattaaaaatgtaaaaaagaaaaaaacttatagaataaggacataaaaaagaaaatattgtgcagctgtacaatgtgttttaatctaagtattactacaaaagagtcaaaaagttaaaaattttttaagtttataaagttaaaaagttgcagtaagctacggttaacttattattgaagaaggaaaaatatttttaaataaatttagggtagcctaagtgtacagtatttataaagtctacagtgatatacagtaatgtcctaggcattcatgattccctgactcactgagagcaacttccagtcctgcaagttccattcatggtatgtgccctacataggtgtaccattttttaattttttataccatatttttactgtgtcttttctatgtttagatatacaaatacttaccgctatgttatattaataattgctggcagcattcagtatagtaacatgctgtacgagtttgtagcctaggatgcctaggtgtgttgtagactatgccatctaagtttgtgtaagtacactctatgatgttcacacaatgacaaaatggcatatggatgcacttctcagaacatgtccccattgttaagtaaggtatgactgtagctgataacacatgcacagaggcataaagcaacacggaacattcaagaaactgcgagttcctgtttggaggaacatatgagggaggtgcatcacaggaaagaggtgcaagataatggtagaagccaaatcatgaaatgctttgggaggtaggtttaaaagtttgaactttattgaaaaagatagtccccctgatcctccaacagctactaaaaatgattttaagcagagaagtaaaatgagcatattttcatttttaaaagatctatttgattttactatggaggaaggctaatgcaataatcctgaattcatgaagcaatgttaggaatagagtagaaggaacagatctgagagacaacaaggagaaaaaattcattgaacctgactgataaaagaatctgtacaccaaacccccatgacgccaatatgacaaacctgcatatgtaccctgaacctaaaataaaagttttagaaaagtttttaaaagttcattgaacttagacattaattggaagagagggtggaatgaaaggaagagtctaaactggcttggtgactaagatgatgatcaagaacaaggacaaagagagggtctcagttggtagggagcagggaaaaacaacaaatatatttcaaattattttgcacattatgttttctatttattgtctgaagaatacctataaaatataaattgtatataacatacataacaaagtgtagccattttggaaaacagtatggaggttcctaaagaaattagaaatagaactaccattaagagccagcaatccctcttctgggtataacactgaagtaaaggaaatcaccacttcataaagatgcctgcactcccatattcactgtatcattattcacaatagtcaagatatgaaaacaacctaagcatccatcaacagatgaatcgataaagaaattggtctatatatacaaaggaaaaaaggagaacctgtcatttgccacaacatggatgaaagtgaagaacatcatgctaagtggaataagctagacatagaaagaaaactattgcaggatctcacttatatgtagaatctttgtttaagaaagtcatacagagacagagaataaaacagtatctaccaggggctgggggcaggagtgaggaaatgggtcagtgcaaatcaaaggatacaaagttgcagttatgaagaatgagctctagaaatctagtacacaacatgaagactatagttaataatgctgtattcaggatttttactaaaggagtagatttagatgctcttgctacacacacaaaaaaatgggtaactgtgagattatgaatatgtcaatttactttattacagcaaccattttactatttatatgtatttcataacatcatgttgtataccttaaatatacacagtaaaatttattttaaaaataaattcacataaatacaaaaatttttttttttgagacgaagtctcgctcttgtcccccaggctggagtacaatggtgtgatctcggctcactgcaacctctgcctcccaggttcaagcgattctcctgcttcagcctcccaagtttacaggcgcctgccaccacacccagctaatttttgtgtttttagtagagatggggtttcaccatgttggccaggctggtcttgaactcctgacctcaggcaatccacctgccttggcctcccaaagtgctgggattacaggcatgggccaccgcactcggccaaaaattttttttaaatcccctgtatcatacatgtgacataaagcttattgttactagtatattcattttaattatttaattagcaaaggcttcctgattttcttaaagttacgttgggggattgagggagaaaaatatttaaaaatcccaagtctcttttacaaagctgaacaagaaaatttaactttccttttcctcccaaaatagatacttgcagaaagctgatatatacgaaatcattccactaaccaaagaatattcagcaattattttaaactgtcctacagttgagacctatattcattagaaaattgctgtattatcataagtaaagatctcaaaaagatgaaatatatgcttttattatgtaatattaacaaagcagcaacttggctcattcacagtttatgcaaagcattttttgaaaagtttaggaagtctaaacctccagaaatttgcaaggttaaaaatgtacttctgagatggtcaggtctgaaacttctatttcccagctgttttcaaggaacttcataatttatttatgtatagacaaataaatcttcagcttcattagtcatttctcactatattctaagaccaaaaaagggtactcttctctttgtttattatggaaaagctatggcaaggcaggggaggaagaggaattgcctggggggaccgagcaactaaaaagaagagcctggagtgggactgagccttggagctgtctaatgagccactctgcctcccacagctagctcctcacagctctgcaaaagactaaaaaactggagccaacaaaaacaaaacactcacaaatctaatttgggtgactaacaccctaaagatatgcagtttgctcctgaccaggattggagtactcactttctttgcgaacttcctcaagtgaagccgtaagctcatcctttaaaactgtagcttcctgggcaatcttctctcccttgtctaataaattccaagttgcttcctccacagaagctagaaggacactggctcttttcgaacgtccttttttcctgctggaagggttctggggacagtttacaagtgtggtaacctaaaattggaaaaatacaaagtactaaattgacaaattgtaaggagaacacagtcctgggatattacagaccagaacaaaagacagtacagttgacacttgagcaactcaagggctaggggcgccaacccaccgtgcagttgaaaatctgagtataactttcaactcctcaaaaacataactacgaatagcctactgttgaccagaagcctgataacataaatagtcaattaacacagattttgtatctgtatgtactatataactatattcctacaataagatgagctagagagacgatagtgttatttgttattaagaaaatcataaggcagagaaaacataattaaataaatcaacaagtagaaatggatcatcataaaggtcttcatcctcatcatattcatattcctgaggaagatgaagaagaagaggagggttggtcttgctgccttgggggtgtaagaggcagaagagatggaggaggtggaagggaaggcaggagaggcaggcacacttgatgtaacttttattgaaaaaaaatctgattaaaagtgaacctgcatagttcaaaccagtgttgttcaaaggtcaactgtatttcatagtaacatgactcatttccagtgctgttggtacacctacaaaagtcaagtcatggcaccaagaacagcaacagcagccaccgtggagttcccaactaaaaataggaaggaagtgggagtcttagtgattgaatttcaaaatatagacattaaaatgtcctctcttcaactaccccagtcatcaaatcatttctatgttaaatatttactgaacacctattttttacattgttctggatgatggaaaagaaatgcatttcatgctttcatggagtttacattcttaatatcggcagcatacaataaacatataaacaaatttaaaaatgtaaggttcagtaaatgttttgaggaaaaataaagttggcggagggaatacagtgagagagagtggggatcggggtggtcaggaaaggcctcttgacaggggactttgagtgagacctgtttgagaggccaaatgagttaggggaaagggtagaagacagatctgaaaggttacaaagggcaagaaagtaggtcatagtaaggatttggactttgtcccctgaagcaaccactgttctatatgattcagaatgtttctccctctcctaatattagttatctctattctcagcctaaatagactaatactgacttaattataattatttttggctccctcttaatgtagattgctggcttaaaagtggtataaattttattttataattatttgatattttggagatacataattttctactctcatttttgactgttttatcaaagttctgtattttttatatgaagtttctgtaattaaaacaatacacacatacacagccttctagagcattcttcgagtagcaaaacttgaacaaactcctcaccacaagtatatgaagtgagaaatgtgttaattagcttgatttaatcattttacaatgtatacatatatcaaaacatcacagggtacaccataaatatatataaattttattcgccaattttaatttaataaagcttggggaaaaaaagaaagaaatgaatcttaacaaatacaagaacaaactcataataagaacattatttgaagataaaaattaagcttctgtatttggaaacaaaaacatcatactgaattacattattaaaaaacacccatttctggccaggggcagtggctcatacccataatcctagcactctgggaggccgaggcgggtggatcacctgaggtcgggagttcaagaccaacctgaccaacatggacaaaccccctctctactaaaaatacaaaattagccgggcatggtggcgcatgcctataatcccagctactcaggaggctgaggcaggagaatcgcttgaacccggcaggcagaggttgcggtgagccgaaatcacgccattgcactccagcctgggcaacaagggcaaaactctatctcaaaaaaaaaaaaaaaaaaaacaacccatttcttaattaaatcttggatcacaattacaagttttggattaaatttttataaacaaagctttaaaatcaccatcgtagaggaatgagagaaaggaaaaaaacaacttgtatctaatatttaaaatagaagacctgaaactcctcttgaaagctaatctgctgcatgtcatgaaacagtggaggctcatgataatcatgcatcacatctttgacagcaaactacataatgcttcctgctcagtagtccctagagattttcgttgttgtttgtttatggagcattcgatgtttgtttacttggatatctggacccagtttttatccatgaactaaaaaaaaaacttaagaagttatgggggaaatatgcggatgaaaatcattttcatctgccctcctaccctcctccccttacccaatagatcctctgtttcattctaatttgctttatttccatgttcatcacccagagtggaatgtcttgtggcaggcctttgtttcctctcttagaaaataaaaacaatcattgttatcctacaagactggggaaggtcaaataaggtaaagtattttggaaaatgcataatatgacacaaatatttgttggcatttcatgtatattttctagtttgttccccatgtaggtgcagaaaattggttataggaatctttaacaaaggtattctctctggatctaagtttatcttgctcttggggccccccatgctaaatgtggcagttagcaaagctcattctatatgctttacaagcagctaaataagatcatgtgtcttcatcatggattatataagaataataataagcctgatttattacatgggttttcacaaattccaaaaggcaaatatctcactcttgtcagtctaatttatatattgagagttgaaaggtatttgtccagattaagacaaattataactaccagtttaaaatctttgtttaaaacaaagaataagtatcattgtctgaagtgttccctcggaatgtattttaagtgctgcaattcatgatgcttcccactgcacattcctcctctattgttcagatcctccatgcgccaaatgttttccatagaatagcctgggctttgaaattaaaatgagcgttccagaaatgctttgttccttataataaatgccagagaagtaagaaatgtgaaaagaactttgtataagaacatcatgcttccatcaaaaaaggcaattgcaacttgcaagttattcacttttataagttgtttgtacctacgtcttcttttaaaatactccaatacagttatttgatattgattaaactaaagtcaagtgaggttttcaatgattccttttatttcagaaagtaaatatggcttggcaatcctgtggaaaaaaagaaagctgaaactattttttttaaccctaactcacctaagagatttaacttactcctatcagtgactgtgactcaccatagcagatgattctcaccaaggcggaggataggagggcgctatttgaaaaggtctcccacctcttgaaggaataccagcaaccagtaaaattagctttcaagttatcctgtaaaataaatcctgtgtcctcattttctttttcagtactaaatcagttatatttctgtaaggaagtttagttggaacaacttgcaacaaagatgattctaatgtagggtttaagcccatgtcttgctaactttaccttttgccatagatacaaaaccctcccattcccctctttctcagacttcaggggtccctctcatatagaaaatctccaagcttgcagcattagagagcttgggtttgcttactttctttagtctgtaaatctgtgctaggctataaagacacaccttcatcgtagatacaggaaggaacttccatgggaatggtgctaaattaaaagtttcaagtaatttataaagaagaaattcccactctattaattctgcaagtttaacattccacaaaaccggacatattttcaatggtgtgtaaaaatatttatatattaaaattaagagtataaaaaaggtttttatagattttccaaatttaggtgtgcttctctaaatgctctaaagatgctgaaaattaaattgataagcttaatgaaccaagccatcaactgtcattatatagagccacactggcacacaatatgaacactgtagaatatgttgacttttttttttttttgagacggagtctcactctgtcgcccaggctggagtgccgtggcacgatctccgttcactgcaagctccgcctcccaggttcacaccattcgcctgcctcagcctcccaagtagctgggactacaggcacctgccaccacgcctggctaattttttttgtattttttagtagagacagggtttcaccatgttagccaggatggtctcgatctcctgacctcatgatccgcccgcctcagcctcccaaagtgctgggattacaggcgtgagccactgcgcctggccgtgaaatgtcttttttaatgccaacttgggtaacacaattatattctataaccttgttccttcccaatatagttctgattttttttaattctaccctcattgtagtataaaaaggccctgttaacagccatctcttttcttgtttattagctaaaacactttgaatttcaaccttcctccaatagctcacaggagccttcagggctacttttgctcccttgagttaattttaatgtatgaaataaaatataagacatttaagctatgttaattagctaaaacttcaacagggttctgaaagaaattagaagggtagaaaaataaaactgcctatagataagtaaaaactgtgatctttcaaagtaaaaggtacaaaccagtctcggggaggagagggggtgtcccttcttcaagtcattgataatttcaactattcttttacttctaccaaaacaacccttactggattaacaaaagtacagaggaagattaaagggttgagaacccaaaaaatgcctctagataacattcaacacccccccaaaccaacttcaatcttcttttagttcctttcaagccaataaacacttatattttgttcaaaataataccctaggcattcaggaaataaatatgaataagctccaatatggcaataagagaaatacacaactagttgcaacattaaaggcagaatgataactgtttacacttatataagtacaaagaaagtgctgccaaaattgcaaacattcacaaggattaagtaggacttccaagaagagcctttaagaacagataattttctaccagaagagataaaagggaggtatgtaagccagggaaagaaaattgtgtgcaaaggggcagagaaaaaaatttattttgtctgaaaatagcagatagccaaacttagcaaactgtggggtaaacacaggcaatagggtgagaaggccaagaaataggtttcatcttaaataaaaagttataaaagtcaaagaaagagttaatatttaatgtaataggtgatagaaaatgaaaacacagcatgcccaaagtagagaagcctttgcccatcaacctgcctctccaccatctgtattttttacctcagtggctaacacctctaacctgaagcagaaacccagaggtcatctgggctagtctctctctcatcttcctctccaagtccttgtcatccaagacacagaaacggggcatcattctctgccccattcaccaatctatcattatgaaaagtgtgtgcaatgattctgccctcgttgaatctttcatgaagcgtcttctgagaggtctcactgcctctgcaccagccctacattcccactagagccgtctcttgaaaatgtaaatctctcatatttgcactacctgtaggctacctgctgcctacaagcaaagtccaaactctttagcgtagcttttgaggcaattttgatctcactgctcactaaattttcattctcatcttctatctgtggaatctgaccacaaactacttgttaggctcagaacaggaaatgttcagcaacctcaacctggggtgactccctcccctcacagctccttgttcgtagctcttgtatcactcattatactgtcttgtaattagctgttcacatattgcctcctctgctctaccacgaactcaataaggacaggggccgtgcttgactcatcctgaaaacacagagccagcgtactgtgaaaaataaacaaacagtggtttactggatgaaaaaaaaaaaagaataaaaccctacattttagaagcctttaaatcaagagtcacaatgttcagtgattcatacgaggttaccaaaagaatgggttgctacagcaaaattaaagtttagtgataacacatagcagctttcattaaaaggaagtccttaatgtgggattttctgccatatctcctgtctagtttagttggggtctgatcagttcaatgtaatctaggatcaagtatattatatccagtctttttttgccccccccaacaaagacacgttacataattcattttcaaactacaaataaaaagagctggcacatcctttttattactgattttttcatttttttcaatccttgtgttagttttctagggctgccataacaaaataccacagactgggtggcttaagccacggttccccaacctttttggtaccagagacccattttatggaagacaacttttccacagacccaggggtggagtgggggtagacgtttttgtgcccggagttggttccttctggtgggttcgtggtctcgctgacttcaagaatggagccacagacctttgcagtgagtgttgcagctcttaaagatggcatggacccaaagagtgagcagtagcaagatttattttgaagcgtgaaagaacaacacttccacagcaaggaagcggaccctaccaggttgccactgctggctggagtggccagcttttattcccttatttgtccccgcccatgtcctgctgattggtccattttacagagtgctgattggtccattttacagagcgctgattggtgcattttacaaacctctagctagctgcagagcactgattggtgcattttacaatcccttcgtaagacaaaaaagttctccaagtcccctacttgacccaggaagtccagctggcttcacctctcagtttcaggatgattcaagtggattacatttattgtgtactttatattattattacattgtaatatatatgaaataactatacaactcaccataatgtagaatcagtgggagccttgagcttgttttcccacaactagacggtcccatctgggggtgatgggagacagtggcagatcatcaggcattagattctcataaggagtaggcaacctacgtcacaataaggttcactttcccatgagaatctaatgccactgctgatctgacaggaggcagagctcaggcagtaatgcaagcgatgggggttggctgtaaatacagatgaagtttcttttgctcacccacccactgctcatctcctgctgtgtggcccagttcctaacaggccatggacatgcaccagttggggtactcaactggtactggcactggaggcctaggggttggggacccctgggttaaacaacagaaatttattttcttacagttctggaggtcagaagtccaagaccaaggtgtcaacaggtttggtttctcctgaggccttgctccttggctatcagatggctgtcctctctctgtgtcctcacatgtatgcacacaacaatgatgtctttccctgtacatcctaatctcttctgataaggacaccagtcatattggattagggcccacccaaatgaccccattttaatttaattacttctatatccaaaggccctgtctccaactacggtcacattctgagaaactggggttagggcttcaatatgtgaatgttggggttggaaatggcacaattcaatccataacaatctttaccacaagtgatacaaaaagtgtaaaataaccataacctttttaaaaatataatttagggttttgtttgtttgttagataaacaaccactgctaacataagccattactccgaactattgagggacagtaacaaagcacatgtagatccctctccaattccaccagccctctgtgccacacagatggcataacaaagcaaagagatttacgtgtcaaacacataagcagttgtagctaaatatcctaatccaagaagtgcacttactcctggataaatataaagctaaacacaactaggaaaagaccacatgctgagaataataccaaattagtttcttctagttttcacttaaccacttaccatccaaaaacaaacgagtttggactttaccattcatttattcaacaaatattgatggtgcacctacactgtgccagaacatggcaatgagcctcattctaagaaggtgggggaacagagaataaacaaatacataagtaaatgtgtaacacaacggcaggtattctttttttttttttttttttttttgagacagagcctcactccatcacccaggctagagtgcagtggtgctatcttggctcactgcaacctctgcctcctgggttcaagcgattctcgtgcctcagcctcccaagtagctggcattacaggtgcctgtcaccacgcccagctaatttttgtgtttttagtagagatggggtttcacccatgttggccaggctggtctcaaactcctgacctcaagtgatccacctgcctcggcctctcaaaatgctcagattacaggcgtgagccactgcacctggccaatagtaggtattgacagatgctatgaggaaagtgaaaaagggtaagaaaataaagagtgaaagagaagagctagtttagactgcatattagggaaagcatctctgattaagtaagaaggatccaaggaaacagaagaataagacatttaaatatctggaggaaaacatcccaaacagaagaaacaggcgcaaaggttccaaaacaagagcttgactgttgtattccaggagcaataggaaggctggtatggaggcaccaaattgtgcaggacttgtagatcaccactaatgctctcaattctattcttatgactggaagttactgaagtgcttgaaacaggaaagtaacatgatctgaccccaaattttaaagcatcattctaaatgctctaggcaaaacagactagagacagctctatgcaaaacagactaggcaaggatgggatgaggaatagaagaagggaaagcagttaggagtccgttgctgtagcccaagtgaagaccacactggcttctttgaggaagcagtggcggagttaagaaatgacaaaattttggtatattctaaagtgtcaacaaggtttgctgacagattgaatatgggttatgaaagcaatatggcatcaaggatgactctggcatctggcctgagcagctgagtaaatggaggtaatatttactagttgaggaaagtaaagggacatgagtaggaagggaaatcaagagttgatggattaccatggcattagccatgttaaatttgccttttagagtttttaaagtggagactagtatacaattctggaattgaaagaggtaaaagttggagatatgtttcgtataggttactttttcaatttaattgttcacttgtcagtagttttgctgatcttaccaaaattgcaaagacgtttggggaaaaatttttttttaatcagagattgaatgagatctcttaaaaacgatgtataactggagaagaagtcacaggactgagctttgagaaaccccaacaattaggtgtagtatttctcaggaaacccaaccgttaacatattaattctaggatatgtagattttgtcatttcgaacattactattatttagaggaaatgcctggtttttgaaactaaatttaatagttgttttttaacttttattttaagttcagaagtacatgtgtaggtttgctaaataggtaaactcacgtcatgaaaagttgttgtacagattatttcatcacccaggtatgaagcctagcactcaatagttatttttcatgattctctccctccaccctcttataggacccagtgtctgttgttcccctctatgtgtccatgtgttctcatcatttagcttctacttataagtgagcacacaagtggtatttggttttctgttcctgcattagtttgctaaagataatggcctccagctccttccatgttcctgcaaaggacatgatctcatttttttttaatgacagcatagttttccatggtgtatatatgccacattttctttatcctgtctaccactgatgtatatttaggttgattccatgactttgctattgtgaattgtgctgcaatgaacaggcacgtgcatatgtctttatggtagaatgatttatattactctgggtatatatccagtaatgggattactgggtcaaatggtagttgtttttaggtctttgaggaactgccgcactgttttccacaatggttgaactaacttacattcccaccaacagcgtataagcattcctttttctctgcgacctctccagcatctgctttttttttttttttactttttaataatagctattctaactggtttgaaatgttatctcattgtggttttgatttgcatttctctaatgatcagtgatgttgagctttttctcatatgcttgttggaaaaatgcctgttttatacagaacaaaaattcagacaaattcagttttaaaaatgtaatgttaatcatatagtctccttttctacaaataaatatttcaaaaaatgagaagaaaaactataaagatattaaattaagcaaactaaagagaaattatattcatgctgtaatttattcctaaatcaaacaactagtaattccagtaaatcaataatccatagtttataggacagtactgattcaaagaaatgttgaataagaaaaagcaaaaagtcaacctttttccatcaataacctttgactgcttaaaggaagcaaaacaaaaagtaaaaaatccaatcataccaaagaagactctaaaataaataagttgactgcacatgtaatagcttagatatgttcacataatcccttggtccgtccagccccgcattccacttccagcagtgactgatggtagaatatggttatgactcctacttacgtattccagaattgtttgataatcatttacaaccctatcaaccataaattgaataaactatgccaatattttgtcatttgtgtttgctttaccaacataaacttagaaagttttatctgcatttccctcccactatctgctgccggattccctttttcacatctaccttagatggtcagatttactctttcttgttctcttctaacacaaaactccattttattgacgatatccaggagaaaatatacatagctacttgctcatcatgatgaatatgagagataataaacattaagcaaaaaagatcatcaaagatagtgattagatttgcagggctgaagattttatagcaaccaaaatatgatttaaatatagctcatcagcaaattaaatacttatattcagtttaagattgattaggctgtatccacctcatttgtcagaactctctctaagtcaatagtcattttgtctcattgtttggggtaaaaattaaataccagtcacccatcttgaatctcattggccagcacttgatctttaatgtcccaaagtcccttctttgatattaccatagtctctcaattctaaaatactatcaactacaacacaaaccaccaatgtaatcacttctcttaaaagtgtaaatatggatattttgtcaatattgaaccttccataaccaaggtgaagccaagagacttattgtctaggaataaagacagcagacagaacaaagataccattgatcatctttgagtttcaaagctgactttcttaagctctcaagaaagaaaataattgtgaagctggaggcatcatactacatgacttcaaaatttactataaagctatattaaccaaaacagcatggcactggcataaaaacagacatgtaaagcaatggaatagaatagagaacccaataccaaatccatacatttacagccaactgatttttgacaaaggcaccaagaacactcactggagaaaggacaatttcttcaataaatggtgctaggaaaactggatatccatacacagaagagtgaaatgagacccctatctctcaccatattcaaaaatcaactcaaatggactaaagatttaaatgtaagaccaaaaattatgaaactagtagaagaaaacacagaaagagaaaatcattttctaaatccttttggctctcatttagcaaaagctagatctgatagactagatcacagttttatgataaagaagatctggtcagacaggaaaaagaagtgtggactattggaagaaaggtctcagaaacaggttagacacattttatttctcttctctgggcttcacccagattaaaagctgtaatggctctcaactaacacagttagttgggaaacacagaaagccgaggaatttttattccatttatcttcaagactttgaaagaaaattgttttatgagctcccctgcacaaaacttcaggggtagctacagtgtaatcttgccatcacaatcttgaagctcaataatacataacaatgtaaatgggtagagagaaggtcagcttagctttcttaaatcagtcttgattcccatgaggcttagatgaaacccagaacatcctagataccatgaaaaacaatcaaaatgaggctatgttgaaaagcagtgggcctgccctgagttcaccatggtgaagagccaagtgatctagcagagtctgagggtacacagataatgccagatactggatggaggatgtagctgggacttcgaatctgaagcaccatcaagggccaaagtggggttaaagcatcctggagaaaccacagaccctagccaagctacaaaagaacgccccacaaagcatataaggacatcaagaaatgcacagaggtgcccacaagatgaccatgcatgggacccatcactccctcaaaggtcacagtccagagagcattccagaccagccactcggcaggcactaagtgtccaaaggtcaccacatgggtccaaaggccgcatctcccaccgtgaaatcatataagcaacaccctcaacccaatctcctgttttagagcattttatctaaaaagactgagcatttaccaaaagggactgtttatattgttgaatcacatcagtttaccatcttattggcttaaacagaaggcatttattccaattcccagtaggtaggagtttatgaggaaggtcagatcacttacgaaagataaactaaagtgtgctgtgggaaaacttgtaatcccctacaagtacaaaaaggaaagctacattaaatgtttatttccattatacgatgcatcctaatttcagaaatggtaaaaaatgtgaggtggacaatgtgggaaaatgtgtttaaattaacgaaatatggtatcttgcaaatcaagattgcgaatgcaaactgtttcctaaaagaaaaaactcatctgaaaaaccacatttattaagccttaatttatttaatttgtagagctttcactactgtacatatatatgtgtatatatatgtatatgtgtgtgtgtgtgtgtgtgtatatatatatatatatatatatatatacagaaatgtggatatctatgtattcaaattcagctacaatgaggttaaaaaggcatagaaggggcaccattttatggcaagctttggaccaagaggcagaaccatgctcactactggctgatatcatggccagcataacagttctgacatggtaatcacctgggagctttaaaaattattgtctagtcctacttccagagattctgatttaactggttttgtgtaaggcctgggcatcaggacttttaagagctccccaggcaattttattgtgcagccagggttgaaaaccactgggctaacagaatctcaacaataacagggattttctgaattgcctacttagtactcttcctccaagtaagccttctgtatctcccatagggcttggccacaaaccactccatcatactttatctcactgggggctctcaattgtgtgtgagataatgcccatttcttacccttccttaaccagggagtgcagagtagctccatgagaaaatggtcagtctaggccaggcgcagtggctcacgcctgtaatcccagcactttgggaggctgaggcagacggatcacgaggtcaggagttcaaaacctgcctgatcaacatggtgaaaccctgtctctactaaaaatacaaaaaattagctgggcatgatggtgcacgcctgtagtcccagctactcaggaggctgaggcagaagaattgcttgaaactgggaggcagagattgcagtgagccaagatcgagccactgcactccagcctaggcaacacagctagacatcatctcaaaaaaaaaaaaaagaaaagaaaagaaaacggtcagtctagaaccagggccttccaagacatagaaggggcaccattttacatcgtaggagccaaatctggcctcttgtctattttggtaaataacaaaattttactggaacacagccacacccatgtgtttacatattatctaagtttgctttcacattacaacaatagcagagtagttgcaatagagacgctatggtccccaaaactgaaactatttactatctggacccatacagtaaaagtttgccaaccactggtctagagtcagagttttcaagctgcaacagtatctcataagacaagttagatgtcctgaaatagccccggggagtctatgaagggtagagtcagaccttgagcagtgaaaatgacgacatctggggagatatggactcttctatcctttcagccagctgaagcacaattgcttctatcaatctattaatatcattttccactaagagggcaggtgtatcttggcttatcagtctgcatcacctggctgcccacacaatcagtttataagagaacaattatatcctaaagctaagttagaagtgggtatctatggaatcagtctgaattcattgaggaaaagatgagctgtgattgaaagataaagtattaacagaaacagagtgaactggggttggttggagaaccctgaaaaagaggggagcaacattaaagtgaagaaaatcacagtctaataggacaaaaggtttaggaagcaagctgagaagaggtgaagcacatacaatgaatggcagctacccacagatcatctcaaagctaccagtttctgctggtgggggcctccttgtatccttgccatgcacgctcccactggacttgtactattttaatcaattagctatgggttttcctatccttattttaatgtaatgagtgacttcctttttctccactatttgtgtcttaagaaatactatagcctagccattttcccatgggagcagttttctggcagtaaaatcatgcagaaattggagaattcactttattagaatcaactcagctatactgaatcatcttaaactttaaaacattactgaggcagaattaagtttatttcttcatcctaccataaaaataacatctttatacttattaagccttaagcctattagtatttaaaagacacttaatttactaacttttaaggttactcgttgaggttatagtcaaaactccaatatttgcttacaacgtgccctacaagaacactctatgtgtgcagacttccttttgagatttccttggaagcttcaagattaattctgatacaaattctattgatagaataatcagcaagagtacaaaaaagaagcttggaggtaaaaccaagaaagcataagtaaatggcatcatgcttattcaaaatgacctatagaaatgacagaaagcaaccacaaacaaaacttgaactgttttctgaaagaaacaaaggaaattatcttctagaaggctaagaagccaaagggggcagacatgttctctccctgctacctgaaagccaatcaaatctgtctgtagagcagtggaaaattaactctttgggcatctaggcatctctttgcataaattgatatatatgattgcttgctgcctttagagggggttgtggtcaaggagagtagaaaggaattttgacgagagtggggtgtagcagagaggttcttcataggagccaggcaggaaagaaaaacatggtgcttggaaaagctaggactaactactccccatgcagtcactaggactggccttgactctagtaaggagcggggagagagtagagaagaagctgaaagggatcattttcataggaattgtgtgtgactctaggtgcaatcattgcctcactggggcccatatgagagagtgcagcacagaattgggaagagaggcattctcccctcttttgtaggagcctagcgccattctaccacattgaggattggcagctgaaggagaccagagaatttcaccccaaaatatggtaccctggtatgtttattattattattattttgagacggagtttcgctcttgttgcccaggctgaagggcaatggtgcgatctcggctcactgcaacctccgtctcccaggttcaagcgattctcctaccttagcctcctgagtaggtgggattagattacaggcatgcaccaccacgcctggctaattttttgtatttttagtagagacaggtttctccatgttggtcaggctggtctcgaactcctgacctcaggtgatctgcctgcctcagcctcccaaagtactgggattacaggcatgagccactgcgcccagccgattattttaaattaaacacccctggggaccagcagacactggaaggagctttactttgatactccctaatctgcctaatgtccagactcgccaaagaaaaaaataattacttctggtcccttccctgagttttcatcaatttaataataactctaatcacaggcaggtagactgaagtctgtcaacacacctggacagacgtttgtcaaaaatcatgctctgcgggcccaacaaactttgtcccaggccactgtatgttctccaagtccactgaatttcccctaaaaatcatttactacaccccaagttgacacatttcccctatctcccctcctctatgaaaaagggtatataagcttctgtacccgttgggttatgaggtaatcattctcctactattcccctgtgttatgcacattgaaataaattttgtgtgtcttttctcctgttaatctgcctcttgtcagttgatttttcagcaaaacttcagagggcaaagaggaagcaatccctttgaccttacagatttggcattgttggtgggataaccaaaactgctctgctcctctagaagctgcagtcaaaggaacacaggacctgataggtgaacagaatgataagaaattcttaccagtcagactcccagtctctctctctgcataatctggtcaagcagacgagaaaaatcagtttgtctcttttttctttccaaatttaagattaatgggagaaaagcatttgtatgactagtcttagatgtaatgactctggtatatttttgctatgaatattcatattgtccatccttttcctcacagaagtagtctttattttttcctttgtctctgtctttctgtgaagagtccctcttgttttatgtccttgagagcttgacttttgaccacgtaggagccctatctcttggtctctgccatccagtgggcatgatttttgggccacgtctggtggccagcctaaaaggactaggaacccggaggtacctaagatattaagcagcacactctgttccaaatgtgccaagctctcagcaaagtttttcttaaataagaaatcccatccataaggggcttttgttgtcctaactcttgttgcctggatagtcctggaaagtccaatcccaggaggacctactcagtgtcacagattaacagatctatgactggtgcccctccctcctcaatactggaggcaccatatgaacaaacacctcctcaaccatctgtcacaagtgtcctttgctatattagactttttctgaaagtgaattttgaggggatcatgagaactacatcatcttcccatttttatactgccacttatactgtccatgatagtctaaacctggaaagctacctctgagactccatgaaaatggctcattaacttgagtcatttatggaataaataaattggctatacttaaaagaaaactttttagagagtgcttgtcttaaacagctatcttattcgtacctatttttaaaaatattaaaggaatatagccttagaaattctcttagtaagatttttaaagcagaaataatattcaaaggaaacttaaaatcctgtacactcaattgcctgctttggatccatctaggatctgcaaaaagcactctggcctatggtctaatggctaggattccactgtttcattgcctcaactcaggtttgatttctagtcagggaaccagccccttggagatgtaaatcctttaactcaggggaaaaaggaaacatttataaaaattagtttgagggtcaggcacggtggcttatgcctgtaatcccagcactttgagaggctgaggcaggaggatcgctggagcccaggagtttgagactagcctgaaacagatcccttctctacaaaaaattaatttaaaaaattagccaggtgtggtggcatgcatctgtagtctcaaatactcaggagactgagacaggaggatggcttgagcccagagatcaaggctgctatgagccatgattacaccacttcactttagcctgggcaacagagcaaaaccctgtctcaaaaaaaaaaaaaaaagaagtttgaattacttattttgaatttatatttgtgtgacccttgactttttggggtacccatttgtcattgatctttttcccttccatggacagttatgttcctgttcatcactaagtctctattttcttccagaggtctttgtggggtggctctggattttgtgaagactgcttctttgtacctctttggagatgtcttgtgctcccttggttaaatcataaatggcttttttggttctgaatcacttggtagttacctttggtttaaaagaaaaaaaactgaagttcagataaataaagttttaaaaaaataaagtttacttctccttcctttctctacgtctgatacacatgaagggatctagatgggactttgagtgaccctgaagcctcttgagaaccacaacaaaaaggtaccactgactccctgttttggggttctctgttttcctcatggagactcaaaagtcgtgaatgggttcctctcaggtctgaaatctctactcttttttgcattaaactccctcatctatttgacttttgtatacatacatgtatacgtgtgtgttgtatgttgtgtctacatgtatgtgtctatacatgtgtttgcatattatctacatgatatcaaattgacttaaaaataaatgagtactcataaattatataactagcccaaaacttttcaagttcccttgactttaataaatctttggtaaataaagctagttttaaaattgctagtaaaataaaaatgtcttcaaaatttaatttagacatttttgcctaggtctactggtcacacaggtttatgctacctctgttagatgttttaaggtcataaaactgttgtttctatgatattcttgatattttcttgatttgtatataaactaaaactgtaagtgctggctgctgggctcccaaaagtcttacacacatcctactgtggcttgttgagccaagcccaatatggccccatcctccctggtccagctctgcctcctggtcatgctgagaggggtcagatcctcccaacattgtcttcacaagtccgtcctctgccctgggccctatattaggtgtgcaaatccaggattcagacaggtcctacccttcgtagtcatcctgggtgccacatgggtactcagaacccaggacaactagagtagggacaatggggagggacctgtgtccagtatctcaaaggccttagttaagataaaattagctgatgctggttttgctttttcaaaaaaaatacataataacctaaataaatagctttattttccatgaataattcaaatataactgttaaaaaatatttttcaataatttaaaatcttaaggacatgttatgttaagtagtagagaatcatgaaatgtttgagtcatttctaagtaagttaaaatactaaaacattaattattaagcatagtttagataattttgacatcttgttcttatatggcatagaaaagctaaatatatctgtatctgttaatgagcaaaaaactgatgaaacatctttctaaaaattataaaattgttttcatttacaaacactgatataaaacagttcaaaattacttacttcctaggttttcagtagaaactagggttactaagagttactattataattagtatataattaaaactactgtatatgataaacaactatgtatggagtatgtaagggaagtaaaatgttataaggtatgaggatgtgcttttgttgagaaaaagcaatttcatatagttcagagattatgtaaaggttgtttcaaaatgagaaaaatgatataaataaaactaaatgggtatagaaagttgagaaagagagaatttcaaaataattaaggtgaatgaaatatttaatatttaatattaaatttatttaaaatttactatttgtttttaaactgagccttaaaatcaaaaatagtctacaaaactagaattttattttctcctttgaacaagattttcatatagtatcaataagaaatagtaaacgactttggttcacattttgagtaaactgcaaaaaaaaaaaaaggggagaaacagcttttgtgtgcctcatgctatcttaataggtcttttgagtatttgaaaaactaagtctcatctctgtcaaactgtcaaagagtaaaggttttggcttttggaaatcctttattacaccagctaaatgaatgactttatttcacagtaatttttgatcaaatattttaaatgtttgacatacttgacaagcttcccaaaatcaaccttcaaattctaaagtaagtctttttgacttcaaactaactttgggattttcccaaagacccctgaagtatccaaaagagaaataataaacaggtttagtttatatattaaattatatgggaagaactgtcaaataacaaataatgtttaaccttttttctgagttatatttatatggctatcttgttagtatgtgttccaaaactgtatgagatttcttaaaatatgatatatcttggtatatgttgtcattcataattatgagtgttatgttgaattgttgtaggccacaaaaaaaagaccaaatatctttgtcaattgtttatttaaccatggccattttaagtcccattgtccacagttaattgttttattctgatgctttttttttcttgaaagctcttcccaaatcctgaagtatgggtcttcaaagaagttcatgggaataacactgacaaataaaggtttctgacaactctgaaactgtataagtgaatcaatgaactgtgtaaaaattccagaactctaataaaaaaaaaaactggactcataaaattgctaaactaccatcaagcagaacaataattaattacatgggactgaactgataaaagactgaaatgattatttatgattttttatttaggctaattatttttatgttttgttctccagagttaaaaaaaaaacaacaactttttaaaggctacaattcccctgtgttatgcacactgaaataaattttatatgtcctttctcctattaatctgccttttctcaattgatttttcacccgaacttccagagggcaaaggagaaatttggccttcacccctacactgctttgaagccactaggacatggctaccttggcatgttcatttccagtttcccagagtaccaccagcagcagtcaccatccaccagcaataagctgaagccagacaaaactggaatacacggcagatacgctggtttgggagcacaagtgagtcataattcagagacttcaaaatttggaaatgcaggaatgaacagaagagaaaagaggttttataggaaaatccccactctagcacaagcaagtgaggtcaattacaggaactctggattgctgctgctaatgggacttcctttgaacttgcaagggtagagtaggaggccagggaatcagattacataaggataagcatctggcctacatggcccagtggtctgggaactgaaaacaatgagtcccacagaggctgaagtataattctgagaatagaatgtagtttggaaactgaaaaaaatctgttaaaaccctggcaactaggtaatcttattgttcctgaacagcaggagtttgtgaatccaaacctgaaaatgccacattcactatgactcaactcttccccttgtttctactttctgtgtatctttcagctttgcacctaatagaactgtttaaccctaggtactaactgcttaaatctcagaatatagtcaactcctcaaaaagaggatgctaacgggaccaattcataatcatcccccagaggcagagctctcatggcagagcacgtcacagggttcttgccaacctataactgagtgtcactaagtcagttgcccaccctgataaagttagctgtaacaagggtgccaaagtgtcttgagagcattatggagacttaacaaaaggaacccctaaaaagaaggcaaagggaatgtaatagttattaaggctgttcacaaatattcccattgtcctctgggcacagggcaggatcacatacccaacatccactttgaccacataacttgctttgacaaaagcaatgtaaatagaggattgacatatgtcatgtccaggtgaacattttaggagttctcgcatgatttatcatgttccatttccccagttgcaatgacagtggaagcacatgttgagataagtctatattagcctgggtctctgagtgcctgtctcaagcagaaaccccagctcacattgaacatgtagcttgagcaggaaataaattttattaagcctctgagatttgggggttgtcttcttatcacagcacaaccttgcttatgctgactaatacaggggctggtaggtaaacttgccccagtgagtattaaaagctatccccaaggggacaggtgggagacactatggaggtagaaatgaaaaaaaggccaagaggtcctacaatacttagaggtgaacgacaaagaaataatgtttattactgttcttctaactctagatttacttcttgaaaacatgggatatatttacagtcagaaaatacatttgacctttgcccttcaaaaaaaaactttacaaaagataacacattataaagagtttgttattactattattttaagggattttgagtaagtcaattcttttaactcacattcaacataaatctgacacctaccaaactgtattttgcagcaaataagattatagacagtttcattatataatgactgtagcatgatctagcagtttatatccccttcagagagtatacaacatagagatgtaaattctttgaagcacaattctgcataaatagactttctgcattgcattgccaaacttggatcttgaaagtgataaagtgcagatgcctacagttgcagtcataaaaatgtaattgctgagaaattatttctgatccattggaagaatttattacagagggatgcaactgtgtaagttatcacacaagaaactgaaagtgaatgattgaaatatatcccaggctaaatatccctgcaaaatgacccaagagaaaaaaatctctgtgcccaagagaaaaaaaaaatacattaaagataaatcaggtttggtagggaagaatttggtaaccataaaagagcagaataaagatttatgaagaaatgaattcagaagttagagtgacataatagtatctatgaccaattactccaaaaattaaaatgtaattttgactttgagttatatacagaggtgataagtaatttctgtggaaccctggaagcaaaggaatataacatgaagataaatcatgaggaaagtgaagaaatttttaatgggactactgaattaataactttagctggtggcaatgtgaacttaaagacatgaacttcttttggaatgttttccagtgaaatcagagactatatcatgtacttaaaccatgtaactatttcaaattaaacactctttgtaacagtagccaaaatatgggaacaaccatctacagatgaatgaataaagaaaatgtggtgtttatgcaatcgaatactattcagtcataaaaaaaagtaaatcctgccattttctaacatggatgaacctggaggacattatgctaaatggaataagccagacacagaaaggcaaatactgtatgatctcacttatatgtgaaatctaaaaaagttaaattcaaagaagcagagggtaaaagggtggtttccaggtgctagcgaattggggaaatggggaagattgttgatcaaaggatataaaatttcagttttaagatgaataagttttgggactctactgtgtagcatggtgactatagttaacatattgtattctttacttgaaatttgataagaaagtagattttaagtgtcttagccacacacacacacacacacacacacacacacacacacacagtggtaactatgggtagagatggatgtgttaattcatttgactgtggtaatcattacacattgcatacatacatcaaatcatcacatcgtacaccctgaatgtacagaatttttatttgcctcattacctgtccattaaatatattaaaaaaaaaaaacactccttctcctcctcccctggggtagatggcggcggctagatttggagccccaacctcgctgccggcaccaagatggacaattagaagcagctgcggtctgcgcactcagagaggaaggaaaggagcaagtgaattcagcaccttcaactgaagtatccaggttcttgcattagggctgactaggcaaacaatttgacccacgaagaacaaagaaaagcagggtggggcgatggtccacctgggagcagcacggagccaaatgaacccccaccctgagccaagtaaagcagtaagtgattgtgagaccccacctggaaaaccacgcttttcccacggatctttgtaatccgtggatcaggagatcctctcgtgagcccacaccaccagggcgttgggtctgatacacagaactgtgtagaatgttggcaaagcagccgtccaggcacacacagagacccaggagttttccacactccagccccaggatccctggcaagacgagagatctgtccgtatatatccctaggaagggggctaaaaccagggagccaaacagcgtcattctgcaggcctgctcccacagcaccccacaagttaagacccactgattggaattccagccagccaatggcaacaggctgagatgagaccaagttccttgcgggaggggcggccaccatctccatggttcagtcgactcagccattccagcctgatggctttggagaatacaaatggtccagacaaagaagggtccccgacaatagcacagctgccttgccagattatagccagactgattctttaagtaggaccccaatccattcctcctcacagggtgggacctccctgtgggggtttcagccaccccagcaagggctctacagacaaagccctgatctctccctgggatggagctctcaggaggaggggttgccacaccatctctgtggttcagtggactcagccattctagcctgccagctttggagaatacaaacggtccagatgaagaaggatccctcactccccgccccaacgcagcatatctgctccaccagaaagcatccagactgcttctgatcccattcctcctgaccaagtgagccctcccaacaggagtctacagacacttcctacaggcacattaggaacagcaacatgtcagtacccccactgggacagagcttccagaagaaggagcaggctgctgtctttgttgtttcacagccttcactggtgatacttccaggtaaggaaaactgaggcaactagggtctggagtggacccccagcaaaccacagcagcccaacagaagagtgacctgactgttaaaagaaaaacaaacagaaaacaacacaacaccaacaaaaaagaccccataaaaaccccattaaaagtgagcttgaagactatcttgctgaaatagagcaggaagacaagattagagaaaaaagagtgaaaaggaaaaaacaaaacctctgagaactacaggaatacataaaaagaccaaacctatgactgattggagtacctgaaagagacagggaggatggaaccaagttggaaaacacagttcaggatatcatccaggagaacttccccaacctagcaaaacaggccaacatataaattcagggaatgcagagaaccccagtaagatgctccatgagaagatcaaccccaagacaaataatcgtcagattcttcaaggttaaaatgaaagaaaaaatgtcaagtgtagccagaaagaaaggccaggtcacctacaaagggaagcccatcagactaacagcagaccactcagtggaaaccctacaaggcagaagagattgggggccaatatttaacattcttaaagaaaaaaattccaacccagaatttcatatctggccatactaagcttcataaatgaagaagaaataagatccttttcagacaggcaaatgctgagggaatttgtcaccattcagtctgccttgcaagagctcctaaaggaagcactaaatatggaaaagaaaaagcattatcagccactaaaaaacacactgaagtacacagaccagtgacactattaagcaactacataaacaagtctgcaaaataaccagctagcatcatgatgataagatcagattcacacaacaagattaaccttaaatgtaaatgggctaaatgttccaattaaaagacacagaatgacaagttggataaagagccaagacccatcacagtgctgtcttcaagtgacccatctcacatgcaaagacacacatcagctcaaaataaagggatggaggaaaatttaccaagcaaatggaaaacagaaaaaaagcagaggttgcaatcctagtttctgacaaaatagactttagaacaacaaagatcaaaaaagacaaagaagggcattacataatgataaagggttcaaactgacaagaaaagctaactatcctatatacatacacacaatatgggagcacccagatgcacaaagcaagtccttagaaacctataaagatacttagattgggaaatttaaataccccactgacaatattagacagatcatcaagacagaaaattaacaaagatattcaggacctgaactcagctctggatcaagtagacctaatagatatctacagaactctccacccaaaaacaacagaatatatattcttctcattcaccacagagaatactataatcacctctatgcacataaactagaaaatctagaagaaatggataaactcctggacacatacaccctcccaagactgaaccaggaaaaaactgaatgcctgaatagaccaataatgagttctgaaattgaggcagcaataaatagcctaccaaccaaaaaaaaggcccatgaccagaaggatttatagctgaattctaccagaggtacaaaaaggactggtatcatttctactaaaactattcaaaaaattgaaaagaagggactcctctctaactcattctatgaggccagcatcatcctgataaaatctggcagagatacaaccaaacaaataaaacttcaggccaaaatctttgatgaacatcgatacaaaaatcttcaataatatactggcaaactgaatcgaagagaacatcaaaaaaattatccaccatgatcgagttgtcttcatccctgggatgcaaggttggttcaacatatgcaaatcaacaaatgtgactcatcacataaacagaactaaagacaaaaaccacatgattatctcaatagacgtagaaaaggacatcaataaaattcaacatcccttcatgttaaaaactctcaataaactaggtattgaaggaatatacctcaaaaaaataaccatctatgacaaacccacagccaatatcatactaaatgggcaaaagctggaagcattccccttgaaaacgcacaagacaaggatgccctctcttaccactcctattcaacatagtatcaaaagttctggccaggacaataaggccaagaaaaagaaataaagagtatccaagcaggaagagagaaagtcaaattatctttatttgcagatgacatgatcctatatctagaaaaagcccattgtatcagcccaaaagctccttaagctgataagcaacttcagcaaagtctcaggatataaaatcaccgtgcaaaaattgctagcattcctatacatgaacaataggcaatcagagagccaaatcatgaatgaactcccaattatgattgctacaaaaataataaaagatctaagaacacagctaacaagggaagtgaaagccttcttcaaggagaactacaaatcactgctcaaagaaatcagagaggacacaaacaaacggaaaatcattccatcctcatggataggaagaatcaatgtcgttagaatggccatactgcccaaagcaatttatagattcactgctattcctattaaactaccactgacattcttcacagaattagaaaaaaaactattttaaaatgtatttggaaccaaaaaacagctcaaatagccaagacaatcctaagcaaaaagaacaaagctggaggcttcacactacccaaattcaaactatactacagggctacagtaaccaaaacagcatggtactggtataaaaacagacacgtagaccaatggaacagaatagggaactcagaaataagaccacaaacctacaaccatctgatcttcgacaaacctgacaaaaacaagcaatggggaaaagatttcctatttaataaatagtgctgggagaactggctagccacatgcagaaaattgaaactggacccctaccttacaccatatacaaaaagtaacccagaggaaagatcaggcagcaacatttgctgttcaccaatattcgctgttctgcagactccactgctgatacccaggaaaacaaggtctggagtggacctccagcaaactccaacagacctgcagctgagggtcctgaatgttagaaggaaaactaataaacggaaaggacatccacaccaaaaccccatctgtacgtcaccatcatcaaagaccaaaggtagataaaaccacaaagatggggaaaaaacagagcagaaaaactgaaaattctaaaaatcagagcacctctcctactccaaaggaatgcagctcctcactagcaacgtaacaaagctgcatggagaatgactttgatgagttgagagaagaagacttcagatgatcaaacttctccgagctaaaggaggaagttcgaacccatggcaaagaagttaaaaaccttgaaaaaagattaaacgaatggctaactagaatacccaacgcagagaagttcttaaaggacctgatggagctgaaaaccatgacactagaactacgtgacgaatgcacaagcttcggcagctgattcgatcaactggaagaaagggtatcagtgatggaacatcaaatgaatgaaatgaagcaagaagagaagtttagagaaaaaagaataaaaagaaatgaacaaagcctccaagaaatatcagactatgtgaaaagaccatatctatgtctgattcgtgtacctgaaagtgacgggcagaatggaaccaagttggaaaacactctgcaggatattatccagaagaacttccccaatctagcaaggcaggccaacattcaaattcaggaaatacagagaataccacaaagatattcctcaggaagagcaactccaagacacataattgtcagattcaccaaagttgaaatgaaggaaaaaatggtaagggcagccagagagaaaggtcgggttacccacaaagggaagcccatcagactaatagctgatctctcggcagaaactctacaagccagaagagagtgggggccaatattcaacattcttaaagaaaagaatttttaacccagaatttcatatccagccaaactaaacttcataagtgaaggagaaataaaacactttacagacaagcaaatgctgagagattttgtcaccaacaggcctgcctaaaagagctcctgaaggaagcactaaacatgggaaggaacaactggtaccagccactgcaaaaacatgccaaattgtaaagaccatcaaggctaggaagtaactgcatcaactaatgagcaaaataaccagctaacatcataatgacaggatcaaattcacacataacaatattaaccttaaatgtaaatgggctaaacactccaattaaaagacacagactggcaaattggataaagagtcaagacccatcagtgtgctgcattcaggaaacccatctcacgtgcagagacacacataggctcaaaataaagggatggaggaagatctaccaagcaaatggaaaacaaaaaaaggcaggggttgcaatcctagtctctgataagacagactttaaaccaacaaagatcaaaacagacaaagaaggccattacataatggtaaagggatcaattcaacaagaagagctttctaaatatatatgcacccaatacaggagcacccagattcataaagcaagtccttagagacctataaagagacttagactcccacacaataataatgggagactttaacaccccactgtcaacattagacagatcagtgagacagaaagttaacaaggatatccaggaattgaactcagctctgcaccaagaggacctaatagacatctacagagctctccaccccaaatcaacagaatatacattcttctcagcaccgcactgcacttattacaaaattgaccacatagttggaagtaaagcactcctcagcaaatgtaaaagaacagaaatcataacaaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaatgagaacaagatacaacataccagaatctctgcgacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaagcaagaaataagtaagatcagagcagaactgaaggaaatagacacataaaaaacccttcaaaaaattaatgaatccaggagctggttttttgaaaaggtcaacaaaattaatagactgctagcaagactaataaagaagaaaaagaagaatcaaatagacccaataaaaaatgataaaggggatatcaccgccaatcccacagaaatacaaactaccatcagagaatactataaacacctgtatgcaaataaactagaaaatctcaaagaaatggataaattcctcgacacatacaccctcccaagactaaaccaggaagaagttgaatctctgaatagaccaataaaaggccctgaaattgaggcaataattaatagcttaccaaccaaaaaaagtccaggaccagacagattcacagccgaattctaccagaggtatgaggaggagctggtaccattccttctgaaactattccaatcaacagaaaaagagggaatcctccctaactcattttatgaggccagcatcatcctgataccaaagcctggcagagacataacaaacaaagagaattttagaccaatatctctcatgaacatcgatgcaaaaatcctcaataaaatactggcaaaccgaatccagcaacacatcaaaaaccttatccaccatgatctagtgggcttcatccctgggatgcaaggctggttcaacatacacaaatcaataaatgtaattcagcatataaacagaaccaacgacaaaaaccacatgattatctcaatagatgcagaaaaggcctttcacaaaattcaacagcccttcatgctaaaaactctcaataaattacgtattgatgggacatatctcaacataataagagctatttatgaccaaccgacagccaatatcatactgaatgggcaaaaactggaagaattccatttgaaaactggcacaagtcagggatgccctctctcaccactcctattcaacatagtgttggaagttctggccagggcaatcaggcagaaggaaataaagggtattcaattaggaaaacaggaagtcaaactgtccctgtttgcagatggcatgattgtatatctagaaaaccccattgtctcagcccaaaatatccttaagctcataagcaactacagcaaagtctcaggatacaaaatcaatgtgcaaaaatcacaagcattcttatacaccaataacaaacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatggataggaagaatcaatatcatgaaaatggccatactgcccaaggtaatttatatattcaatgccatccccatcaagctaccaatgactttcttcacagaattgggaaaaactactttaaagttcatatggaaccaaaaaagagcctgcattgccaagtcaatcctaagccaaaagaacaaagctggaggcatcacactacctgacttcaaactatactacaagactacagtaaccaaaacagcatggtactggtaccaaaacagagatatcgaccaatggaacagaacagagccctcagaaataatgccacacaagtacaaccatctgatctttgacaaacctgacaaaaacaagaaatggggaaacgattccctatttaataaatggtgctgggaaaactggctagccatatatagaaagctgaaactggatcccttccttacaccttatacaaaaattaattcaagaaggattaaagacttaaatgttagacccaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttccgcacagcaaaagaaactaccatcagagtgaataggcaacctacagaatgggagaaaatttttgcaatctagtcatctgacaaagggctaatatccagaatctgcaaagaactccaacaaatttacaagaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaaaaacaggtgctagagaggatgtggagaaataggaacacttttacactattggtgggactgtaaactacttcaaccattgtggaggtcagtgtggtgattcctcaggggtctagaactagaaataccatttgacccagccatcccattactgggtatatacccaaaggattataaatcatgctactataaagacacatgcacacgtatgtttactgcagcactattcacaatagcaaagacttggaaccaacccaaatgtccaacaatgatagactggattaagaaaatgtggcacatatacaccatggaatagtatgcagccataaaaaatgatgagttcatgtcctttgtagggacatggatgaagctggaaaccatcattctcagcaaactatcgcaaggacaaaaaaccaaacaccacgtgttctcactcataggtgggaattgaacaatgagaacacttggacacaggaaggggaacatcacacacctgggcctgtcgtggggtagccgggagcggggagtgatagcattaggaggtatacctaatgtaaatgacaagttaatgggtgcagcacaccaacatggcacatgtatacatatgtaacaaacctgcacattgtgcacatgtactctaaaacttaaagcaaataaaaaaacaataataataattaaaaaacccaagatggattaaatatttaaatgtaaaacccaaaactataaaaaccctagaagaaaattgaggcaatagcattcaggacataggcaaaggcaaagatttcatgatgaaaatgccaaaagcaattgcagcaaaagcaaaaacagacaaatgggttctaattaaactaaagagtttcctcacagcaaaagaaattatcatcagagtgaacagacaacctacagaatgggagaaaatttttgcaatctattcatctggcaaaggtctaatatccagagtctacaaggaacttaaacaaatttacaagaaaaaaaaaacattaaaaagtgggcaaaagacatgaacagacacttctcaaaagaagacatacatgcggccaataaacatgaaaaaaagtttatcagctgggtgcggtggctcatgcctgcaatcccagcactttgggagactgaggcaggtggatcacctgaggtcaggagttcgagaccagcctagccaacatggtgaaaccccgtgtctactaagaatacaaaaattaaccgggtatggtggcatgtgcctgtaaatccagctaccaggaagctgatgcaggagaatcactgaaacccagcaggtagaggttgcagtgagctgagatcatgccactgcactccagcctgggtgacagagcaagactctgtctcaaaaaaaaaaagttcaacatcactgatcatcggagaaatgcaaatcaaaatgacaatgagctaccatctcattgtcagaatgcttattaaaaagtcaaaaaacaacagatgctgacaaggttgcagagaaaaaggaatgcttttacattgttggtgggtatgtaaattagttcaaacattgtggaagacagcgtggcgatttctcaaagacctagatgcagaaataccatttgactcagcaatcccattactgggtatatacccaaaggaatatatatcattccattataaagatacatgcacatgcatgttcactgcagcactattcacaatagcaaagacatggaatcaacctaaacgcccatcagtgatagactggataaagaaaatgtggtacatatataccatggaatactatgcagtcataaaaaagaacaagttcacgtcctttgtagggacatggatggagttggaagtcattatcctcagcaaactaatgcaggaacagaaaaccaaacaccacatgttctcacttataagtgggagctgaaggatgagaacacatggactcatggggggaacacactggggtctgtcagcaggggtgggaggagggagagcatcaggaagaatagctaatggacgctgggcttaatacctaggtgatgggatgatctgtgcagccaaccaccatggcacgtgtttacctatgtaacaaacctgcacatcctgcacatgtactcctgaacttaaaataaaagttgatgaaaaataaatactgaggtctacttagtcttttcaaataaacaggttactctttttttttcttttattataccttaagttctgggatacatatgcagaacgtgcaggtttgttacataggtatacacatgccatggtggtttgctgcatccatcaacccatcatctacattaggtatttctcctaatgctatccctcccctagcccccacctcccaacaggccccagtatgtgatgttcccctccctgtgtccatgtgttctcattgttcaacttccacttatgagtgagaatatgtggcgcttggttttctcttcttgtgttagtttgctgaaaatgatggtttccagcttcatccatgtccctgcaaaggacatgaactcatccttttttatggctgcatagtattcaatggtgtatatgtgccacattttctttatccagtctatcattgatgggcatctgggttggttccaagtctttgctattgtgaatagtgctcccataaacatacgtgtgcatgtgtatttatagtagaatgatttataatcctttggatatatacccagtaacaagatggctgggtcaaatggtatttctggttctagatccttgaggaattgccacattgccttccacaatggttgaactaatttacactcccaccaacagtgtaaaagcattcctatttctccatgtcctctccagcatctgttgtttcctgactttttaatgatcaccattctaactggcgtgagatggtatctcattgtggttttgatttgcatttctctaatgaccagtgatgatgagctttttttcatatgtttgttggccacataaatgtcttcttttgagaagtgtctgttcctatccttcgtccgctttttgatggagttgtttgttttttcttgtaaattttaaacagctattcttatctaaaaaaataaaaataaacactttttgaaaaacaaaaaagaatgtaatgagacacttaacatgatgttatcctagaaaaaaaaacctttaatataatttaatgagatattttatttgtgttggtgggttatacatgatcaaagtgacagatacaagaaggctgaacatcaaatccagaaagatcagttattttaaaatataactctttgactttgaaatgtactggtttttgataaggagaatcccattattaaaaaaacaagagtgtatacaaataatttagttaaatagaattctgctttataagatagttattgcataagttgatattatataaattattaatattttaatttaatatcacttgagtattgctaagaccataaaatcatttttatacctgagacgttgatgttttataccaaagtacttttaagaaatcagtgactattttgaaaacattgacatcaatcttaaggaagacaaaattagcaattatatttacatgtaacagaactgtctggtatgtaaaaggtaatgagttccatttctgtgactcatctacttgtggatcatgaaaagtttgaatccaagaacatcaaaagccctctaaaactagtataatcacactttttaaaagagatacatttctttccaatcaaacaagattactcaggtcattttcatccttctaattttataggtgaactcaataaatgtttatagatggttattatctatttagaacatgccataaaatgtgcacgtgcgcgcacacacacacacacacacactgtgactagcattaccctttaatgtgaatttacttagaatactttctattaacttctttagcaatgtacttgactaaagcaaaatatctattagtttcagttagaatataaaaagtagtttccccatgatactctctctgtttataagcaatatgtcagcaacctttgtgattagcaagttttaagtgaccaactgtaatgttccattgttatagagcaaataagggttataaactagcattaatgtatttgttttcaccagccatctccgaaatgaaggtcatttccctattcctactccttataattggataggaacaaaaccttaaatgacttgtgagaactcatttaaaactgtccccaaaaaacttggtgatatgtatgaaaaagtataaaaatattcatatcttggccattaacttttacatttgtaactaattctagtgaaataatacaaattgatgacaaaaatgtatatacaaagatgttcagcagagcaatatttataataggaaaaaaatagaaacaccctaaatgtccaaaaatgtgaggctactttaaaaaaactgtagtgcagccatatcatatataagtaaatagcagctttattaaaccatgcttacaaataaatagggaaattattaaaatatcatttaaaatggaaaagtgggattaaaccctgcatatatagtactagctccacttgttaatatatatatattcttcatatatatatatataatatatatacgtgtaaggatatatataaagaagatatattctttaatattacaaagtacaaagatgataaaaatctcccacaactttattgtactggaagtaaacgcaccaaaacattaatgtttatctcttggtaaaattatgagtgtttttattcttttttttaactttttttgacattccaatttttttgtgaacttcattagaaaaacaaatgagggtttttctttctttttttttttttttaaacagggtctcactatgttgcccaggctggtctttaactcctggacttaagcgatcctcctgccttggcctcccaaagtgctgggattatacacatgagccactgcacccagccttttttctttttaacatgaaactgtttagtgagtggctaagacggactttaatgaagtctccacagtcatctagtataaatttcacaccagatattagtgccgttaagactgccaaagttaactattaaggtatcatcagggatgcacatgttttgaattgtctttcgagtagcagatatcaacttgtacaacatgtacaaattgataaaaatatgtaaacttgtaaaaatatatacaaagtctattctcagagctactcccctccccacatccatctcacaaaaaagataagcagaacatatttaaattatctgaggaaaggtcggcatagtttttcacccaagtaacccttgggttctttgagtccctaggaaaagggacttgaatcttgtattaggaggcaagatgtaaggcaggcctaaaggggagttccctcacaaattgtgggttaatgacaaaaatttaaatctataccactgcataagtttcttcaagccctgctctaagaaaatccaatacatgaaatctcgacttacataataaaaaaagtcagagaatcattatgcatatcatcaaaggattattcaccttatgaaagacttcatcacagaattcctttaaatagctgcttttctcatacattttagtattttaaaggtagtttcccatttggcaaatgagatgccatgtgcctgaggcaagttagtgaaattctctaggcctcagtttcctcatctatgtaataaagatggttttaaccatgttacctgcctcattcagttttcacgattatcaaagaagataatttatataaaggtactctgaaaattatatatatatatatatatatatatatatattattactgctattcttgctaaaagagaatgtgggggaaactttcagaatacatactttttcacatcttaacaacacacatacctacttttcacatcttaacaactctttaaaggacaattttagatgacatatttatatataaaaatcaaatcttttattcttcattattcatttttcccacatatttttcattcttctgcagttactatatatcataatttccatggtattaatacctggattatgagaggctccagtagcttctccacggtgaatgtttggacctgcagatcctgaggatcgatattcaatgtgattggtgtttcagctgacatgctgcctgtgcacaaacacaaaaggatgcttattaataaagaaaactgttttctaaagaagaacacttatgaaatcatggaataggtaaaacttgtattcagcacctcttcctgatatcaaccatagccctcagaggaccaggctacaaaatctaccttcagagaaagaagatattccccaactgttccctgaggtcatgctgcctgggcttaggtcctgtaacaaattaatctacacaagtatgttcatgattaaattaacaactcatccggggtgggtttgtatttgatcagtagtcttaagtgatcagaaaggtaagacacatcttacagcattcaagtcctttggcttctgtgaaatcacagcactgaggcagcctatgcccatattttgcttcttcttgttaatgatgacttagacaaggaacaagtaaacctttgaaagacatgggaacaagtaaagatatgtccttacttgatttagagattgtttatttgagggttttgattggagaaggttaaaggcaatttaccttcttggacaggaaaagaaactaatacaaattgcacagttgttgtaaaaagagagaagcccctgagaaggcattgatatttggtcaagacaaaataagaagaaaaaaaagaattgcaagccattctctaaggcattaacgttatccttaaaaatcaattcagtgagatttttgcctaacaatatacatttataccaaatgaccatatgtggcatgtcatagtcggattaacgttcaaaaactctagccatattttcaaatagctataatatattatttattaatctactaaaaactacagtaagtgttaagaattttagatgaaacccactggcatcgttgattgcaaagagagagcacacttcctgaaatgtagcacatttctagatagttctctttctcttattgaaaataacccaaatggcctgcccagggccccatttgccccttcaaacctgccaagtgtgtccttgttcctagtctgtgcttaactctatcacaagccacttacagggtggctacaattcctttactttttgaaagattttgccttgaaaaaataattattcaaattctattaagtgaaaagatattacttgagtttcttctcaaatcaaagtttcaaattactgttattggcatatgatacatcaacatataaagtcaaagccctacaatttagccctgttttaccttgtttctctctcctttgcgttgatttcattctccttctaaaagtagaaacatggtctcttttctcagcgattcagctgcaatgtaagagacacgcttcaagaaaggctccaaacactattgccaaatggtttctctcaaatgcatttctagaactgaaatgttttagtttggtttggttttgattttgctttttcaatcatttcacctaccactttgattccttctaacacagggaaatctaaattgacagatagcctattcctgtggtgacctttctgcatagcccagagccaatctgtgcaataggatatgtccttcagtgtatagccttagggttctatcaaataagtgctcacaaaagaatttatttgttactcctctacgacaggtactatcctacataaaaatcaagtcaagatttctgccattgctttgttctttcatctgaaggacaaaagtagaggagactgttgtgaactaaaataaaatttggtgaaccttcgcagcctttaaaaacatgtcattttcaccgtgaaattcacgactggtttccaaagctacatggccaccagaaattgaaagtaaggaagataaaaaattaaggagagcaaaaattatccatatcatatgtaaatccttctagaagaatttttcaacctagaaggagctttctaaaaggagtgctttttagccaagagataaaagacaacctaatttagccaaagtatcttttaagtctgtgttcatgtctttaacacaaattaagtaaaagtttttcaaaagttcatttttccatggtaaaaattacttaaaaaaaataaatccttaaagaacttggcttcatataattattaatctttaaataaatgctatttcttatttttaaaaagtcttcctgctcttttgtatgtcctggtcagtattcctgactgattggaaattagggctatcataggcagaaaactgcataattttgcaaatgaaattgaagcaaagtcaaaatctgacaaatttgtagatatagcaataccacaacgcaaatccaaaacaaaaatcctactaggttgtaagtattacattctgaggcatttgcattttattttgttttatttttgagactgagttttgctcttgttgcccaggctggagtacaatggcctgatctcggctcaccacaacctccgcctcccaagttcaagtgattctcctgcctcagcctcccaagtagctgggattacaggcatgcacctccacgcctggctaattttgtatgtttagtagagacagggtttctccatgttggtcacgctggtcttgaactcctgacctcaggtgatccgcccgcctcaccctcccaaagtgctaggattacaggcgtgagccaccaccctggccggcatttgcattttgtaatctataaaatcttaggagttaggcagtacctcccaaacgattcaagaataccttctacacaaccttcatttcaccaacacactgggcttggatgaatagaaatgatgagaagcttactataccattagatgctcgttgagttgaaacctgccacttttaaacttttatccaaaagagatggcttaataaaggggaaaaagtacgctttataaataaagtaagaaaagtacagatttggagagagactataacaaaattccagttttcagaattaaaggaaggagaacaaatctcttgacagtggtgatagatgtctccagagaaagacaccaaggcagggcaaacccaaccatatggatccttcccttctccccaaactatctttgtctgcaatgactcaattttcttcattccactttattccctgctggaaactgaacttttatcattttatatcaattttaagttcatttggtttaacacacatttcatttctaaatgcagttaattctgagaggtcatggggtgcacacattcagtcacacattagtatgaactagctcattgcttgccatttgacaccctgtgcacgtctctattacagcacgaaccacgttgtgttttcatcgtgccctggcagcaaaggagagggatgatggaagatcagagagatgcacagagaggccagtggaaaactattcatttccaaaatttgcctaagggttgccattccctcacaaatattaaacagaaaacatttggcacctacttctcctccctacagtaacacataaccaccaccccctcccccactgcctccccactcttcaccacccactctagagctcaggctcctcttagtaaaactacaattcttttacataagttgtcatgttcttgtgggatggcttggaaacctaaccatctgtaatgtggttcctatagaaaattccctaatatcaaatatttaatttaaaaaaaaaaagattaacttttgtaacacaattagtttgtaaggtgatggctgattctcctttaagcttattaaattccatgacacagtcatcatacttacctaattagtctaactttatactcacttttcaactaaaatgtttaagtcttttttatttcaaagattattgcaaactcaagtctctcatcacatctttaaacaaatgatttttatttactcctaaatgcagaattttattttgtcttcctaacaccttatcctgtagaatatggacttttattcctgctagtcaaaaattggtttgggagaacccaacacattaacaccccctcccatttccctgtttatccattaatttgtccagtatgaattctagaattccctattaagtcattaaacaggtgaaggccagacataaaacctaattttgatactgttacaaatctctttccagatatgtaatgatcaattaataaacactttagacatgattttcaatattattaaacactgttgtgtgaaataatctacctttttcatttcgtcaaaaatatagatatatcatgaagaggcttttcccaatgttttaatgaaatagaaacaccctttctacaccttcctgtttaagagctcaaaaaatatatatttatagtttggcatgacttgttcgtgaagaattcatgctgactgctagtaattactgccctttatttacaaattaggtttttagttttcctacagattggcacctagatgtccagtctaattaaagagatcatctttttacctatgttgaaaataagaatatttgctcttctctatgtattagttcatggtgctataacaaatatatcatagactgggtggcttaaacgacaaacatttacttctcacagttctggaggctgggaagtcctagttcaaggtactggcccatctggtgtctggtgagggccagctttctggtctgcagatggctgccttctctctgtatcttcgcatggcagatagcagaacacatcatgtctcttcttataaggacactaatcctattgatgaggactatacactcatggcctaattagctcccaaaggctccaccattctaatatcatcaccctgggagttaggatttcaacacatggatttgcagtggcaggtggggaagatacaaacattcactccagagcactctgctttctggcaggtctaccatttctcagggattcccaagaaagtttctgttatcacatctaaagatcattttagggttcagggatatactccttttggatgtatgtacttcaactaatttaaagagactaggctatcttctttactttcatcatctagagtttcaattattgtttaattaattaaacattttattaggtaatacaaggtttaataatgtatatagtgaaaccaagtctctctctctctcatccctgtcttcctaccacctaatttccctcccagaggcaactactttgggcacttactcttatagttccagagatatcatacataataccagaacatatggatttatatatttaatacgaattataacatttttgtttttctactcaattcaattcccttaatctttgttccacccttgccaatttgacatcatagtttagatgtatcataagtcatctattaatcccttatcatgtgactaatgtagaggatctattccttcctgtttttgtttttcttaccttcagcatgtcctgccagacctagcaaatgagaagtgctttagccttcccaactttacttttcctagtttctgccattctcttttatttgccttcagtcaggtgtccctgtattaagctattcttgtattgctataagaaatacctgagattgggtaatttataaagaaaagatatttaattggctcatggttctgcaggctatacagaaagcatggtgctggcatctgctcagcttctagggaggcctcagggagcttttactcatggcagaaggcaaggtggggagcaagcatctcacatggtgagaacaggagcaagagagaaagagagagaggtgccacacacttttaaacagccagatctctcaagaactcactcactatcatgaggacaacaccaagaggctggtgctaagccatcatgagaaatccgcccccaaagtccaatcactccacaccagaccccacctccaacactgggaatcacaattctacatgaaacttgggtggggacaaatatccaaactacatatgtccctcttctcatctttaattcatattctttcaaatttgtacccctacacagatacattggagtttggggttgtttatgttgttgttcaacaactatttatggaggacttaaacacatcagccacaatcttaggttccagtgaaagaaaatgtagtaaagcccaggccctaccaactatgcatcttctttcttcatgtttaatttatcacattccttttatgtcatatatagtcccttggaatcatatttcgtgttaatctgaaattgttgaaatttacttctcttaaagtctaggaggcatgtctaacattatcttatttgggattatcacccaaataaatggccactttctctataaccctgggcaaaagcttccccaccccctatcctcatgctttggaagtgtccatggggccaagatgatgcacccacccagagcccacatctattctatcctatcctacccagggtagccagtgtctcaactccctgctcaacgagtgcaaacccacttccagtgcctatgttggcctcttcgtggaatccatccttccaagactgaaccattcaatgtgcccaaccctatacctgagaggtagccaaaaggcagctgtttgccaatgagtgcagattgagtttgggtgtacaggctgggctgtcaacttgcaggcactcaaggcccctcaagtgcaagacagccagaagtgggaagagaagagaacaggccatgtgtcagggacacagaggtgagctccacctccaccacctccttctaaaaggaacccaaggattctaaaaccaatcttgccttctgggttatttgaaggtatatttctcaaagtagaaagattggcgagtagagcctactttagcagcctattacatagaattgtaacttatacacataggcatatggtgtgcaggcctccgtctgtaccctcacacttcccaatacaaacgttaaagataggcctgcccagactttctagcactccatatcaccaagtggtcagatttgcttctttcattgtttcctcaatatgccaagatatataattgccaaagagttaaggtgaaaagtcatgttattccacttttttttttttttggaggcagggtcactctgttgcccaagctggagtgccagtggcgtgatcacagctcaccactgcaacctccacctcccaggcccaagcaatcctcccactcagcctctcaagtagctgggaccacaggcgcgcaccaccacacctggctgttattccacttctaagagaaggtttcttaaaatttttagaatgtgtcatctgttactgtaatagttttttaaatctggaccagtaaagttactgaagtattaagctgtgtgacaatatctcttctcttacttctctttcctccatccaaatgctctctgttattattctttccttaagcttctgatttccatgcaagagtgtgcattcactatatgtgtatttctctacctcttttattaaaattattttgtgaacattcaaaattccattcatgagtaaataattaaaggttaaatagtcgaaaacacagaaataaaaaacattcatgatttattagtatatctgtgattatatttaatttgtgttctcccaggtaactattcttatttattatcgaccttctcccatgttttctcctgataagtactatacatcatctctattaacatggttctttctatgccctgattattgtcataacactaacacatacacacaggtgtgcacattcatatatgtttgatggttttatctggaaataagtgtctcttcctcaagtttaaactattctgatcatgtcaacaagtcttccaccaaaagtatctttgggcttcatggattcacagtggatctcatttagtgaaactctatttagttaaatataaaagagaaatatttgtattaatagtaggtgccaatccccaccatcatcacaaatgttaacctttgcctaatacctgtctcccaaaatatcagaagaaaggatcagcaactagtgaaagactgtcaagtactgaaataatgttataaaagagtattttaaaaattttcattaagaatttatcttgaggtcgcgtgcggtggctcatgcctgtaatcccagcactttgggaggcagaggccagccttccactacaatctcctgaggtcaggagttcaggaccagcctggccaacatggtgaaaccccatctctactaaaaatacaaaaattagacaggcatggtggcatgtgcctgtaatcccagctactcaggaggctgagacaggagaattgctggaacctaggaggcagaggctgcagtgagccaagattagaagatcgtgaaacagagcgagactccgtctcaaaaaaaaaaaaaaaaaaaatttatcttgaatgcataactgaactttataagcctcgctctcccccatcaccatgcctcagaaaaattagtataatatagtcaggaataatgtgaaggattgaaaccagatgttaactgaaaaaaaaaatctaaatcatcacaagaagatttaagtaaaggaaaaggaggcaagggaagtttgccatacaatattatcatagctgattttatacaattgagtcttggctagagtgaaataaaatggaaagaagacaactgtaatataaaacttccactacaatttctatacacactggttttccaagccccacctccatgtttccagtgcaataatttgctggtatgtttggcctaccaagaaagaaatacatacaccttctactctcttggtaaacaaaaggatctgaggtttgtcagatcaataaaatcaagaaactgcctgatatcgtaagtgatgaaggaatagttgggtctcattcttttcaaatgctcttcctggactttacaaatatttttgatgtgtttacatagagggcaataatctatataaactctcccacctagctttttggtaggctataagagcaaaatgatgtgagatcagacgtatccctagactatagggcatcattcatttattcattctttcaacttatatttactgactatctactctgtgccaatcacgaggagagtgtgaccataaacaataaagataataaatagtaaatgatttcgtatattagaaaataacatatgccattttaaaaaagaaaaagcagaatagagtaggcagggctgggtgatagggaagttcagagcagatttcagtattaaataaggtcaagactagcctcattgagaaggggacatctgagcaagactcgaagaggcaagaaaattagccaagcagacagccgggggaagagcactgcaggcagaagtaacatcacaacagaagcctaaggcagaaaagcagtggcagaacagcaaggaggccagtgtaagcagggcagagtgagctacaaagagcatagtaagagagaaagtcagaaaggtatggaggctgcagatcataagaactattgcagatgtttgagcactaaaacatcaactgttttatttagaggaatcactctggtgaatagaacgaagtacgaagggcaaaagaaaaaatagggacagccattgggagttcccatagtaacctagatgagataaaataatggcttagaactggttggtggtagcagaagtggacacagggttcagattgtagatatagtttgacaattgagacaacaggaattcatgaaagattaaacataggctagagagaactcaagatatctttaagtttttcgatctggagcaactggaaggatagagttgccattaactgaggtgggaatggctgcaagaggagcaggaagaagaagagtccagctggggacatgataaatttgaggtgcatattaacatcaaagtgaagatgtaaagtaggcagttagatatacaagagcagggtttgaaagagaaatctgaaatgaaaatataacttttggagttgtcagcataaaggtagatacaatgagactaccaaggaagcatgtagactagaaagaggtaggttgaagtccactattgcaagtgaatggaaatacaggcagtgatattcagagtatgactgtagaattgagatttgccttcaggtgaattaaaaaaatatgccccttctggacagatggattagaaaactgaccaggcacggtggctcacacctgtaattccagcactttgagaggccaaggcaggtggatcacctgaggtcaggagttcgagaccagcctggccaacatagtgaaatcctgtctctaataaaaatttaaaatattagccgggaattgtggtgggcgcctgtaatcccagctactcgggaggctgaggcaggagaatcacttgaacctgggaggcggaggttgcagtgagctgagatcacgccattgcactccagcctgggcaacaacagtgaaattccatctcaaaaaaaaaaaaaaaaaaaaaagacaagacaagaaaaaaaagaaaactgtgccactctctgagtagacacagccctgcaagtgttagcagaaaggcccacagtttgcccagcagagggagggctagatttcatctccactcagacccttagcagggtaatatgcagcagcccatgtgagacatcctttcgcttcaccctgcaacccccaccgtctgctaaagagttcttaaattctcttacctctcaccactattgggcctcagtgattatcagcatcagctttaaagttggactgcctgggtgagaatccaggctctgttccctgctcgctggtgactttagataaattactgatctttcctgaacatcagtttcctaatccataaaatgagaataataagagtacctacctcaaaaggatcttaaagattacctaagaaaatctatataaaatccattaacttagccaatatctctgacacctggcaggggctcaacaaacattagttgatatcattatccccttttaagtgaaagaacagaatctacttgtctacattcagattaaacctctccctcatctatagacctcataattattattcaagagtgctttcattgattgttttcataacaaaagactttaaaacaaagcttccctccggtggcctcattttattggatttcttgacttcaaaatcaataaggcatatttcctacatgtgcactaattagaaatgcaacatgcctaaagtactgtcttaaaaaaaacaaacaaacacattcctaatgcacaacagcctcctaaaggatcttgagccctttgaaatcaattccagagtggtacataaaaggtatgccccagggttagggctacaactgttagatgcactaagtgtggggaactccaagagtctgtactttttatttccttagcatccaaaatctctgaatttcaacagaacaaaacaatattacattttagaacaaaaggtaaatatcattagcatgttgtaattcaaactttataagcttgagtatttgaagttctctttattaaacctttagatagccatcttattgatgtttttgaaaaatgatcaaattgagcctcccccaaaaatgatgagttttatgaattctttatgaaaagattcaaacaaaattaattaaattaaaaaatgtgtttactctagccagagcaaccaaaattaaacatgtttcctcacacatacaaccaaaatgaaagcagcaaaaaaggtaaaaaaaaaaattactttaaccaatatgaaatatgaaaacaaaggaaaacaacagattctacttatatttaggtcttacaatgtccttctgatcatgaatagctggtcaaatctaatctccctcttaaaaaaagcaaaaagtcataattcaatttctgacttacctgaaaagtaatattgtacatgagaattccacaagatgactttatgaccctgacaacataccatttagttattttataacatgtcagttcatactaaaagctcaccacaatggcacacattttcaaaattgcagctacagagaaagaacagaaatgccccatggtcagttactctatgtagcaatgccttctacttaaggacattttgtaccatataaaaagtatgccaaaatggagacccatcttatataagcccagcatgaaggttacctacatattttttaaaagccatagaactaaattagtcaaattgaagtcaaagaagaagctaatctaatatatgagacaacagaaaagctttcactgaatcaccagaacaagaataaccttcagctacaaggcatcaactttaagcaaccacggcagaagtaatgtgcccttcacatacactttgaaagtgacagaggcttctgttgctgcaagtccagtgagcctatgggtccatcccattccataatattgtaaaacagctcaactgtatatgaattctcgtaaggtctgatatttttaaaaagcagagaacaaaaagagaatggcaaaggtagtagaattctcatcaacctcaatgtgaagccaaaaaattcccatttcttctttgttctctgttcagctagaaataaataaaagcctgcttatcagaataaataaaatgaaaccaaagtccttgaaaaacactatattcatttttctgtaaatcaataaatacacttaggaaaacaaatagtatgtaactggggaatttcagcttcttctgtgtctcctagttttccattctgtcataatccttgaagagaattttaaaaagtctctgctagaatctttaaatctaaccatccaagttcattatttatcaatattttcttaaagtttctccaggaacactagctaaatacctattaaccctacttaactgtttcttattacacatgttaaatatcctctctataggaaatagatgacttttctcccctggcttcaaaacaccaccctcctgcttctccccaacaatttagaattcaagaaacaaatggaagcaagcaacaaaacattagtaacattagaagtatcccatacacatggactgagaacacatttggggacatggtgggcagactagcaatttgctgtggaattacacagcaaaaaaagaaaagatggaaaagccacaaacactcatcttcactcatctttcatagcaagagattaatagatactatttgaggttgaatgcaatttctcattcatggaaaaatatgtaaacttaaccatgtaaaaagcctcccaacctcattcataataagagaaatgcgaattaagtccgggcgcagtggctcatgactgtaatcccaacactttgggaggccgaggcggtggatcatgaggtcaggagatcgagaccatcctggctaacacagtgaaaccccatctctactaaaaatacaaaatattagccaggcatggtggtgggtgcctgtagtcccagctattcgagaggctgagacaggagaatggcttgaacccgggaggcagagcttgcagtgagccaagatcgcgccactgcactccagcctgggcgacagagcaagactccgtctcaaaaaaaaaaaaaaagagaaatgcaaattaaaatacattgagatattctttctcacctttcagattggcaaataccaaaatttttataacaaactgttagtaaggctgcagagaaacaaatactcttataccttgcttgtggatatttaaaacattatccctatggagggcaaatatgcaatacatgtatatgtatatgtatgtatttaaactttgacccagcaattcagtttttaggactctaccacaaatataaaaataaaaagtgatgtattcccaaggcaattaattgcagcaattttactaaaacaaaaaaaaaagagagagagagaaaaggaaggaagaaagagaaaaaggagggagggagggagggaagaaagaaggaaggaaggaagggaagaaagtcaggaagttaggcagggaggaagggaggcagggagggaatgttggccctttcttcacatcacatacaaaaacttacttgaaatggatcacagagctaaaggtaggacctaaagctattaaacttctagaagaaaacataggaaaaaaatcattgtaaccttggcaaagtcttcttagatgcaacaccaaaagcatgatccataaacgaaaaagttgataaactggacttcatgaaaattcaaacttcgtgaaaatacaaaccatagacggggacaaagtattttgaaaatctacatatgacaaaggtcttgtatccaggaaataaaaagaacccttagaactcaataattaaatgaaaaacaactcaactctttaaatgggcaaaaaaaaaattgaaaagacatcttaccaaagaaaatatatacatggcaaataagcacatgaaaaatgttcaacatcattagtcactagagaaatgcaaattaaagccaaaatatgtactcctccacacatgctagaatggctaaaatttgaaagattataaatactggagctagcaaagatgagaaacaactggaaatctcacacattgctagcaaaaacgtaaactggtacagccactttagagaaaagcttggaagtgtcttataaagttaaacatatacccactctatagctcagcaattccactccttaggtatttagccaagagaaataaacacttatgtccatatagatacctgtatgcaaacattcatggtggccttactcataagacagtcatccccccaatccttgggggatatgttccaagacccccagtggatacttgaaacctgggatagtaccaaaccctatatatactatgctttttcctattcaacacacatataataaagtttataaattaggcacagtaagagattaacaacaataacataataaaatagaatgattttagcaatatattgcaataaaagttatgtgaatgtgctcactcattctctctcgcaaaatatcttattttgtgtcatatttttgaaccatgggtagctgaaactgctaaaagtgaaaccatggataagaggggactactgtagtcagaaactagaaacaactcaaattttcatctacaagtgaatggataaacaatctgtggcacaagaataccatcacatgttatgcaagaagaaagaatgaaccaagtatacatgcaatgacatgaacgaatatcaaaagcgttttgctgagtgagaatcagacataaataagtacacactatatgattccatttatataacatttttgaaaggacaaaaatacagggacaaaaaacagattggtagttgccagatgccaacagttgatgtaatcagttgactgcagaagggcacaaagaaactttttagcatgttggggatattctatttgattgtggcggtgatggttctataactgtatatggttgtcagaactcatcaaactgtaaactttaaaggagtgaatttaatatggtatatataagttatttctcggtaaatttgacttttaaaaacatcttttgtgttcatctcttatcccagtggcacagaaatatttctacattatttcattcactatataattacaagtttccactgatatcctttggctccaggagctcttccttaagttctctgaattaatactttcaaaagttgattcactttttcgaagtgtcttggcccttcttgtacatctgtcaatttacagtatttggtgcctaaaccctacctaacttcttaatagtattcattcccaggcttcacacctgtgtgttcaggttattctcaatatcatcctgtgcatctgatcagttatgtgttatatatttgatttataatttttctggcaagaactctaagtcaacctatctatgtgtttacaaaactacaaaaacaagagctttcagtatttgtttttgtactgctttaaaaaaaaatttctttttatttttctttgtgtgtgtgtgtgtgtgttaaagctagctgaggttttattttggaccaaaaaaaaaagcaattgaattgttttgtagctggaggcatgggcaagtgcggtccccagtcagtaaactctcccgtgggtgggctgaggggctagggctgagcctcaggtgggtctcctcttccctgtgctcctctgcacaacggcctccctcccaggatctggggcagccgcaggaggggcaggctgggaggggctgccgcagctgttgacttgggcaggacgtcagaggactcggacaccagcttcccatcgcgggtctcggtcttcttcacaaccacagccctggtgaatcatttcttattgaccttacttttaacaacgaataaaaaagagccaaatgactgtccctggctcatcatgttaatatcagaagacaacactgaaaatccttcgcaaattttaactactaccctcttgtcttttttcaattctgctctctgacagcagcgagtttctaagctagttcacttagacaagcccagtttagtgagtacaaggcccagagtccagaatcttcaacatagtaggtgtcctgcgagtatgtgaagatgaaagtacattataaagtcctgtctctggtttccttctttctacccaacaactttttttacaagttagatcaatccagttaattttgaccttactgaagttgaaattcaagttaaatttactgctagattaaaagtgtgaaaagaaggaaagtagctaatcccatttacaacaatttattttttaaaattgtaggactagtattcatacatttatacaaaattgctaaatatattttattttaaacattgtcttgatcatgtctgttctattatgtagatattttatcttatttagatcactctggtgtttccaaaaaactaagcttctttaatctctcttctgaactaaccaaatttttttctgaacatttggggccacatttactttcacataagttagtgtgtgggttaaaagggcagcatttcttcactatttttcaccaaaacacgagtgacatttaaagcatatttaatatttataatctaatatactctcctcattccagactgccaccaaggtaagagaaggcaactggtttgtatgaaactccaccataagatttctgaaaccctatattttctctctcatctatccataatacaccagagttatcattgagaattgctgcatttattttattgttttttttcttactcctggctctgttttatatcccacacttgttttctttcttctttcactccacatttaatttatcctatcttgaatttcatgtagccttataagtcaccttaaatcctttctagaacaagacaaggaataaataaagagtcattctaggtatctgaaaaagcaatcttttctcatttaccttagataaagccttacaactttaacttcttgctgcctcttagctatgctctaccgtattgaatacacaagtatcaaaaatcatgagtttctccttttttgctttaccaattctctgtttaaaaatatttaagtctgcgcacaaaaactacagggaaaaatccatgcacaatttaagtttaaaagcccataacttttaattaaaagcaattaaattatttgcacaaataacctactcgctgtacaatttttgtgtctaaagtatgtaaagtttctagtgccttgcatacagttactcaatcattatagtaatagctcagttacagagtaggagtttttaaatgagctgatgtaagactactatagcttgggtattggcacatgagaatctgttttagtgctatttttaaaaccactaataaacagcagactcgagcctctgctcaattgaatctgcctgagttgtgaaagaaaaaatgtgtaagagaaccacatttttatctaaatctgaaatgcctgctaatatactcggaaaagtagacatttaaaattggagctttcataaaatagtctagagtttagtgttactaaaacgaaaattagttataaaagtaaaaattgcacaacataatagtttctattcatcccattttatagaaataatgtcctttcatttcccccaaagttatctaaccgagcaacagataatctataattactaggatttgccttatagcaaagtttgatttttaaaagtttgacactccactcacctactgcaggacagagtattgcccatatacagatactaaaccaattgtctaagcaatttcttgtatttagaaattcagtgccactatcatggctcacaatttggcttatgatgcatct

SEQ ID NO: 1449 - DNA, 12556 bp, Homo sapiens
caggagcgcggtggagcctggagtggagggcgagggtcccaccgtgacccgcctggagggcagcccagctctgggacgcgaaaccgcctacgacggtgccgcaggtggagggaagggtagaggggagaccagtatgggggagagcaaggtggccccacaggttgggagaggatgtggggaagtccccctacccacccaaggccgaacatcgcctaactggctgtgggacgcccggggcaggggctgggggcggatggcctggttagggcccagcttggggtcttgaaaatatccctatggctttggggccacagaagggcggagtcctggcattcaggggaaagggccgaggacggttgtcaacgggaaggaacctctgaccctaccctgggtcaatgtgcagtccaagttgccacaaatgaccggaggaaacagtgggaagggaaggtctctttcccattccaaaccaggatgcccttcaggtcgcccacttccttcatccccagagcagctgccgactttcctgttaagtgccagggcctgggaggtgcggggctgcagctcaggcgctgaagggggcctagggtccaggaacctcctgccaagccagtggtcctcagacgctggtccaggcaccaccacggggtacacagcttttcttacctcctggtgttatgggtcctttctgttttttgagacggagtctcgctgtggctgtgtcgcccaggctggagtgcagtggcacgatctcgcctcactgcaagctccgcctcccgggttcacgccattctcctgcctcagcctcctgagtagctgggactacaggcgcccccaccacgcctggctaatttttttttttttttttttttttgtatttttagtagagacggggtttcaccgtgttagctaggatggtctcgatctcctgatctcgtgatccacctgcctcggcctcccaaagtgctgggattacaggcgtgagccaccgcacccggcccatgggtcctttaaaaaataataatttggccagacgtggggcctcatgcctgtaatttcagcactttgggaggtaaaggtgggaggatcacttgagcccaggggttgcctgggcaacatagcaagaccccatctcaaaaaaaaaattagccaggtgtaatggcatacacctgtagtcccagctactcgggaggctgaggcaggaggatcgcttgtgcccaggaggcatgaatgcaccactgcactccagcctgggtgacacaagaccctgtctcaaaaaagaacaacaacaaaaatttgaataaaaaccaaaccagtgacagtagataagttgctttgtttttaatgctcttggcaaaataaaaagttggcagtcgtatattcccccattctctctctctttctcacacatgcacatgcctataagaaagcattctctggatccacagaattccagatttgggaatcactgaattgaactgccggccattggtggctggtgagactgtcctggcagtgatgcagtattctggtccctgtgccagcactgatgggctgtggaatcctccaccagtcattccctctctccagctctccatctctgcttctgtacaaaaggatctaccaatcccctcttatattcaaatatctatgacctttcagtctggcctatatccgtgcggatctgaagttgtgtatccgaagatgtaaccttgtccagtgctggcactaagggctgcttcagggagggacctggactggtgcccagggaaaggaggacaaggtcctcatcactggagagtggagggggcagtgggaatgggacagataaggggtagtgccctggggtatacctggccccaaagtaaccccgggctgtgaagacaaaagcactgcatcacatgatgtgtttctgtgtctctctccctagcagttccaagagcctctgagttcctgccttttttcatctctgaatccccaccattggcctacattgggagtggggcgacctgtaagtgcacagtgaatttttgctgagggagtggctgggagggctgcgtggagtggacagcaccaagctgcacttttcaggggagtggggtttggaaaatctggggagcagaacaggcacccccgcccccaggaaggaacccaggtgtattagtctgttctcatgctgctaataaagacatacccaagactgggtaacttataaaggaaataggtttaattgactcgcaccacatggctgcagaggcctcacaatcatggctgaaggcgaatgaagagcagagtcacatctttcatggtggctggcaggagagagcttgagcaggggaacttccacttataaaaccatcagatcttgtgagacttattcactaccacgagaaccgtatgggggaaactgcccccgtgattcaattatctccacctggccctgctcttgacacatggggattattacaatgcaaggtgagatttgggtggggacacagccaaaccaaatcaccaggtacagaggccagaggagcctggggatgacggtgatgttccaggtgtggagggagacgtggcaggcgtggggacaggaaggttggaaggttggggaactttatgaagggaaaactgagaagatgaggaaggctgatgagatggaagtggggttggggagagggaagaaccagcatgagctcaaggctagggtttgggtgaaggagagaaaaaaaggtagaaaataaaggagacagagatcacttctagtcacatacaggtggagatggggtagacaggaagaggtgccccctatcaaatgagaatgcccagtgtactcccatctatacagaggacaggatcaagatgcagccatgactccttcccattgagttctaatactagaaggatgcctcaatgccctctggtccaacagacttcatcattttagatagaaggaagtggaagccctgaggttggggtgacttgtatgacctggagagtggatgggagatggaaaggggacatttaaagagagggaagggctgggtgtggtggttcaagcctgtaatcccaactctttgggaggccaaggcaggaagatcacttaagctcaggagtttaagacaccctgggcaacatagttagacccctgtctctacaaaaaattaaaaaattagctgggcgtggtggcacgcacctgtagtcccagctactcaggaggctgaggtgggaggatcacttgtgcccaggaggtttagcctgggtgacagagtgagaccctgtatctaaaaacaaaatataataaggaaagaagggaataattcaatttttcaagtgggaagaagagaaactagagaatgtcagaaaggaagagaaagtacaaacattttcaagtcactctgacagcatcgaagatgaacatgtgtttacctgtttataaccagggtacttgggtgtggggggtacaggaagggagccacacctctgccctctgccattaggcttgttcagccatagccattggtagctctcagagacgcccccttccctggctgcagcaagtgtctgcatgggcaaagacgcccccttccctggctgcagtgagggtctgcatggggattgggtagaggccccagtgtctgcactgggcaaggtttgcacagggtgtgggagcaggggaggaaagcatgctcacttcgagggccttgtgctctctactgcccaggcacagcttgaaaaccgtgatgctgccaagcccagcctggcacaggcaagggtccccaggtctggctttgggtaggacttggaaagaaagactgtcatcttggggtgcacctcccttgtcacatcttcctttcacctgatgccccctttctgcactgccaggtagcgagggtcatcacagtgccacctggaggcctctggccaggcccaccctccctgcagctccaatcaccgtccctgcttccttccttcccattgctggataactctcattcctcagagctgccaggctcagcacagacagaggggaaagcagattcgttgaaacaatttgtcctgaagttgggtgtggcctccagccccttctcccacagggatatctgaattttagaagtctgccctccatccctgccctcccaactttaaccaagcacctgagtgctcagcactgtgttggacactttggtatgcgttatttcatttggtcctctcagtggcaggtgttgtattcttatcattgggcaggtgttataatatatccttccttatccttaggcaggtgttatatccttccttttccagatggggaaagcaaggtcctgagactctgagcaacttccccaagatcacacagctaggaagtgatgaagctgagacaagaccagccagcacttacccaccacggtgtaactactcattcaaaagatgacatcttttgaaaatttttattctttcagagacaaggtcttgctttgttgcccaggctggagtacggcggcatgatcatagctcactgcagtctctaactcctgggctcaagagttcctcctgcctcatcctcccaagtagctgggaactacagacaggcacatgcccccagcctggctaatttttaacaatttcttgtggagactggtctgactgtgttgcctaggctggtctcaaaactcctgagttcatgcgatcctcccaccacagccttccaaaatgctgggattataggcatgagccaccagtgactggccacaaaaggagacatcttagtgacagatggtgatgaaagagaagatgggtttgggggaggaactccacgtgatagggatccttcactgagggcccaggctgcaggaggctctatgaaacaccagaactctttgtaaaacttcctgtttgtacatgacctgctcatttctcagcaggggctcctcctgtgcacatggacctctccccacctaaacccacagttcctgtggtcagaaggccagtcactgaataagggcacctaaggctctggtctgaatatctccccttggttctcagtctgaaatcccaaaaggaagacagttgactgcaaaataggctggagttgtcctgatggccagtagaggtggctgttgatagaattgaaagcttagggccaggcatggtggctcacacctgcagtcccagcaccttgggaggctgaggcgggtggatcacctgaggtcaggagttcgagaccagcctggccaacatggtgaaacgctgtctctactaaaaatacaaaaattagctgggcgtggtggcgggcgcctgtaatctcagctactcaggaggctgaggcaggagtattgctggaacctgggaggcagaggttgcagtgagctgagatggtgccattgcactccagcctgggctgacaacagcgagactccatcttaaaaaaaaaaaaaaagaattgaaagcttagaactttagtttttttcttttttttaaattatttaatttttttttttgtttttttttgagacaaggtcttgctctgtcacccaggctggagggcagtggtgtgatcatggttcactgcagccttgaccttcctgggcttaggcgatcctctcacctcaggcttctgagtagctgggactacaggtgtgcaacaccatgcctggctaatttttggtagagacggggtttcgccatgttgcccaggctggtcttgaacttctggactcaagcgatccgcctgtctcagcctcctaaagtagtgggattgcaggtgtgaaccaccgcacccagctgaaagttgagaactttaaagctgaggaggccttgtgaatggcccagttcaacctcctcagtttaccagaggaagagggctcagagagggaacctgacatgcccaagatcacccagtgatttagcgacagaaagcattttatgcattttttttttggtctgctgcagaggtgtataggctgtaaagttaagcaaagaaatcatcatttactgagtttcacatatgcgccacacacagcactgacatttccccagccactgtctccttccctctgtgctgcaggagaatttgggtcggtgtcccacctccacgatcacttttctcttacacaggtgatgctgacgttagaggacaaggacatgaagggattctcctgggccatagtcccagccttaacctccctaggctacctgattatactggtggtctccatctttcccttctgggtgcgactgacaaacgaggagtcccacgaagtctttttcagtggcctatttgagaactgcttcaatgccaaatgctggaagcctcgacccttatccagtaaggagggatggaggcggggaggagagagagggagatggggccagtgttgggacagaggtggggggtgaaagaacagggtgggagcagagaggacaaaatctaattagctcagggctggatgcggtggcttgcacttgtaatcccagcactctgggaggccgaagcgagaggattgcttgaggccaggagttcaagaccagcctgggcaacatagccaaaccctgttgctacaaaaatgagaaaattagctgagcatggtggcatgtgcctgtagtcccagctactcaaaaggctgaggttggagggctcctgcttgagcccagaagttcgaggctgcagtgagctgtgatcatgccactgcattccagcctgggagtgagagtgaggccctgtctcaaaacaacaacaacaacaacaacaacaacaacaacaacaaaacacaaaaaattaaccaggcttggttaacccaagggtagactctgggatatctggggcttcaacagcaactttgactccttatcccactgccagctgcccacctctgccagctcaggagggtatgcaaactcattttcacatgggtctgcatcatgccagcagtcagagaacaaatcaccctgttatcagactctggctctgctaattttggtctatttcactacttctgttattgttgttgcttttacagatggggactcactctgttgcccaggctgaagtgcagtggcgtgatcatggctcactgcagcctccaactcctgagttcaagcgatcctcccgcctcagccttctgagtagttgggactacctgtgctcaccatagctcccagctaattttttaattttatgttttgtaaaaaacaggatctcgctttgtcacccaggctggtgtgatcacagctcactgcagcctccaactcttgagttcaagcgatcctcccaccttagcctcctgagtagttgggactacaggtgcgcaccacagctcccagctaattttttaattttaggttttgtaaaaacaggatctcgctctgttgcccaggctggtgtgatcatagctcactgcagcctccatctcctcagctcaagtgatcctcctgcctcagcctcccaagtagcggggactacaggtgtgccccaccgtgcccaactttttaaaatttcttgtagagatggggtcttactatgtggcccaggctggtctccaactcctggcctcaggcaatcctcccacgtcagcctcccaaagtgttgagattacaggcgtgaaccattgcacccagtctcactcctattaactaggaaaattaaataaagatgtggggattccctcagcgttcagaacattttgacctcacaaagttttgattttccacaggcgaattacttcagggtaaccaatacaggtgtgattcttcacatttgcatgtgcaacaaattttatcacaagagtttgattttgtgttgctttttaaaaccaccattttcccctagtggatgatacatggtttggtacaaccaaattcccataataacatttgttaaggccaggcacggtggctcacgcctgtcatcccagcgcgttgagaggccaaaatgggaggatcgctggagcccaggaggttgaggctgcagtgagctatgatggtgccactgcactctagcttgggcgacagagcaagaccctgtttctacaaaacataaaaataaaaaaattagccaggtgtggtggtacatgcctgtggtcccagctactctggaggctgaggcaggaggattgcttgagcctgtgaagtcgaagttacagtgagctgagattgcaccaccacactccagctggggcgatagagggagaccctgtttcaaaaaaagaaaaaatatgtttattaagaactggtgatttcagtgtctgacattgtcaatttaattttttttcctatatttctatgccattgggaatcaaattgtggggccaaagcattcttggggccaaagtggcatggtcacaaccttggtcccaaggccatgctttgggatctaagggtggtggaggctccgggggccagccctgcccaggctctgagggactctgacctttccgggtcagggttcccagcttcagccccacttctccctcccctgcagtttacatcatcctcggccgggttttcctgctctctgcagttttcttggctttcgtcaccaccttcatcatgatgccctttgcatccgagttcttcccgaggacctggaagcaaaactttgtgttagcctgcatcagcttcttcacaggtgtggaacagctaggtgatccctgaccttcgctagggcctggggaggagtccagagaaagaggggtgctcagtctctgtgatgtcaaaagaggcataatttttctttttagggacagggtctcactctgttacccaggctggagtgcagtggtgctatcatagctcactgcagccttaacctcccaggctaaagtgatcctcccacctcagcctcccaagtagatgggactctaggcatgtgccaccattcctggctaatttaaacatttttttttttggtagagatggggatctcgctatgttgcccaggctggccttgaactcctggtgtcaagcggtcctcctgcctcagcctcccaattgctgagattacaggcatgaaccactgcacctggccccttttgacatttataaagggtgacccaggctccaccctgagaggctcctaggcaaatggtggaggtagagcagtaggaaaatgggattgcatttaatccaaagtgttgcaccctctgctaaggtgcagaggtgagctaagggcagatgcagagggtgctaggaaagggagttctgatgatggttccctggaaggtaaagcacatgggctttgaagatgagtcagaaaggagggagggacaggcatctgggtaggagttttgtttcagagagggggcaaggatgaaggagcctccaggcaggagccacagggggtgaagtttggagggaaggcgggtagcatgggaggagaccgagggtgtctccctgtgaccctccaggggcctgtgccttcctggctttggtgctgcatgccctggagatcaaggctctgaggatgaagctcggccccctgcagttctccgtgctgtggccttactacgtgctgggcttcggcatctttctgttcatagtggctggtgagtgtccagggaacagtgccctgcttcttgtcctcggtctggatttaggaacctgtcttgtggaggccctccctttggattctctagaattgcactgttccaaaccgcagctgccagttagacgtggctatttaactttcgttaattaaaatagttattggccagatgtggtggttcacacctgtaattccagtgcttcgggaggccgagatgggtggatcacttgaggccaggagtttgagaccagcctggccaacatggtgaaaccccatctctactaaaaatacaaaaattagctgggcgtgatggcacatgtctgcaatcccagctactcgggaggttgaggcaggagaatcgcttgaacccaggaggcagaggttgcagtgagccgagatcacatcactgcactccagcctgggtgacagagcaaaactccatctctaaaataaaataaaaagttatgaattcagttcctcagccatactagccacatcaccgatgttcaataaccacatatgtccagtggctattggacactgtcatattggacagtgcagacagagaaatttccttctctgcagaacgttctacctgacagcactgctctggagcttcaaccccatccttggccttcctgttcttatccttcttgacttagaactaaactctttcaaatttttatagtctcccttccaccatcctggttccttaggctatctatttctgtctctaccttttttttttttttttttaagagatagggtcttgctttgttgcccaggttggagtgcagtggtacaactgcagcctccaactctggggctcaagcgatcctcctgcctcagcctcttgaatcactggaactacaggcatgtgccaccatggccagctagttaaaaaaaaatatatatatatatatatacacacacacacacacacacacacacacacatatttatatatgcacatatatatgtatgtgtgtatatatgtatatagacatacatatatgtgtgtgtgtgcacgtatatatatatatatatatacacacacacatatatgtgtatatatggccaggtgcactggctcacacctgtcatctcagcacttcgggaggccaaggcaggtggaccacctgaggttaggagttcaagaccagcctggccaacatggcgaaaacccatctctactaaaaatacaaaaattagctgggtatggtggtgcgtgcctgtaatcccagctactcagtaggctgaagcaggataatcacttgaacccaggaggtggaggttgcggtgagctgagatctcaccactgcactccagcctgggcaacagcgggactccatctcaaaaaaacaaacaaacaaaaaaccacatatttaagcttttatttcttaatttccccttcaccaaatagagttacaatattttatattttaaccttttaattccatttttccatgatttccatgaattctttgaagttctctcacattttatttaaaatttttgtggcttttagtggtagagtagtctgctataatgctgaaaatagaagatgtcttttatcttagtcttcatcttaacacagcattgatcatttactcaagatatctccatttgttgtctctttttgttcccgagatggagtcttgctctgtcacccaggctggagtgcagtggcatgatctcggctcactgcaacctccgtctcctgggttcaagcaattctgcctcagcctcccaagtagctgggactacaggcatgcaccaccatgcctggctaatttttatatttttagtagagatggggtttcaccatgttggccaggctggtctcgaactcctgaccttgtgatccacccacctcggcctcccaaagtgctgggattacaggtgtgagccaccgcgcccggccacttgttcttttttttaaagggacaaggtcttgctctgtcgcccaggctggagggcagtggtgtgatcatagctcactgcacccttgacctcctgggctcaagtgatcttcctgcctcaccctcccaagtcagtggggcttcaggctcatgccatcatgcctggctaattttaatttttttttggtaaacacgaggtcttgctatgtcgcccatgatgagtctcgaactcctgggctcaaaagaccctcctgtctcggcttcccaaagcactggaattacaggcgtgaactaccacgtccatccctcgtttgttcttattcgtgtcagttgtctatcttttacttcactgaaggtcttgggttgggcctgggttttgtgttggaacttcctttctctaaaccttagttttttttttcacccattaatgggctacatgattgctgagatgtcttctaggtgctgaccatgggtctgtgattttatacatgtatttgtacttcttgtcctttgacgcatcctgtctgtaatctctctctgtaatactctagattggggggcagaatgagggagggcagctctggagctagagggacctgacctctagggcgtggagctctggactttctctgacctgacccaaacgttggctgttccctaggtaccatctgcctcattcaagaaatggtttgcccttgctggcacttgttgtccacttcccagagtatggaggaggaccacgggagcctgtacctggacaatctggagagtttgggaggagaaccgagctcagtacaaaaggagacacaggtgacagcagaaacagtcatctagcccaggacatggcttctttacccttcttcaagccatgtgagtgtacacatgtagctgtttgtagtcctccccaccctctctgccagtatctgtgcctttgaggagcttcttgcgtgtcagatcaactctccacctccccatactcacagtgattctatcttgcttgtatgtgaaatttgctaaaagtcctttcaactcttctgagcttcctaagtgacgtttttgcaggtattttcaataaaaagaagggctactttgttcatccata

SEQ ID NO: 1450 - DNA, 12556 bp, Homo sapiens; identical to SEQ ID NO: 1449

SEQ ID NO: 1451 - DNA, 12556 bp, Homo sapiens; identical to SEQ ID NO: 1449

SEQ ID NO: 1452 - DNA, 22220 bp, Homo sapiens
aggtagcccagccccgcgttcggctgctctcgaggaggccggagcccccggagacgatgcgccccgcgcagccgcctgcgcctgcgggagccgtgagtatttcccgcgtgggggcgtccccggggcacagccggggcccttctccaggtgggcgagctcgagcgaggttgggtggtaggaggtcagcgtccgcggcccgcagctcagggctcacgaggaagctgtggcttgctgcgtccaagcgccgccgcttttgtgctgggcgtgggggctgcagctctgggtggaggtggaaatacctccctccaggagcacttagagctgagaaaggtggtgcgacgtagtggaaaccacgagggcttcagattcagacgtgggtttgagtcctggctctgcagggagcatgtgagcagacagttaaggtttctgagcctcagttttctcatctgcaaaatgggaacagagatgctccctccctgggctgggcgactggatatgatgagaccgctctgtgcacactcagcatgctgagcactgggctctcctttcctgtcccacaacgtggattgagaaccactatctcatagatgaagacactaagactggttaacagcaacacctatcacagatgccgtccacgtgccaggcctgtccaaggccctggggatacagctgtgaaaatgtgcaaagccccttctcccacagaacgtttgtccttgggagattcactggggctctgtgacttggatcttagcctagacttagatccatggcttatcagagggagactaacaggagggcgacgaagactcggacgctcttccgtagccctcgtggcccctgcatgtgggccggcttctgaaggggtcagcgtacttccccacgtacccaggagctagacggaaagaagtaaggagccactggtgtggctttgtgctgcctctgagagaaggtggacacgtgccagttggtggctgcgactggaggaggccggatcgggggtcctaggaatggagcctctccggacagggctggtcggggctgctgtgcttccctaggggctgaggggaccccaccggaggcttcttcatgatgggcacagcccgttaggagtctgggtgctagaaacattcagcgtctgtggccctccatgctttcctgtgtgctcctcacctgccggctgtgacacacagactgttctgtggatgctgagggtttgctgggctttacatttacaatacgtatttattctcctcacacacctcttaggtttgtgtgtgtgtgcccgagagtccctaaaggagattatagaatcatgggcccaggaaaaaaccttaactcctgcctttaggttaaaaaaacaaaacaaaacaaaacaaaacaaaacaaactcagcttcacaaagaaggcactttttaaaaatatatatatttatttatttatttttagagacaggctcttgctctgttgcccagactggagttctgtggcacgatcacagatcactgcagcctcaaactcttgggctcaaataatgctcctgcttcagtcacctgaggagctaggacaacaggtgcacaccaccatgccagctaatttttaaaatttttttgtagacacaggatcttgctgtgttgcccaggctggtctcaaactcctgggctcaagcaatcctcctgccttggcctcccaaagtgctgggagtgtgggcgtgagtcaccgcccccagctttcatgtaatgagtgccctcatgggaacttcatgaaaacacattctcttatagtttttaaattcatcatccaagagttcctgctctttgatgatgagacatacctggtagactccaaaacagagagcagacgcctagtatctttgttctggggtgtgcattaagagtacattgacctgtctgtctccagtcttgactcttttggaagagagatgctagtactgatgacaacctgcattctggctgcggtgtgcgtccacactgcacagtgtgcaccagactctcgtatggacaatgactgtccctcacatcaggcgcagatccattttagagcctcagaagtcaggagagggtggactttcaaccacgactgaaaacactgtctttcttaggacatgctgtgtgtatgacacacttacagatgtctgtgctcactgatgcttgttgatgtgtcatcgcacatcagtgacaaacatttgtcatgtttttgcctttggtggaacttctttattatactcactttcctcccaaaccatttttctcaacttcatcatgaagcaaatgtcatgtggtcattctgtgatggggctcagggctaggttaggtgatgatttctgaaagctcagagacgtgaaggaaaaaggacatcagtgcttggatcttagctcttataagcctcacgtgcaacaataaacccgagttcaagaatcagattcttagatagattggtttggtagcaaatgacaaaaaaccaacgtaaatatgcttcggcaaaaaagaaaaaaaaaaaggatttattgtttcaaataactgaaaagtgtatgggcaatagtttcaggcatggctgagtccagatgctcaaatggcattgccaggaatccatctgtctcctttcctcagctttgccttcctctctgtgggcctctttaccaggcaagtcccggagctggtggcaaagatggctgcctgcagctccaactatattcctactggtttggcatctgaaacagaaagagcaagtctcctttccatgagttctagcaactgcccgtggattgattctcatgggcttggcttttatgatgagcctgttaggaaaatggagtgctctcacgggcccagccttactcataggccccgccctggaaccaggagctgggatcagacccgaacacacagacttttgaagaaaggaagggggttggttgcacagccgcgtaagggtacttaacactactgaattgtacacctaaaaatggttaagatggtcactttcggccgggcgcggtggctcatccctgtaatcccagcactttgggaggccgaggcgggtggatcaggaggtcaggagtttgagaccagcctggccaaaatggtgaaaccccgtcactactaaaaatacaaaaattagctgggtgtggtggtgagtccctgtaatcccagctactcaggaggctgaggcaggagagtcgcttgaaccttggaggcggaggttgcagtgagccgagatgattgtgccattgcactccagcctgagccacaagagcaaaattctgtctcaaaaaaaaaaaaaaaaagataatcgctttcatgttttgtgtattttactacaattaaacattttctaaagaaaaaaaggaaagaaagggggtgattttctcaaaggggaattgaggggttgttaccagaaggagaaacgaatgtgagtgagtaggcgaaaccaaccaatttccagagcgaacggagtcaggtgctgaccccaagccaatgtgtcttttctcactttaatgcctgagggatttcagagtgaacagagtgaagaaaggaggaagtggaacctcgtcatggtcctcacccacgaggtgggcgcgaggagcaggctggtactggataggctcaatgtggccacaaagcctggtgaggtcacagggactcccctcctccagccccaacccaaaaggttgcctaaggcaggtgctgcgccatgtgcaccaagcaactttctgctgccacctccaagaaagagaaggaccgggaggggatttctcccaggagagagagcacataacgctccgtcttttcacctgtctgttctcaagcaggacctaagtgtctaaggcaaccccacacccacagtgcctggcaggggcccacccatgggtacacatcgtgttctcctaagctcatgtcactccatttcagatgtcaactggacatggactcctgctgatcctccctactgtcattcactcctctcctgctccagccctgatccctgaggtctcttctacccttgcagtgtctcccctctgtggtcctcaggcaccaaggctgagccctttccctcggccctgcagtgtctcccctctgtggtcgtcagacaccaaggctgagccttttcccttggccctgcaggctcagtggggagcagggctttccctgcctggccctggaccacctccttcaacttcagcaagttagcggtctccctgtcaccagccagcctgacaccctgagacctcctcatgggcctcggccgttctcttgttctaggttattgggcccttcctcaggtccttaaactgatgcttccattcagcttctcatctccttccaaatccccagttttcttctaggctctctggctagagaaggttagagccattttgaaggcctctgacagcccccgtcttgctttgtctccacagaaggccatggtcccatgatacactcaggggtgctgttcagaatatcaggcaccgcatggcacagctacttgggaggctgaggcaggagaattgcttgtaccctggaggcggaggttgcagtgagccaaggtcacgccgctgcactctagcctgggtaacagagtgagaccccgtctcaaaaaaaaaaaaaaaagttaaatcacttgatatgcattctgaaatatttaaaggaaagtatatcaatgactgcaatgtactttgaaatgcacgatcaggctgggtgcagtggctcacacctgtaatcccagcactttgggaggccagggcgggagtttgagaccagtctggccaacatggtgaaaccccatctctattaaaaatacaaaaattacccgggtgtgatggtgatctgtagtgatctggtgcctgtgatcccagctacttgggaggctgaggcaggagaatctcttgaaccccggaggcagagatctcagcgagcagagatcgcaccattgcactccagtctggcgacagagtgagactctgtcaaaaaaaaaaaaaaaaaaaaaagaaagaaagaaaggtggcatgggtggtgctgtgtgcctgtagccccagctactcggtagccctaggtgggaggactacttgaggctgggagcttgaggctgtagtgtgctacaatcccatctgtgaataactactgcactccagcctgggcaacatagcaagacctctaaaaaaaaaggagaaagaaagatggacagaaggatagatagatggatagatgtatgttgttggggaaaagttaaatgactaacagtacctagtaactgttcacattccttgtcatgatcataaaaatcaaataataagaaattagaaaacttccataggaaatgtagctacctataatacactgccatatgaattactgggttattgctccactcaacttttagcttgtgatgaggaggtgataccagcactgagcctgcaggatgagtaagagctttgcaggtgaacaagaccagcaaaagagcctttcccacagaggacagagcgtgtgggcatgcgtgatttagtcaagggtcgcaggcatcccagggtggctggggcttgtggtattgaggttgagctgatgcagaagtcacagacctgggtttgaattgtggctctaacattctctagctgtacagcctaaacctatgtgagccgccattgaccaagtgtgaaatggagatgacaacatttacctgctaggatttttgtgggaattatatgtaaagtacccggtatagcccgtgttccaaggtgagcactcagtaagcatgagctgtcacagtgaagagcccggacagaatctgggagtgattatgcagacctcgaacaccactgaattgacctttgaatcggcctcttgtcaggaatccatatgctttcgttcttcaatcgtacactttctcaaggaaaccaagtagtcggggtggggggatatattttcattgttttcccactggggccactaagccgctgtcatcacccataaaaaacccctgcccacagtctaccgtggaccctgggtgctcgcttctcccctggacatcccagggtccacacgctgcagctcccaggggtgggagaagggacgaaagctccttctccttcactgtatttccctcaacaccagcttgctgtttgcacagaggaactctgctttccctttgattaatacacctctttgtctcactatggaaagcgtctgtccccctccagtgggggcgtgtcctcctgcaggccttggaaggcttggtggggtcccccgcccactaaacgtgaagtccgaacattcccttacatcgacaaagccttttcacacacactgtcccattcagtctcgacacaaccctgtgaggccatcaaggcaagtgctgtcctccgtggtcaccaccagagtgaaggagccaggcttgggcccaggcctccttccccagcccagggtcccttcctctacacaggtcccacctgctccttcttatcgagaagggcggtggcaggtagccactccctcagaagtgaccagagggaacaaacttgtgatactgaagggaaatcagatgctaatgcgttatgcggttgagcgcctatcagcagagattatgtgggtctctcctatagaaaggtgacaccgaggacctaccaccagccaccaccagcatgcaagggcgaggtgtcacctcccagtgggagcaggtttgcatttattaagacctgtggccagatggcagcctgtgggcatggaacaggacgaggtgggctgacctctgatggctctaccaggccgacgctgaccacgtagggaagccagttggcttattcgtggccctaaggaagtgagggctgagcagggaggtgctcaaagcgggctcctcacactggctgtctggagtcgctgtgggaagggcccaggggaagaagggttgctggggcctctgaatccccccccgatggaggcagagcctcatccattcccagagagtctctcgccacgagccccggtacagcgcaggctgaccagagaaccggagaaccgggtgggaaccggagatctgagttgaaccagtgctgggaaccatggcactgccttcgccgagccgccgcgtgcctctcttttcacctctctggcctgcatattcttttagcaaacttggggattatactacacattctgctttacactttcctttccttgatattattttattatgaacgtctttctgcgtcaatcaatatattgctaccaaagcatttttttatcataccacgtcattcctatcatgtagttttaccataacttatttagccagtgcttccattattggacttttgatggtttccacttttttattattcttactaatgttacaatgaatatttcttttaaaatatttttatgtacattgtatttccttaggataaattcctagaacttgagtcattgaatcaaaaagaatccagactttcaaggtctttgataaattggctaaattgttcttcagaaaaagtgtgccaattttctgttctacctgcagggtgtgagacagttcttagggggggagaagtcaaaacaattgtattgtctatattttgacaaattcattattaagagaaagctagagaagcaaatcacaagctctgaattcacacatcacaattctaaatgtttgttgttctaatcctcaatttcaagttcttgttaatgcatccaccatttgaatatttactttttcaaaatataggaatgtgttaatttaccaaagatcacaatcggttctttgctttttgcttattttttgagacagagtcccacttcgttgtccaggctggagtgcaatggcatgatctcggctcactgcaacctctgcctcccaggttcaaatgacactcttggctcagcctcccgagtagctggaattacaggtgcctgccactatgctcggctaatttttgtatttttagtagagacggggtttcaccatgttggtcaggctggtctcaaattcctgacctcaggtgatctgctggccttggcctcccaaagtgctgggattacaagcgtgagccactgcgcccagccacctggctaatttttgtatttttagtagagacggggtttctctatgttggccaggctggtctcgaacccctgatctcaggtgatccacccacctcggactcccaaagtgctgggattgcaggtgtgagccactgtgcccagcctgtatttccatttttaacataacaaatgtttcctgagcacctttctgagaagagtgtttgaaaaaggtatgttaatgattcctggaaatatggggacagagattaccataatttaacatctcttttcaggaacacttatttcattttcctcatttttaaatgtgagtactttaaaacttacagaaaagtttacaagaaagtacaatactaaatttaccgagtagtaatattttgctttactgtctctattgagccatttgaaggtagtttacataaattacggacatcatgaaagttccctgtaagtgcttcagcatgcatttcctaacaatagaggcgatgtcttacataaccacaggcttgttatccgacctgcagacctcatatcatctgtgcatctgaaaactcatcacttagtgcctatttaaatttccccaattgtctcatacttttctgttagagattctttaaaatccaacatccggccaagctcagtggctcacgactgtaatcccagcattttgggaggctgagttgggtggatcacctgaggtcgggagttcaagaccagcctgaccaaaatggaaaaaccccatctctactaaaaatacaaaattagccaggcatgctggtgcatgcctgtaatcccagctactcaggaggctgaggcaggagaatcacttgaacccgggaggcggaggttgcaatgagccgagattatgccattgcactccagcctgggcaacaagagtgaaactccatctcaaaaaaaaaaaaaaaaaaaaaaaattccaacatccactcaaggttcattcactgcacttggttaaatgcttcttagtcacttgtaatctagaacagacacccccagccccactccagcctttctttgattttcaagactgactcttgagaagtccaggccagttaccttgcaggacgtcttacagcccagatctgtcagaggctttcctcatgactggattcagggcaagtgtttctggcaggcgttccaccaggacagtaccctgtttcctaagtcatcacactcagaggctcagaatggcaggagctctcaccacgggggtgttgagtttggacatttggtgaaagttgaggtcatcctaatgttttgctaagaatcagagggaccagagctgcttgcttgagacttcccagtgcttcctggagaagggactgttggaaatggtcacagactgggggttggttttgttctgtatcatctgttctcagtggtctgtgaccagctgcccttcccattctcccagatcccaggtgcaattgctctttttcttgcagtcaaaggcagactccctttcttgtggaggcctccatccggcaccgtgtgcccttgtgtgtccatgagtgtcactgtcacacatttaccactgcacctgtgcgcactctgcctctggagagccctcccccagacccagggagaaatatttgtttctctcttttttttttgagacggagtctcgctctgtcgcccaggctggagtgcagtggcgtgatctcggctcactgcaagctccacctcccgggttcacgccattctcctgcctcagcctcccgagtagctgggactacaggcgcccgccaccgcgcccggctaattttttgtatttttagtagagacggggtttcactgtgttagccaggatggtctcgatctcctgacctcgtgatcacccgcctcggcctcccaaagtgctgggattacaggcgtgagccactgcgcccggccaaaatatttgtttctagcacagagtgccccgagagctgcccactttctccaggagacctctttccgtaaagctttttcagcttctctgattactttgaggagaaaattcttaactacgtggtaacatacgtatggcacttgctcagagcccctttagcggagagggtccggtcccagctctggcagcagctgctcacgtagtagcagtcaggggaggtgggggtggggacggtaaggtgtccgagcagctccaacaaggagaggccgtcactctggccgggataacaattcagatatccagcgtgcacctgaatagtagaaatccagcatccttttctaaaaacaaaacaatagcaaaattcagatctgagctactctgtagcatttctttttttagagacagagtctcgctctgctgcccaggttggagtgcaatagcgagatctctgctcactgcagcctccacctcccaggttcgattgtcctgcctcagcctcccgagtagctgggattacaggcatccgccaccacgcccagctaatttttgtatttttagtagagacagggtttcaccaggttggccaggctggtctcaaactcctgacctcaggtgatccacctgcctcggcctcccaaagtgctgggattacaggagtgagccactgcgcccggccatttttgtattttttttagagaggcagggttttgccaccttgctcaggctggtctcgaactcctgagacccagtgaccccccactccttggcctcccaaagtgctgggattacaggcgtaagccaccgcacctgttcgcaacaaacataatttctaaaacaaaggagactctttgcagcggctgtacgttcttcttcctcactgtcagcattctcttgttgcagaatacaacctccattcatgttgtttttatgaatgaatctttttaccactttcttactatgaccaggtctggaggcagaaaaccacgttgtcttctctgcctaaaaagcaacaccacatcttcatagacaaggttggctatggagtagactcacagcattccatgataactagttagaatgcagcagtgttccaaatgggccaaaccttgtccagacaggagcaacaggcagctcagggtcccaggaacactcaccagctggcagcccctcgggaagcggctgggctttccacctgttcctgcatgctgggcacactctggcttagatgccctcttacagctgcagatgctgtggcgtggtcctcagccctgaggatgtgggaggagaggaagcagtcctgtgcatgcaggggatgagtcacgggattttgcagagagatatggcaagaggattgtttatcttggactctttgcagtgccatggctctgaggaagctctctgcagctacacactctacgaagagtgtttctcaacctcaatggtcactattttgaaagccttttatttctttacagtcattacatacttttaatttagcactgggtcttggccattctcacatgattgtattagtcagggtccaaccaggaaacggaaactgcccagattatttaagacagaggatatttaatgcaagaaagtggcaacacatggtggaaaaggctgagaaagcaaataaacagtcaacacagcgacgagcagcttcaggaagcttcttatcctcacctaggtagggtgaggacaagaggagaaggtgggccaggcaccatgactcacgcctgtaatcccatcactttgggaggtcaaggcgggcagatcacctgaggtcatgagattgagaccagcctggccaacatggtggaacctcatctctactaaaaatacaaaaattagccaggcgtggtggcgtgcacctgtaatcccagctacttgggaggctgaggcaggagaattgttgaacccgggaggtggagtttgcagtgaggcgagatcacaacattgtactccaacctgggcaacaagagcaaaactccgtctcaaaaaacaaaacaaaacgaacaaaaacaaagaggaggaggtggtgtcaccagagcctaggggtcagcggaagaaactctaggatgtctctgtccaaggcagagaggaagggagagaagtatgctggattctttctgccctctactgtctgacctcccaggaggagtgtcttccattgactaaaccagcagagtttgtgacaggtgacagcagtttgaggccaggtgacagcagagtttgagattcagaaccttcagaagtcagagccctgccacactgaggagggcagggaaggggaaggcgcagctctggggacaaaccgctgtcagccagcatagtcatctgtgctcagggctagccttgctctgcaatttatgaatgcagagtttttaattgaaccttcctgcatatgttttacatatctagttggtataattcatccttccagccacattactcaggcctttattttagactttgtgtagctgttgaactaccttggagattacacaggaataaccagcactcagtcaactcactggtgtttggaactcacaagtaataattaataattgtgttacttgctacctttacagccatgaagccctttcacattcatgagactggttattctcatgcaactctggaatagttattattactcccattttgtagacggattctctgagtcttggagactttgtctgaattcctaaaggacaaataacaaataacagaggcagaattcaaactctggtctgcttggttccaaattccatgatcttcccatgatatcctgctgcttcctgccagggccacaacaagagtttttttctgggctggttggctgagtttaggaggaaggagaggatatgttttaaacttgcaaaattcttgatgacccataaattaaaatgcccctcctgagtgtgacacaaggcctggcttgccttccagtctgaaggttgccttttcgctgagggacctgcactcttgccccttacacgtctagattcagttcttcgatacgcagggctggctcttccagagagactggagtcacagcagcaggtaccaccccacacctgacaagaggtggccagggaggaagggagggttcttacctccccatctcccctcagtaaaattcaggatgcccagtgaagtttgaatgtcagataaacaatttgttagtataaggatgtatctagcattgaaatgatgccttgtaatttactaaatctgcaactatgcagccttatttcatggcgggcagtggtggtgatcccaggtttcaggggcggggaagggtgctggggggatcctgaggtcaggaacccgtacacctctgcttctgccctctcttccctgtgccggccacaaggcaatgactcctgtgtgggtgcagaggcagaaatgggtctggaaggggattcccagtgtctggcaagttctggtaaattctgcattggaggttctctctgtagtaaggggagttggcctggcctgaagtgaaagctggcttacccggtttcattgagctcttcaattagtctgtttgcactggtgagcattcaaatctgatcaagaaggtaaaatgagctttcaagatccctaaatgcatttgaagaaaggaaagaggaggcccctgagtggctggagcgagcaggtggggtgagctggtgccgctggcccaggagaagatgggagggcagacactgggcctccggtaggtgtcaaggaatgggcagatggaatgctggggccagctcttgcctctgggtctgcagaatgcagagctgggggcatgcactgggcgtcaggtccccagcagggcagcagtgagtgcagcctcgctgctgggagaaactgccctgctcactcatcggagctcggggagcgaggcggggctgctcttagccctgccactaagttcatccacaacctcgagtagtatctctgggcctttgttcacctggcaaatgtgatgagtatattgcatttcccttatggctccccttagttctgaatctctgctggtgcgtgtataccttcaagccttctcattattgctgttctctgtgcactggccaggcaagcgggctggcaaccacgtttcgttaaccacctttattctacccaaagattgcttcttcattttccctccgtgtttcccccgtccaagcaaaatatcaaacctcttttttcaaagggtcatagtcaaatgagtgaaccaaagagatcaacgcttttgtaacagccccacatcagcagctgaggagtaactctgggacagaggcccccatccgtgtttccgtctccgtccactctccagttgttcattcattcactcagcaagtacttactgagctcaggggatgcatcagaccgattggagctggaggcaggaaaacttcagcagaattacaaaatatgggaaactccaggtgactggaggcctggttactcaagctttttgcttctcccttctgtgctggactcgctgaagtttagtgttcagccacccgtccatcaagtggtagaggcaaaatgaaattgagttcttgtcaacagtttcagtgaaaggccggaagtcttggctaaatggaggtatctgagtatcctgtgggctgcacctctatggagctccacagagctccaagaccacatagaattggaactggctccttctgccgataatacaaacagccctctgggatgtccttctctgacttacctcttccctgctctctgtccacagggctgcccttgagatggagttgctgcctctttggctctgcctgggttttcacttcctgaccgtgggctggaggaacagaagcggaacagccacagcagcctcccaaggagtctgcaagttggtgagtttcccttgaaccctgatctgtcggctgctcctgtcctgacaaggcttggtccatttggaaagctgacagattgtccatcaggaagggcagagaatgaaggagcctgcatcactctgtgcctgcctagcacaggggcatgtgcagctgccctttaaccacaggattttaagatgcttcctgggaagagccaggcagtccctgccccgccgttctcacgcctgctgaggataggaggcatccgagaccagcctagggcatcctcccggaacaagaacaacttgttaaaaatctggatgattcaggccgggtgcagtggctcaggcctgtaatcccagcactttaggaggccgaggcaggcagatcacttgagcccaggagttggagactagcctgggcaacatgatgaaaccacatctctacaaaatacaagaatcagtcaggtgcggtggcacacacctatagtcccagctacttgggaggctgagatgtgagggtggcttgagcccaggaagtggaggttgcagtgagctgagatcatgcccctgcactccaacctaggtgatggggccagaccttgtctttaaaaaaaaaaaaaaaaaagccaggcgcggtggctcacgcctgtcatcccagtacttagggaggccaagtccggcggatcacctgaggtcaggagttcgagactagcctggccaacatggtgaaaccccgtctctactaaaaatacaaaaattagctgggcgtggtggtgcatgcctgtaattccagctacttgggaagctgaaggaggagaatcgcttgaacccgggagacggaggttgcagtgagccgagatcacacccctgcactccatcctgggcgacagagtgagactctctcaaaaaaagaaaaaaacaaaacaaaacaaaaaactggatgactgagctgcaccgatggtatgagaatctccgggtgaggtgcttgagagctggagaagcctgcctcggagtttgtggacgagttgaccgctaaggcttacacagctgcggggaggacttgctgccatgccactctgcagagcggcagcccggaccacgctcaggctaagaagacccggagcgtggatacccaagcctcctctagggctttcagcctagatgtgaaaatagacttgggtccaaactgagaaatttccagtaattttccccttcatctatataacaatgatatcaaaagtctgctcaagaaacacatatttaggccaggtgcatggctcacgcctgtcatcccagcactttgggaggccgaggcgggcagatcacaaggtcaagaggtcgagaccagcctggccaacatagtaaaaacccgtctctactaaaaatacaaaaattacccaggcatggtggcacatgcttgtagtcccagctactcgggaggctgaggaagattgcttgaacctgggaggcagaggttgcagtgagctgacatcgtgccactgcactccagcctgggtgacagagtgatactccatctcaaaaaagaaaaaaaaaatgaaacacatatttaataaacatttcttgagccatattatatactaggcgttgggaagacaaattggatgtcagggctaacacttacattcaagtatgtattcttaaagcatagctgtcatggtttttaacctcttttagtaggaacctataaccactgtgctagagtctattccaatatgacatagaggttacaagctagactggcctggtttaaacccagccccacccttagctggtgacattggggtcactctaggtcatagtttctccatctgtagaatatatacgtaataataatatctaccaataacatcatgctgtgttgactgatgattaaatgggttaatacatgtaaagcactcaggacagtgcctggtaggtagtcagtgctacgcgttttatccgttatcactcatattattattaatctctgctatgtttgacctccagcattctcttacagaggcaataaaggattaactacacagtagttattcaggggttaccaggcacaggaagaggagagataaatgaacagcctttcagagttcaggcaaggccctctgcttgacactttctggcccagtgggcaggagtagagaattggctgccaggaagcccaaagagtgggtttcctgtggctcttccgagttgaggactgagaattggagagtctgggtgccctccactggccctcatcacattatccatttgaccttattagaaagtggacgttggccaggtgcggtggctcccgcctgtaatctcagcactttgggaggccgaagcaggcagatcacctgaggtcaggagtttgagaccagcctgaccaacatggtgaaagcccgtctctactaaaaatacaaaaattagccaggcatggtgacgggcacctgtgatctcagctactcaggaggctgaggcaggcgaatcgcttgaaccagggaggccgaggttgcagtgagctgagatcgcgccactgcactccagcctgggcgacagagcaagactccgtatcaaaaaaaaaaaaaagaaaaagaaagtggacatggtaagcttttctgggatggccatatggtccttctacatcacttcagcggggccacagggaattgcagaggtgtgacccacgactgcagcagctgtggtggaacagcaccccatagcgtgaagaaagcccctgaccacaacattctccagtgagtccacacgcagggaggagcgcaacacccactcacataaagacacacacctggccgggcgcggtggctcacacctgtaatcccagcacttggggaggccaaggcaggtggatcacccgaggtcagggtggccaacatggcaaaactctgcctctactaaaaatacaaaattagcccggtgtggtggtgtgagtctgtaatcccagctacgtgggaggctaaggcagcagaatcgcttgaacccggcaggcagaggttgcagcaagcagagatggcgccattgcactccagcctggacgacaagagtgagactctgtctcaaaaaaaaaaaaaaaagataaaaattctcttccagagtactttgtaattataatgcaatcccaatcaaaataccaaagagggaagggggatgtggaaagaacttggcaaatcctttctaacgttcgtctggaaattagagaaacccaaatgctcaacaataggagatgattaattagatcatcctaataattatagctcacatttattaagcacagtaaatgtgtttcacctcaacagtcacacttgatcctgaaaaaaaacgctatgcgaaaatgacgagtataatttcggttttacaggcagggtaatggaggtctctttcggttccgtaaccatccaaaggtcacccatttgatcaaaagcagagccacgaagcattggccctggaactcttgctctcagccactgtgctattcatgagatgaatgcatatgcttcctaaaaagattatgatcacatttatttgtactgccaaggcaataagtccgtcatactttattgacagggggagaaaaataggttactgaacagtttgcacagtatggtcttatttttgttttttagacaaaggtaggtaatatcttacgaaagatccagaaagacatggaacagaaggtgactggtgtttctctgagagagaggcggaggtgacagaagagttgaggtttccatatgtcaatacagtatcaatgtttaattattggaaggttttattttaattatcagataaagaacccgaggggccaagaaattccactgctagtggtggtagagccgagattcagattgagtctgtcctccaaacctgtgcttcttctaacctctctctcgggattttcctcttctgttgccgtgctgcacttgccctctgggattgaacccacaattgtaggcaaccactgcccttgtattactgataaacttgtgcaaacgaatgccattgctcctctatcttatcacttaaaacttctttctggccgggcacggtggctcacgcctgtaatcccagcacttttgggaggccgaggcaggcagatcacctgaagtcaggagttcgagaccagcctggtcaacatggtgaaaccccgtctctactaaaaatacaaaaaaagttagctgggcgtggtggcatgtgcctgtaatcccagctactcgggaggctgaaacaggagaattgctcgaacccaggaggcagagattgcagtgagctgagatcacaccattgcactccagcctgggtgacagggtaagacttcatctcaaaaaaacaaaaaacaaaaaaaccatttttgtcctagacacctaaataacatcctatggctgatggttgtttttgccaattttgcaaagcgtggggtgaattaaagtatcctgcacgtgtgctttctgcagtgcgaccagggtggcctcgtccctcccgcctccttattctgcatgatcagagtagagccctgtttaggaaaagcactgaactgggcattcagagccctgggctccagtcccggcacagccactggctcttcacttctcccctccagacccactttacttccctgtacaattcaggatggtgaaagctctcaagtccttttttttttttttttttttttgagatggagtcttgctctgtcgcccaggctggagtgcagtggtgcagtggtgcagtctcggctcactgcaatctctgcctcctgggttcaagcaattctctgcctcagcctccggagtagctgggattacaggtgtccaccaccacacccggctagttttttgtatttcctgtagagacaggacctcaccatgttggccaggctggttttgaactcctgacctcaagtgatccacctgcctcggcctcccaaagtgctgggattacaggcatgaaccaccgtgcccggccttgtctatcctatttttaaaatgaacatctctagagccatccccggcggttgcagggacagtctgataagtgaactaagtttctatgcataaatgcttgcctctgggcctcctcgctgctgaccggtgtggttttggccgcaggtgggtggagccgctgactgccgagggcagagcctcgcttcggtgcccagcagcctcccgccccacgcccggatgctcaccctggatgccaaccctctcaagaccctgtggaatcactccctccagccttaccctctcctggagagcctcagcctgcacagctgccacctggagcgcatcagccgcggcgccttccaggagcaaggtcacctgcgcagcctggtcctgggggacaactgcctctcagagaactacgaagagacggcagccgccctccacgccctgccgggcctgcggaggctggacttgtcaggaaacgccctgacggaggacatggcagccctcatgctccagaacctctcctcgctgcggtccgtgtccctggcggggaacaccatcatgcggctggacgactccgtcttcgagggcctggagcgtctccgggagctggatctgcagaggaactacatcttcgagatcgagggcggcgctttcgacggcctggctgagctgaggcacctcaacctggccttcaacaacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgagccacaaccagctgtcggagctgcacctggctccggggctggccagctgcctgggcagcctgcgcttgttcaacctgagctccaaccagctcctgggcgtcccccctggcctcttcgccaatgctaggaacatcactacacttgacatgagccacaatcagatctcactttgtcccctgccagctgcctcggaccgggtgggcccccctagctgtgtggatttcaggaatatggcatctttaaggagcctgtctctggagggctgtggcctgggggcattgccagactgcccattccaagggacctccctgacctacttagacctctcaagcaactggggggttctgaatgggagcctcgccccactccaggatgttgcccccatgttacaggtcctgtctctcaggaacatgggcctccactccagctttatggcgttggacttctctgggtttgggaatctcagggacttagatctgtcggggaattgcttgaccaccttcccaaggtttgggggcagcctggccctggagaccctggatctccgtagaaactcgctcacagcccttccccagaaggctgtgtctgagcagctctcgagaggtctgcggaccatctacctcagtcagaatccatatgactgctgtggggtggatggctggggggccctgcagcatgggcagacggtggccgactgggccatggtcacctgcaacctctcctccaagatcatccgcgtgacggagctgcccggaggtgtgcctcgggactgcaagtgggagcggctggacctgggcctgctctacctcgtgctcatcctccccagctgcctcaccctgctggtggcctgcactgtcatcgtcctcacttttaagaagcctctgcttcaggtcatcaagagccgctgccactggtcctccgtttactgacctggctgtgtgccaagactcgaaattcggtccgcacacaacaggacactttctctgccagctttcaagatgtgatgcagaggccaagtctgacgaattgaagtttcaattaaaatttaatatgtttccattcctcatcgcccaccccacccccgcccccaccaccgcccaagttctttttccatcattataattcatcctcattatcttggtaaaatatttattaagtgactttttcagaaataaaaggcaacgtgtctcataaatattttttaaattaa

SEQ ID NO: 1453 - DNA, 32808 bp, Homo sapiens
ctcagtgtttaagtattttattaaatcagacaaggaatctccacactgttgcacataacagcttttatacaatgataaggacatatcatttgtttacaaagaaagtctaaaatttcaagaacattcaaagagctaacacagtaaaggtcatgcaagttctagaatagtgaatcatgacagaactcattcattttatcctttacctccaaaaggcccatctccttaacgagaagacatctcaagaccaggagcttgtcactagtctgatatttcattcaggaatattgagcctgttagcacgtactggcttgataggaagtaactcaaccctaactgtagaaaagggttttctgaagagactcactgctgcaaaatgcatgccctgtattcatattgtgttatacgatgaacatgccacatgctttcatttaagtacgtgtgcgtaacacccgaaccaggaatctcagctatgaccttttcacttagctacgctaaatgtcagtccaagataaaagaggagattaaagataaaactgaagattaaagagactgtgagtagtgacacattcaagtgaggctgtaaatctaggtaagtgacactaagaacctgaagagaccctatgaacttttccctaggaggccgtttccaactgccctatgacaaacagctgatcatcacgtttataatgatggttcactcacggagcttcgaacttattcatacctacatttaattgatcaccacgaatgggtaggcagacgtgtcagaccttcaggggactctccttccccacagcccccaaaccttctatacaaagtccctctgctttaagtcaaaaggtcaattctggattaaaacttgtccgcactaagtttataggaggtaacatgcaaataatgtgataaagttaaaatgacttgtcaatagcaaacattataaatgtatgctactatctcattaagtagaggacctggagaaaccataaaggtaacaaaaacccaagctaaatttcaaattttgtagtaatttcattttacagtggttgaatttacccacccaatgcttaatgaccacaaaatgtttctgcaactaaaactaaaagatagggaattataggagttgggatacatgttagatactaacgatcttcaagctttgaagatgtcattgcatgaagaaaattatgggaaacactgttcccgataattacttacacccttagtgtaacatatggagatcactgtctccgatacagacactgtggtaggtaaaaactaccttgttctttatacattatggaagacactgctcccgataatgtgttaggattgtgacaaaggtactggaaattttgcaaaatgggaattagagttacaccttggataaactgagctataaaattttgcaggagtactaccacagcctttaagtgacattgatttataacttggtcacaattcactgcatttaggaaaaccagcattcttatctggtcagtgctcgcttcttagcaacccctaattaaatttaattcatctctaaatcttagcttcaactttattcaattacatttggctgacggctgttttctaaaacccttaagtgttgaccataaatgcaaaacttccagtatctgttgggttttattagcagatgctgcttttatttaaaaaaaaccgacagtataactgtcataattatggaaggcactgcttccgataattatattctattaaaaaaacaccatttatagtgaactctgtcactgataaataaacaataaatatctcagtgccaaaaggacagaaagctctcccctaagattaacactttggccaaaatttggcagcatattattctttaaagtctgacaaactgagtctgcaactaaacacctgaaactggttctctttcaatgtgctttggaagaaacaaaaataacaaagaactaaatggaggcttatgggggaagggacagaggaaaagaaaatatactaagtctttggcttctggtcccctcttttcataaatgacactgaggttaacatattaaggccttattcctgcaatcaacagttgaacctcattttatccagcagaaggacctccatttcagacctcattggcaagaaaacaagcccatctcttctgaaagttaactgtttctttcaggaatgaggaaaccagctacattccttatggaaaggcttagatctcatttggagaaggtctttcaacctggtatctcctatttagcatcaaatgaagttggaggatcactcaaagtaagcgaccacttacaaccttcagcagagaccagcccttaggattcagagagatcattcacataactggtttctgacattttcattaacaacaacaggaaagaggcagttcccattacaaagcacttaaaattctagagataggggaatattccatcatggacattttttaagtggttattcactttaacttgaagtacaggttatctaccctgtattaaaagctgctgcctaaagacatctagtagtaccaagatgatgggatggaattttaacatcaggttttgtagccctactgaaaatttagcacgatcagcacaagtctagaaaccagactaccctgctgttctcatggaagctatgggtatcacatttaaaactcattgtcaatgtcccaaacgtcaccagagagggcatttgcagctccctgaatagtccaagtagctagagccaactggtttctgaacagcgtttcattaaaagcaccgttattttgtttacgcagtttcaagttctccagtaaagctggcagcgtgtgagagccggagccccagaagacatgtcggaaaggagactcttttggagatacgtagggagagaggaagtgatactccacctacgaaaacaacacacaaggcaatttacacagccctgtgacttttgtagtaaaacaacagttcacttcaaatgtaaaatgtcccaaatttaagaatgccgatcagactttttttttttttttttttttttgacacagagtttcgctcttgttgcccagactggagtgcaacagcgctatctcggctcactggtaccctccacctcccgagttcaagcaattcatgctgggattacaggtgtgagccaccgtgcccggctttttgttgttgttgagacagagtttcgctcttgttgcccaggctggagtacaatggcgcgatctcagctcactgcaacctccacctcccgggttcaagtaattctcctgcctcagcctcctgagcagctggaattacaggcatgcaccaccacgcccagctaatttttgtatttttagtagagatggggtttctccatgttggtcaggctggtcttgaactcctgacctcaggtgatccgcttgcctcggcctcccaaagtactggaattacaggcatgagccactgtacccagccagctgatcagactttctatagcagagtaaggaaaaaagaatgctgagaaccaggctaatgctaatcttctaaggttaaaattctaaaggaggctaggcacagcggctcacgcttgtaataccagcactttgggaggccaaggcaggtggatcacttgaggttgggagttcgagaccggcctggctaacatggtgaaactccgtttctactaaaaatacaaaaaatgagccgggcgtggtgttgggcacctgtaatcacagcaactcgggaggctaaggcaggagaatcacttgaacctgggaggtggagggtgcagtgagccgagaccgtgccattgcactccagcttgggcaacaacagtgaaactctgtctcaaaaaaaaaaaaaatttttttaaaggaaactgattcattttacaaaggaaaactttaaatgtgttcagattcttttccccattggagcatacatggaagttttacagcaagtctcttccaaaaagactaggtttgactaagttctgaattagacagcagaaacagaaaatgacagctaaaccattaatgctcccttcttaaaggaattctagactcctagagtttgtccactttgcagaagtgtaagatttatcggttattttacacatactttagttcctcctttcccaaaagttcacttactctcatgacacgatcattgagtttcttcatgacaaatctgtctgttttctcagcattcccgaaatctgttgttagtctggaagtagcacggaagaagtctccacgagcagaatacagccactgtaaactcaggcccatttcctgaaacagacattattcgctatgagaagttttatttctaaggacattcttttgtatgcctttctaatttaacgtgcgttaagtaagattctgataaaaggaactcgcagataagctcaagactccgaaagcaccttgcacaggggttccaagctctatggactgtgatatacactcatatttgagcccagcatgtaagaaaaccattctcattaagaaattgaacataattatataatcctatgtactatattgtttccagttcaattctccttttgggggaaaatgtccctataggggaaaacattttggttcaaggtacttcaggatttagttatttccacctggtaagttccattttcaacagttacaattagtttcaagaaagacataagatgccgggcgtggtggctcatgcctgtgatcccagcactttgggaggccgaggtgggtggatcacctgaggtcaggagttcaagaccagcctggccaacatggtaaaaccccggctctactaaaaatacaaaaaattagccgggcgtggtggccggcacctgtagtcccagctactcgggaggcttaggcaggagaatggcgtgaacccgggaggcgcatcttacagtgagccgagatctcgccactgcacttcagcctggccaacatggtaaaaccccggcttctactaaaaacacaaaaactatctgggcatggtggcacacgcctgtaatcccagctacctggggagccgaggcaggagaatcgcttaaagccgggaggtggaggttgcagtgagccgagatcatgtcattgcattccagcctgggggacaagagcgagacttcatctctcaaaaaaaataaaataaaaataaaaataaaaaagatataaaaagattcggttgtcagtgatttacttcaattaagagatctgttaaaaatcaactcctagtaccataaaacaatctggaagctactttaatattagttttattaatttatttagagatgggattttgctatgttgcctgggctggactccagcaatcctcctgcctcagcagaagtagctggggctacgggtatgcaccacctcaccctgcttatcagtttcgtttaatagaatatttgacttttagatgcgcagatcactacgagatggaatcctgctagctgtgctgtctttccatccgggtcacgcccgagaggcacacagcccaactccttgctgagatcttcatattccgtgtcctactgacgggctgcctgggagacatgagtgacagaaaacctgacactgctctggattctgaaacacctgctgagctctgtcctaggtctctaatccacagcctcccgacttctctcaaacaagttaccaattctacatacaattatacctcagttcactttaaaatgtactatggctacaatcacccttccaacaggaacacacaggaacacatcacatttcaaaatacttgacattcagcaaaataaaaacgtaattggaatcagtgctcacctttatgtctgctctgtattggttcagatccctcacaaatgaaagcagttggctgttgtacctctcatagtccaggttcaattcaacatcatgggttagtttaatcacgaactgaccagcgacctctgcagctgctcgtgccactttgttcaactcaggaatcctctcaatcagttccttataggtgtccatggtggtacccaaataaggataatctgtgtcctgcaagacaacgcgaggctatggtactcacgtgagttctaagagcaagagcctcacattctggcttcgccatcgaggtaacagtgacgacagttccacccttgcttctaacatattcctaccgcaatttaccccaattctatctcattatctgctgctttaagtacattcttgctacttctctcaagctaacctactcctagagtgactactttcttccaggttctacagaatccctgttctatcgtatcatatgccctgaatagacttctagccaaattccttaaggctgtatgtttttctctctgggaagtttgggcctttatcaatgaaaaaagagaagatacatgaaacataccttgagacgaggtctctctgtcacccaggctagagtgcagtgatgcaatcacgactccccacagccttgagacaaggtctctctgtcacccaggctagagtgcagcaatgcaatcatgactccccgcagccttgagacaaggtctctgtcacccaggctagagtgcagcgatgcaatcatgactccctgcagccttgagacgaggtctctctctgtcacccaggctggagtgcagtgatgcaatcatggctccctctagccttgagacgaggtcactctgtcacccaggctagagtgcagtgatgcaatcacagctccccgcagccttgagacgaggcctctctctgtcacccaggctggagtgcagtgatgcaatcatggctccctgcagccttgagacgaggtcactctgtcacccaggctggagcgtggtgatgcaatcatggctccccacagccttaagctcctagctcaagtgacccccctgcctcagcctcccaaggagttgggactacagctggccactgggccacttaatttaaaaaattttttgtagagatatagtctaggcacgttacccaggctggtctcactcctggcctcaagtgatctgcccacctcagccacccaatgtgccggaattataggtgtgagttactgcacccagcctgaggaaaatactgttcagctggactgtccaatagatagccactgctcaatcactcaagaaattcagccttggttttttttttgttgttgttagacgatcttgctctgttgcccaggctagagtgcaatggcacgatctcggctcactgcaacctctgccccctgggttcaagcgattcttccacctcagcctcctgagcagctgggattataggcatgtgccaccatgcccagctaatttttttgtatttttagtagagatggggtttaaccatgttggccaggctggtcttgaactcctgacctcaagtgatctacccgccttggcctcccaaatgctgggattacaggtatgacccaccacactcggccaagcctcattattaaaactcataaagaagttttagcaataaactcaaatgctaattaagctaattgagattaacaagtctatgttaaaactaataatgaaggaacatgcaataattacatgtgtataacttttttttttgagacagggtcttgctctgtcacccaagctgcagtgcagtggctccatctcagctcactgcaacctctgcctcccaggttcaagcgattctcctgcctcagcctcctgagtagctggggttacaggcacacgccactatgtccgactaatttttgtatttttagcagagacggggtttcaccattttggtcaggctagtctcaaactcctgacttcgtaatccgccttccttggcctcccaaagtgctgggattaagggaggagaccacccctcatattgtcttatgcccaatttctgcctccaaagaaagaagaagtaaaaactaaaaggcagaggtggacagcccagcgctgccgcaccctggtcctggttaaagatcgagccctgacctaaccagttatgttatctatagattccagacattgtatagaaaagcactgtgaaaatcccgtcctgttctgttctgttctaattaccggtgcatgcaacccccagtcacgtaccccctgcttgcccaattgatcacgaccctctcacgcagactcccttagttgtaagcccttaaaaaggtcaggaattgctcactcggggagctcagtttttggagacgtgagtcttgccaaagctcccagccaaataaagcccttccttctttaactcggtgtctgaggggatttgtctgcggcttgtcctgctacaggattacaggcgtgagctaccacatccagcacatgtgtataacttcttaaaacattttaagcactgcagtaaatttggtctcaaagttgacacaagaagatccatggccaggtgtagtaagtagctcttgcctataatccaaacagtttggaggctgaagggggaggactgcttgaggctgcagtgagccatgatcgggccactgcaccccagcctgggtgacagagcaagtcaccattgtcaaaaaaaaaaaaaaaaacaaaacaaaaaacaaacaaaaaaaacccaacaactaagatatgtgcaagttgtcaaaatcaaaatggagtcactagtgttaacaaaaatgcaaccctgaagagaagggtctcacccttgtatgtctgataacaaggattaagggtttttttttttcctttttacaaaaactacaaccttacacaaaggccactgcaaccttgcaccaaaaaacttctctcgtgagaaaatctgcctagcaactgcctgtcaaccttggactggtgtcatccttgttattgatcttggtagccaagaataattacctcaaagtaattttgtaatcctcgtcatttgtccttaaaaacttgttttcctttactcctctgaatatgtacatagttgactatagcacaggcattcccattgcaatgccctattcccaaatacagatcacttccttttagagagcctctctccatttgtcatttaaatgaacagacttacctcgcaaaaacagaaagaaactgctgggattccagaatatgcaaggaaagggaaagcagcattgtctaaagtgagtttctcactgcaaagacaaagaatgtgtctttagaaagtgttttaaagaatagactgttctatcgtgctagtccccccatccaaaataaattctttagctgaatatctttaggtgtaagtaagttcaatgcaaggacagatttagattctacctaatgtagtaggtagaatctctgcttttctattagtttgttcattcacttttctcaacttacactttgctggcccagttgctgtcctgatatagaaattgcccagtaaccggatgcttcacctgtaagataagaaattatcattaaaactaaccttttggaacttatttattcaggctagtcactaacatgttactctataacaatttttaaataaaaaacttgtattatatcttcttgaaaagaaattatttatgatagttaaaacaatctcaactttaagttattactaactaggctcatgttgtcagttcctttagttatggtgaggaaaaaatgttttcttcttaattaacattttaaaagtgggcctaggccgggtggggtagttcacaactgcaatcccaacactttgggaggccgagctgggaggatcacttgagcccagaagtttgagactagcctgggcaacacagcaagactttatctcttaaaaaaaaaaaaggaaaaaaaaatgaataaaagctgggcgcggtggctcacacctgtaatcccagcattttgggaggccaaggtcaagagatcatgaggtcaagggattgagaccatcctggccaacatggtgaaaccccgtctctactaaaaatacaaaaattagccaggtgtggtggtgtgcacctgtagtcccagctcctcaggaggctgaggcaggagaatcgcttgaacccaggaggtggaggctgcagtgagccaagatcgcaccattgcactccagcctgagtgctggaggaagacagaggaagactccatctcaaaaacaaacaaacaaacaaacaaaaccatggtggcttacccacaattgtaaaagccctctctgggcttcacactatgcctatcttgtttctggtttcttccttctagtgcatcttatgccaccaacctaactggcaaattcatgatcaccttgcttgagatcctataatccctagtatctcttggatcaaggccaatgtctgctatctgacctgtttctaactttactcactccaatatacagcctctaatcccattaggcaaatattttcttttttatttatttatttattttttttttaattatactttaaattttagggtacatgtgcacattgtgcaggttagttacatatgtatacatgtgccatgctggtgcactgcacccactaactcgtcatctagcgttaggtatatctcccaatgctatccctctcccctccccccaccccacataggcaaatattttctttcacatgctctccctcattcaaaactatggtaattgtttattcaatgaatatttcctccggccttctcaaagtatagttcaagttgatttaagccttccttagcattgtgactctatagacaatcccctgtgggcccctgcactacagcttaggcctcatggcattttgttatatattcctaaataaacaacatattctttaagattggagccctcatctcatatggttcaataggcaagtatcccttaaataacgctgctataaaatttattctcaattcctattttttgttactgactacggtttacatatcagtgttttttatctcaggttgattcaacaaaaattaagtcatacatttttgtaatgaggtatatactcacattttgcattgttttctcaataagcgtatacaacagtgggctggcagaaaccttgaagttgctggtacctgaaaataaattgttttatcattgccccttctccattccgataattttcacactgctacttctacaactataagtacttgacaaataagacagtaatctagatcagtggccctgtgcaacaactatcccattcatcaagtaaacaaaagtaattttggtatcaagctctttagcaactaagctaacttcactcaagtgggctcgtactactccttgagtttgcatactttaatccaagtcaccttttttaaaaatatcagagcagttaggccgggcacggtggctcacgcctgtaatcccaggactttgggaggcccagacgggtggatcacaaggtcaggagatcgagaccatcttggctggcacagtgaaaccccgtctctactaaaaatacaaaaaattagccgggtgtggtggcgggcacctgtagtcccagctactcgggaggctgaggcaggagaatggcatgaacccgggaggcggagcttgcagtgagctgggatggcgccactgcactccagcctgggtgacaaagcgagactccatctcaaaaaaaaaaaaaaaaaaaaaaaaaaaaatcagaccagttttaggttcagcagcaaaattaagagaaaggtacctagaggtcccataaatccactgcccccacacatgtgcagcctcccccattagcaatttcatgtttaactttctggttcacccaggttagagctatacatagtatgcttgctatactcagcacattctgcggcaaacatacaacagggaaataactaacctagagaggtttaattgtaactctttccttttttcccccatgtagacatttcactattctcagctcatcagctacatctgcactttcttttttaccccattcctgttgaatgtacagctgcactttaaataacattcaaacccttttgtcaattttctgctgccagtgaacattcaaactcttctagaagtttcattatccaatatttctatcagtgatgccacaacgtaacaggatgtgaattactctctaagtaccattctatatggcatagtttagtttcttctcacctcaatatagtccagacttatggtcctaaaactttagtccatcagaattacctgtagtgcttgttaaagttttttgtttctttgtttgggtttttttgcttcaggatactttgtccttaagaaaataataggtttttattccccaagggttgccaaaaaaaaagcccagtttttttgtttgtttttttgagatggagtctcgctctgtcgcccaggctggagggcaatggcgccatcttggctcactgcaacctctgcctcccgggttcaagtgattctcctacctcagcctcctgagtagctgggattacaggtactcgccaccacacccggctaattttggtatttttagtagagacggggtttcaccatgttggccaggctggtctcgaactcctgacctcaggtgatccgcctgccttggcctcccaagtgctgggattacaggcgtgcaccactgcgcccagcccaaaaagcccagtttttagaccaacactcccatttctgactcaaaggtctggggtagacatgacagtttgcattcgtaacagttcctaatgctactcatctgggggccacactgagaactacccactgttctagacaagcaattgtgctcactgtgtaacttgacagactatttaaaggaaggttaagatacaggctgagggcaatggctcatgcctgtaaccgcagcattttgggcagctgacatagaatgcttgaactcaggagtttgacaccagcctgggcaacatggcaaaaccccatctctacaaaaaaaattagccaggtggctgaagtgggaggatcacctgagcccaggaggtcaaggctgcagtgagccaagattgtgccactgcactctagcctgggcaatacagtgagaccctgtctcaaaaaaaaaaaaaagctttcttccacttcaaagtagtttatctggccaggcacagtggcccacatctgtaatcccaggccgaggcaggcagatcgcctgaggtcaggagttcgagaccatcctggccaacatagtgaagccctgtctctactaaaaatacaaaaaattagctgggtgtggtagtgagcacctgtaatcccagctactcaggaggctaaggcaggagaatcgcttgaatctgggagacagaggttgcagtgagccgagatcgtgccattgcactccagcctgggcgacaagagcaaaactccatctcaaaaaagtttacctgaattcatacacagctaatgaaagggatacttaccaagaaccgctttatccagattaatataagtgaaagcctttaaatgcagggacgaaaggtatccctagaagagaagggaaaacactaataagtataaatctgtttatttatcacatacagtagcattagggattcattttcaattctggactctactgagactaaacgcaaaggcaaaagtggtaaaatcaaacctataaaaacatcacttctggacaacagcctaagcccacaagctcgtgtccaatatgggaagggatgataaagaatacctctagccattcagtggcaccaaccgatccaaagtctccagcactccaactggcaaagataatgcttctgctgggctgaaacccatctgaaagagaaaaaagttagctttacctgaggaaaggttatacacagacaaggatggaaggtatcccacttaagatgaatcagaaggtctaattccaagatagcagattccaaaatcttttttttctgagccaaaaaagaaaaaaaaaactaacaaaatctttttttgagaccccaggtaaaagaataaaagaataggaataattttttttaaagtaacctacaaagagcaagataggagatctgcaaataagattttgagtacatagcaggggccagtagtcaccctttcacaatttcattcttggagttccttaacttctggacccagagatcattgaaaacagtgtaagcatgatgatgcacatcttgagaaaaatcttcagaggtaaatccaaacattggatttttaaaaaaataattctaaaataaaataaaaattcacaaatttaagttacaagaagagtttgcagagaaactatatttgtgacagcaccttttgaggttacatgtatcacactgccctccatccctcccacttccctcactgtatctttttctccattaatgtactctgtattaaagttaagcattgcagtttgccctaagacccaaagattcaagaatgtgacgtgattttgaatgtgtgggtgggtaggagtgtgaaagagtggaaagtaggacagaaaggctcaaaaataaacaaaagaggcagggcacggtggctcactagcagcattttgggaggctgaggcgggtgaatcacttgaggtcaggagactagcctggccaacatggcgaaaccctgtctctagtaaaaatacaaaaattggccgggtgtggttgtgggtgcctgtaatcccagctactcaggaggctgaggcaggagaattgcttgaagtcgggaggcagaggttgcagtgagctaagtgagatcacaccactgcactccagcctgggcaacagagtgaaactctgtctcaaaaaatgaataaatgaataaacagaacaaaatttcaatagctgttaggcctcagtacatgagtagagaggtatgctactgctttcaaatagattgcttagggactatgatccaccttatcactctggatccaccacactaagcactagggctcagtaactccactgtctcaaagaaactggtgatttctagcacagttaagacactttatggaaagctgtttcaaaggaaaaggcagctacaacaaaagacaatctgccttgtatttaagaactagagtctagcatgagaaccacaggaatgcaggcaaagtgagcaaagcacagtataacatctagaactgtatgcagtgcaccaatattcaaaagaatcaaaatttgtactctaccttttaagaccatatctgagaacatctgggcaagtttcaataggagagctgtgcctacaccggattttgcagctccagggccccatgcatctctctgggccccaactacaacatagtgatctttaaaaaagaaaaaagaggaagaaagaacttatataatcagcttctaaacttttctagaattagcacatcagtagaaaggtaaaagcacagtatatgtattaaggataaaagagccttacttcaaatctgactaaaaactctgggaattaaaaattcacatgagaatattaattttaccttactagtagagctacttttttcctacactactaattaaatttactgactacttaagtccaaggacttatttcttagtaagtgttggctgtttgattgcatttaaagttaactccagggactggcaaactacagcccgcatgcccattcactacgcacagtctgtgcctgttttcttgctcccacagagttgaacagctaaaagagagactgtatagcctggcaaaaggtttattatctgcccccttaagaaatttgcttatcactggtctagtcaataacttagaatagattttctagtcataatggtcaatttttaacaagaatttcctagggccttattacctcccaataaaactgacacataggctgggcgcggtggctcatgcctgtaatcccagcactttgggaggctgagggaggcagatcacctgaggtcaggagctctgacctcatggagcctgaccaacatggagaaaccctgtctctactaaaaatacaaaattagccaggcgtggtggcgcatgcctgtaatcccagctactggggaggctgaggcaggagaatggcttgaacctgggaggcggaaattgcagtgagccgagatcacaccactgcactccagcctgggcaacaagagtgaaactctttctcaaaaaaaaaaaaaagaaactaacacataaacaattaactttaggacagacaagattgagcacttcataaaaccaagccaagccagcattcctacactcgctccttctctagccacatccttaggaacagaaaagaaaacaaaaaaaaagcggggcgggggggggggggggcggtctttacctggttctacaaagcctttaataactccaaagatgttaagaatttttatctctttcagcacattgctcacagtgagcttcacattcttgctttctgaggttaccatcctacatgtagagtctgttttccagtcagagggacagtctccttccatattcctagaatcagaaagcaggcgtaagttctgagttattgttccttgcccagggtttactcctgtccagtgaagttacagattaagaggacatataaacaaaacttactctcagcccggcgaagtggctcacccctgtaatcccagcactttgggaggctgaggcaggtggatcacaaggtcaggagttcaagaccagcctgaccgacatggtgaaaccccgactctactaaaaatacaaaaattaactgggcatggtggcatgcgcctgtaatcccagctactaaggaggatgaggaggagaatcgcttgaacctgggaggcggaggctgcagtgagccgagatcacgccactgcactccagcctgggcaacagagcacaagtcctgtctcaaaaaaaaacaaaacaaaacaaaacaaaataaaaacaaaaaaaaacttactctctagtggtgaaccatttgcgtcttactttgatctgcaggcagccaattggaaaccattaattaagcaatattttaaaacacttctctaactatgcgcctttctgccagacatacttacgtagtttatatttggaatacataccaagatggactcaaaatgaagttcttctaatatataaaagaatattaatacacttttatgtttcccaactgtcaccactaacaaggatagtacacattcttagctcagttataaaaaatattcctcagctgggtgcggtggctcacgcctgtaatcccagcactttggaaggccgaggcagaattccttgaacccaggaggtggaggttgcagtgagccaggatcatgccactgcactcctgcctgggcaacagagtgagactgtcaaaataaaaaaaaaatcttgtgcttcccctatctaattcctctgtgttacccaaataatagctgctcctaagggggcttacttacataaatataggttgaaacattattactcccctactacataaggataagatgggacgctggcttcacaggttggttacgatttgtaggtggtaggtagaatgagtcaaaaaaatcacctatgctaaatgcctcttagcgttatcaatagtcatggtatgttacacactcccctatgctaaaggcctctcagcatgatcaacagtcatggtatttcatatactccttatatacagatgttcttcatttgagactatcaagtagaatatattttcactatccaattatgttaaagaaacaggatcagagaacctatgtcatacaggagataaatgctttcataaaggcctgaaactagatctccatcctgtaataacaggaaatgataaatatgtccacatccaaatcaaaattaatgctacgtactctaatggaactgggctctgtttttaaagagagacactaacgttacagggaggatatccagaggagcgagccacaaccataaatggtttctctggaaaccatcataagaagcaaggcttctcaatctatagacaaggtaactggaatcataccgtattgcttagaagaaaaatccagacaaatggatgtttcggggaataggattttatcccaatatgaattctaacagattctctctactaactgaatgggctgctataggcatcgtgcttcagcacagaagtacttgagcagaagctatgccaggaatcttgcacaaggaattcactgggtttataagtctccttattctcctgtgtttataagtccaaagtccattattaagatctctttatagagaaaaattcatttatatctgtaccaaggtaacagctaaccatcctccaaattcccaaatgtggaaaattatcatcatgtttaacattttaatcaacatattaccgttcttccctaatcataaaacctcactatgcaagaccgctttcaaataaaaacttacccaaacagcttttctgcagcagctctggagattgtctggacaggtatattaggcaatcctgatgaccgagatggtggaaactgagtgtgattgaaggaagggaatccaggtgtgtaagggtcacctgtccccagatgagcctaggaaaacaaaagagcaattcactccatcacatacttcctcaaaacttctctgtaagattcaggtttggtataaggctgcagcccaaccttagtttaccaacttgaagcctcaaaaatctgagtggctctacaatgtgactcctgttttcatggcatatggaaattctcaaattcaaggcactattgacaaagtacttttagcaacaaataataaagcctcaaagtcaatgtaatctatcttcttgcttactgctaacgccctcccagaaaaaagagcagttaaggaagacacagtgctatttctgctaatacaggaatccaagaacaactcaaggaactcaaaacggtgatttactcaagaaataactcacatgtccaaagaatgaaagttctgcgttaacaatgggaaatttagtctggtccatgtatatcaacacaccaattgcatttaagctttcagcatttgcaacctaaaagaaaacatataaagctcagaaaatgaagatctgatcatacgaaatgagaatacatcctggacattatgctaaaggccaaatggttacagaggactaaacttataatacttccaaatatttcaaattgtttatctggtaatttattaattgcttcctgaaaaattaactcacttgtttgcaaaataagagtaacgggccaggagtggtggctcacgcctgtaatcccaacaccttgcaaggctgaggcagggggatcacaagctcaggagttcgagaccagcctggccaacatggtgaaaccctgtctctactaaaaatacaaaaattaactgggcgcagtggctggcgcctgtattcccagctatttgggaagctgaggcaggagaatcgcttgaaaccataaggcagaggttgcagtgagccaaaattgcgccactgcactccagcctggacaaaagagcaaaactccctctcaaaaaaaaaaaaaaaaaaaaaaaaagaataacaaaggccaggagtggtggctcacacctgtaatcccagcaatctgggaggccaaggcaggtggatcacctgacgtcaggagttcaagaccagccaggccaacgtcgtgaaaccctgtctctactaaaaatgcaaaaattagccaggcatggtggtggtgggcacctgtaatcccagctactcagaaggctgaggcaggagcatcacttgaacctgggaggcggaggttgcagtgagctgagatcacgccactgcactccagccagggtgacaagagactccgtctcaaaaaaaaaaaaaaaaaagaaaagaaaaataacaaaaacccatctaagacaaccacttttttgagtctcactgtcactcaggctggagtggcacgagtcacatctcacaacctccagggctcaagcagtcctcccacctcagcctcctaaagtgttgggattacaggtgtgagccctgccactttttttaaaaatgcagaaatcaccactgtcttttgatatgttccactctagttccttgtgtatgtttggctattaattttcctttttataaaacatgcttttagctgaattctgtatatgcgtaaaactgagttatacagagaaatagctttcacttaagcacttctgattaggtaagtggaacttacttcatttgttgagcattttaataaattatattatctggtatgagagtttaagattgctgattttcagaatgtaagaatattaacaagaaatatcacttacctgaagagtaagataccaaaagtactgtatttaatattataataactcatactcaccttttctgcaaaggtgattttccctgctctgacaatcactatagatccattcacaggagtgtataaatcctcaaaatcttttttagtaccaaaattagcatggaccagtttaccctagaacaaagacattagatttaatgagcattatggtatcggaacagctctaaaatcttgagacagaagagtgttatagatcaaacctaagacaggcaacccaagtaagagataaaaggaggccaaggcctaaaaaagacatgagttctaaaaaactttacaacttttaggtcagagctattggaataaaatcaagatttttggcctcctatgtctttcatgcttttatcccatgctgcctttcatctgaagggcatttagattaaagaggcctatgtaggctggtcatgggactggaggcctggaacaatcttagccttgaggacatcatagaaataggttttaactgaaaggtctgataataaatctgtcccaaaattaaaacaccatctattacaacaaagtgacttgcatacaccaactttagatgtgtcatgatgttcctaagctcataagagtccagatgaacagccataaactgacactaacaaccaagccctcaatacagaaagcttgaagttgaacaaaaatcttcaatgttctttaacagaacaacctacccatctctaaactcctggcttataggcagccaggcaaagggataaagcacaagtatccagaaaggcaaggaatcaacacagaactgcaccagccccgaaaggtatccactagagatacgcctgacttacaaatgtgattttttttttttttttgagatggaatttcgcttttgttgctcaggctggagtgcaatggcgcaatatccgctcactgcaacctccacctcctggcttcaagcgattctcctgccccagcctcccaagtagctgggattacaggcacccaccaccacgcctggctaatttttgtatttttaatagagttcaccatgttggccaggctggtagctctgaccttaggtgatccacccaccttggactcccaaagtgctgggattacaggcgtgagccaccacgcccagccacaaatgtgatttttaagctgaaaattattctatctatctgttctctatttctgtgttaatttgactatatttgcctaaatttaaaaagatcaagggctgggcgaagcagcttcctcctgtaatcccagcactttgggaggctgagggtggtgaatcacctgagcccaggagtttcaattgaagaccagcctggccaacatggcaaaaccctgtctctaccaaataataataataataataataataataataataaaataaaaaataaaaattaactggacatctcagctactcaagaggctcacttgagcctgggtggtggtggagaatgcagtgagccaagctcacgccactgcactccagctagggcaacagagtgacaccctgtctcaaaacaaaaatagaaaaagatcaagcattaacgaatcaagctaagactaggccccagccaagatggatatttacatctgtccccacagggaggatatgcatttgtttagcaaatactactatgtatgtcaggcattctccaaagctctgcaacatggcagtaaatagaactaacccatgattcttcatctggctcacattctaatggaaacaaaggcatagataatgtcagctgctagcagtactataaagaaaaaataaaacaggacatggggaaagtgattagagagagaagacaatgcatgttgactgtgtcattagagggttgaaaaccaaaatatctcatgatcatttacattttacaggtaaatttataactcctaagaacagaaaagatgagttttgaatgattcaatagggaagagtctcatgcactgttttgctttacttacagtaactgttgcagccttactatacgccacataacccccaggattctccaccaggtaaacaagtctaccgttcttatcaactatgatcaccgagttttgagcgctgttaaaaagattaagttaaaataagcctaaggtcatccttccaaaaaacacaatagcttacatttagtatgtcttgcattatttggcttgaggaaatttacctctaaatcttaagcttgatttttattttaaaagcctttgggccgcatgcggtggctcacgcctgtaatcccagcactttgggaggcccaggcgggctgatcacctgaggtcaaaagttcgagaccatcccacctctactaaaaatacaaaaattagctgggcgtggtggcgtgcgcctgtaatcccagctgctctggaggctaaggcaggagaatcacttgaacccagaaggcaaaggctgcagtgagcagagattgtgccactgcactccagcctgggcaacagagcgagactccatttcaaaaaaaagccaacaacactaacaaaaagtctttgctatatttagcacacctgaaaatagctacttgtataaaaataagtttaccatctttcaacatacctgtctttgacctgaatcttaacaaaatgttgatcacgccagactttgctgagtttaaattcacgaaattgattttcaacatacaacgcaagattttcatctttttgagatccagcctcacgagggacatatgaattttcattcagcagcctggaggagaaaatgccttttaaatgaacttaagtttactttaaaataaacatttaagtcaaggattaaacaaattgttttgaaagcaaaatattatccctcatagttcagataaatgaactgtgacccaaaacttctagactgaccagaatatcacaaaagaaaaaaaattttgccccaaatcttgtaacttcaaagcttctttacccactacaaagcactccttcaagagcctcatcataacacaatgtatctgcttaggatagttttaggggaaatgagtagcttccagatctactataaaatctaagatagtaatactgtgctgaacagagtgcatagtttcaattctcacctacttgtgaagcatctgaataccctgaagcagaactgctccttggtccgatctcccatacttctttctatttactcagcatattagttcttacatttttgtggggtggactatactctcactttaaccataaggtctggtgtacagtaaataaacacaaaagcatcaactagatgaagtagaaaatgccataacttaagactaaagaattatagtaccactgtaagtgtaggaagcttgcaaaaaggaaaagataaatttattctttgcacagaggcatgtatgtgcaaagatagtaaaactctatggacaagtgttacagctcttttagaatttgtctagcatgctttctagtttttgccagaaagcccattacaaataaaataaataaataaatataaaatagaaatttggccaggtgcagtgcctcatcctgtaattccagcactttgggagccaagacaggaggatcatctgaggtcaggagttagacaccagcctggccaacatggtgaaatcccgtttctgcaaaaaaaaaaaaaaaaaaaaaaaacccacaaaaattagcagagcatggtggtacaagcctgtgatctcagctactcaggagactgaggtaggagaattgcttaaacctgggagacagaggttgcactgagctgaaatcgtgccactgcactccagcctgggcaacacgtaagactccatctcaaaataaataagtaaataaataaaaatctaagaacagaccggcctgggagacatggtgagactccatctcttaaaaaaaaaaaaaaaaaaattagctgggtgtggtgctgcgtgcttatagtcccagctactcaggaggctatggtagggggatgaagctgcggtgagatgagagcacgccaccgtattccagcctccaccagagggagacattgtctctggatactgactggcctaggggttaatgggtgagtatcacagaaattaagaagcactagagacttaaggcaggcagttacccatgatcaaggagatgaaaaaggctacttctggcatgtgttgcttcctaaaacagagaaaagctactgatgtccttgtcagcaaagcagagcttagtacaacgttacaagaggttaagaagaaaaatcagagccagagaatgacagcaagcaataagctacaaagatggggaaaacatcaagggcctattaattttttaagaaaaaggagactccccagagaagttctaccttttcccctaccagtatagtttcagttttttacaggccccttcccctctttagctaaacatgacaagtcttgtcttctctaacaagccattccccacagtgtcaccattattgtttccccgtggcctatcataattcttgaattacttgtctagatacttgcacagcagctggcactcacttgatggtgccggtgaagtctgtgctgtccagtttctccgacaactttctcttcaggtcatcccaatataagcgacgtgctgcagggaagtcctctcctggctcctccctcactggagactcggttcctgccagtctctcacactcagtttttggttctacccctttacaatagcccaagtagccaatcataaatcctaaagagacaaagttccagagctgaactcagaatttcatttgtaatctatccctgttaatctgttaatattttcaggtaagccttgaaaatactggttttcatcaaattctaagtagttttaaagtatataatgcatctcagttttgtatactttaaaccacttaataaattatatactagctttatttcaaatagctacctattcaaaacataggtagttttttccaaaagacccccttgaaacatgagactgagctgctgcaccgccagtgtcctgcggatattttctagcgtagcatttgcttcctggtggagtgggagcaaacaaaaaaatacataaataaaaagaaaacacttgcacgtcgtattgaaataattcatgggtctctctttccaaccagattaaattcaatgacaggtatagaatctactcatgattgtcttcctagtggcacttaaaaaggcataaagtggacgggaaagtggctcatgcctgtaatcccagcactctgggaggctgaggcgggcagatcacgaggtcaggagttagagaccagcctgaccaacatggtgaaaccccgtctctactaaaaatacaaaaattagccaggtgtggtggtgcacgcctgtagtcccagctcctcaggaggctgaggcagaagaatcgcttgaacctgggaggcggagattgcagtgagccgaaatcacgccactgcactccagcctgagccacagagtgagactccaactcaaaaaaaaaaaaaaaaaaattagccaggtgtggtcgtgggcgcctatagtcccagctactcaggaggctaaggcagagaatcgcttaaacctgggaggctgaggttgcagtgagccaacatggtgccactgcactctagcctaggcaagagagtaagcctctgtctccaaaaaaaaaaaaaaaaaaaataaggtacaaaataactatatgctgagctgacataacagacttcccagagttggttatagaaaacattgaagtttggaatggtcattctcaccaatcaagaaaaagacgatcacagcaatagtcccatagcagatacttccactacacctttttggttttgtgacattggcctttgtgttattgtcagcattttcttcttcatctacagcaagtttcatctccacatgactgttatcgccatctacttgccgagccaggctgaaccgggtatatgacaatggttctccaccaaactgtgttgcggaaaaaggcatgatgaagaacaggcacgggaatgtttaggaaaagctcgtttaggtatatgcttgttattgggccattactataacttgctatatattccttagggtgttctcctttcaaaccaacattcttccctgggcccagtcaagggctagttcacactggtcttctcagtcagtctctccctttttgtaaatttttttttttttttgagacaaggtctccctctctctcccaggatggagtacagtggtgtgatcacagctcactgcagcctcaaaatcctgggctctactgattcccccacctcagcctcctgagtagctgggactaggggcacaaatcagttcaggatactatgcagtaacccagaccatgatgttggtgggagcaagggagcaagaataaaacaaagttataaataagcagaaattctgactaagcataagatagaagacagaaaagagagaatagaccagacacagtggctcatgcctgtaatcccagcactctggggggggccgaggcacacagatcatttatggtcagaagtttgagacaagcctgaccaacatggtgaaatcccctctcactaaaaattcaaaaaaaaaaaaaccactagctgggcatggtgtcgcacgcctgtaatctcagccacccaggaggctgaggcaggagaatcgcttgaactcaggaggcggaggttacagtgagctaagattgcacactgcattccaacctgggcaacagagcccaggctgagactccatctcaaaaaataaaataaaaataaataaataaataaatacaaataagagagaattgaggtctagacagagtgttaagagttaggctccttctcgtcatggcctggatggctgttttttttgtatgttctttcagctttcactcatactgtctactcaatgtttcttaaaatttcattttttttttaatagagatgggcttgctatgttgcccaggcaagtctcaaactcctcaagtgatcctcctgcctcacctcccaaactgctgggattgcgggagtgagccaccacacttggcctcattcagcctttgcttttttttttttttttgagacggagtctcactctgttgcccaggctggagtgcaatggcgtgatctcagctcattgcaacctccgcctcccgggttcaagcaattctcctgcctcagcctcccaagtagctgggactacaggcatgcgccatgacactcagctaattttttttttttttgtatttttagtagagaccgagtttcaccatgttggtcaggctggtcttgaactcctgaccacaggtgatccacccacctcagcctcccaaagtgctgggattacaggcgtgagccacagcgccccgcaagcctttgctttttacttctcctactaaaacattttgatcagggctttaattcgtcttatctactaagctgtccccgtctaccacacccagaaccactctgagaattcttccaagactttccataattaaccctactgaaggctgaactctttgtgagatcagttatgcctcaagactaccaattcaaatgtaaatgaatacctgataatagattggggttattatttcatgcttactcagttaaagtcatgcttgtatatttcacattcttgcagacacagaaatacaactgaaaatatcttaccaagttagagaatgctgatctagcttgatccatcattctgaactgccacacagaagaacctaggtatcagaatagagaattattgagaaagatactactgtatcagattagtgagctttctattaccaggctaaatgatacattaaatttttaaaatacattatcacttttctagaaaaggtatttaaccatagtttacatgacaactaaattaagtgggatcctttttaaagtttgttatatacataattctttttttttctttttgtagagacaaggtcaccctatgttgcccaggctggtcttgaactcctggcctcaaacaatcctcccaccttggcctcccaaagtgctgcaattataagtacgaaccactatgttctgagtagacaaaagtgacacatactgctgggcggggtggctcacacctgtaatcctagcactttgggaggctgagatgggtggatcacctgaggtcaggagttcaagaccagcctggccaacatggagaaaccctgtctctactaaaaatacaaaaattagccggacgtggtggtgggcgcctgtaatcccagccactcgggagcctgaggcaggagaatggcgtgaacccaggaggtggagcttgcagtgagccaagatcgcgccactgcactccagcctggaaaacaagagcaaaactctgtctcaaaaaaaaaagaaagtgacacatacaaaaagacaaaattaagactaaggcagacaagaccagttatgctacaaataccacaaaccatctccaatgggaaggggaagaaatactgatcctgactgaatgaatagttcctacaagtgattcgatctttgacacaagaagaaacatgaaacacagattacgctgttttacagatgaagaggccagttattagagaaactaagtggcctgttcaaggctgaaaattgataatctaagcgaagttaaatgggttactgggttatagaaattgtgttatcatctctggaaatttaagacattaaccttaacttttgtcaaagcaaaatacatctctgtaatcaaagtcctaagttaagttaaaggccttaactgaaatctgaattttccagttaatttggtttgagggcatctagatacttgaaaatgacattatcctgagatttgcaaaatggacatttattggataccattttaaagcttttcctatatacgagtacacttagggcatattaaacacacacggcacaaagcaagctgtgaggtatacgcaaattgtaaagcaaagggtattataactggcattaagaaaaagctttctggccaggcacggtggctcatgcctgtaatcccaacactttgggaggccgaggcaggtggatcacgaggtcaggagtttgagaccagcctggccaaggtggtgaaaccccatctctactaaaaatacaaaaattagatgggcgtggtggtgggcacctgtaatcccagctactggggaggctgaggcaggagaatcgcttgaacccgggaggtggaggttgcagtgagccgagatggcaccactgcactccagcctgggtgacggagtgaaactccatctcaaaaaaataataaaaaagaaaaagaaaaagctctaaaacctattacaaaaaattctttttaaattcaagctttaaaaaccagtgtccatatgcaatagaccatattcttagaagcataatctttttttttttcttgagacagagtttcggtcttgttgcctaggctggagtgcaatggcaggatctcggctcactgcaacctccccctcccgggttcaagccattttcccacctcagactccgagtagctgggattacaggtgcccaccaccatgcccagctaatttttgtatttttagtagagacgggattttaccacgttggccaggctggtctggaacttctgacctagggtgatccacccacctggcctcccaaagtgctaagattagttacttgataagaacatcccaaggaaatcgaaggcgtgagccactgcgcccagccagaagcacaatcttttgccccttctgttacaaaaagcttatcactaccactccaccagaacagtaaggacccaatcattagagccagaactggaaggccccaccctgaaccaattttaatcatccttttctaggaaaaaacatcttgcaagttttaacactcatctgaaccatcattcctcaagttttcttgttttaaattaattttaagaacacaaagcgatggccgggcatggtggctcacgcctgtaatcccagcaacactttgggaggccgaggcgagcagatcacctgaggttgagagtttgagactagcctgaccaaacatggagaaatcccatctctaccaaaaaaatacaaaattagccgggcatggtggcgcatgcctgtaatcccagctactggggaggctgaggcaggagaatcacttgaacctgggggaggtggaggttgcagggagccgagatcacaccattgcactacagcctgggcaacaagcgtgaaactctgtcaaaaataaataaataaataataatctaagctacttgtgttatctttggtgttctcaatggtgactgaaaacaacaattcaatttctcacattaataatgaagctcaggtaggcaaaacgtagccccacgttttgaaccatgaaatggaacacattcactgcctaacaacttcactaccctctattttctccaaaatcagacagaatccagcccctgtttttacccaccaacattcttctctgttccttgaggtcctcctcatttcttccaggctcagctcaaggcttcatctctatgaagccttctctgactgacttccctatcctgtaataactggtattgaactacctgataatgagtaaaaatattgtctttaacagtactggggcatgcctgatgcatgagattccaaatgatatgaaaaatataatgaaaacattggaccaggaatcttttcccgtccccatcactcttctggtttagtagggagtttttttgttgttgtttttgagatggcatctcgctgtcgcgcaggctggagtgcagtagcacgatctcagctcactacaacctctgcctcccaggttaaagcgactctcgagcctcagcctcctgagtggctgggattacaggtgtgcaccaccatgcccagctaatttttgtatttttcgtagagacggggtttcaccatgttggccaggctagtctcgaactcctcaccacaagtgatccacctgcctcggcctcccaaagtgctggaattacagacgtgagccaccatgcccggctaatttttgtgtttttagtagagacaggatttcaccatgttagtcagactggactcgaactcctgaccttaggtgatccgcctgccttggcctcccaaagtgctgggattacaggcgggagccaatgcgcccagccgagggtcatttttaactagcattgtgatcgattcaggtttagctgggaatcttgctccatgacatttaaatacattatcagaggcaagtaactgcctcgccttagggcggagttagccaaactgctgtctatctaacaatcttcaacacaggctaggtttacagccaccattacttgataagaacatccaaaggaaattgaaggatgctatgctatatataaccttgcaaaatcgatgacaaaaattatcttaactctgagttttcttgagaagcatattgtaacccaaaattcagggccggggggcggggggaaccagcagggtccacaagtactctagacagcctaaccttaattttcacagtaagcttagcatataagcatggggtagccaaatacaatttcctactttaatcctcttatcaacggggaagaaaatggaaaaagctgcagaatccagtcccccgggtaagtgaggtctctacaagcagtaagcagagggaaagcgttatccgaaaagagccgaatcagaatgtattttcttacccaccctcccaaccttaaaagaactgtccagcagaatgtgacacaatcggcctctccggcgcccatcaatccagcacagccctctgaccacaccgctaatctccaagtatctttcacaaataagtcactcctatggctcccgtcttgtagtgagaactgctagcaatattcttaatgtgaacacctgcggcgttcagtcggattctgccttgagaaaacagaatccacacacaaggcgaacaggcagagcatggcaagatcaggttgtaccagagccgaagggtaagtttacagaaacccgtatctaattaatgcctgtaacacgctagtaaccgaatcggggacagctttgtccctttccgcagtgagaacggggcccgcccggagcccggggaaccgaaggtttaggagcccaaggtcacccacgaatcccagccgttccctggggcgacttcctggagcagccacgtgttcccccggcgccgcacgccgcgcagctgcaccttggctgcgcccgcgctcccggacccgcagcccggagccggcgcactagggcctgcggccttcaagggcgaggacccgaagtccccggggctgagagcgacagtgggggtacacctggtctcgtcattcgtcgctctgtgaccgaggaggcgggcaagaaggcagagagaagggaagggacgagaggcgaagggacgagaggcgcagggacgcctctgcgcacagccgccgaccccgtgtacctgcagccgctcgaggcgccgccacagccccttccccacaggctcgcggccccgctccatcccggccgccccgcctggggccgcgaccgctttcccgctccccgtgcggctccctatggctgctggacagcaccggagcggccgctccagccagccccgcaggatgaagggaggacacgagggtcggtgtagttctagaagcccgcactcacactagcgcgtcctccgtcccgagccgccacccgatatcccgacgctct

SEQ ID NO: 1454 - DNA, 32879 bp, Homo sapiens
ctcagtgtttaagtattttattaaatcagacaaggaatctccacactgttgcacataacagcttttatacaatgataaggacatatcatttgtttacaaagaaagtctaaaatttcaagaacattcaaagagctaacacagtaaaggtcatgcaagttctagaatagtgaatcatgacagaactcattcattttatcctttacctccaaaaggcccatctccttaacgagaagacatctcaagaccaggagcttgtcactagtctgatatttcattcaggaatattgagcctgttagcacgtactggcttgataggaagtaactcaaccctaactgtagaaaagggttttctgaagagactcactgctgcaaaatgcatgccctgtattcatattgtgttatacgatgaacatgccacatgctttcatttaagtacgtgtgcgtaacacccgaaccaggaatctcagctatgaccttttcacttagctacgctaaatgtcagtccaagataaaagaggagattaaagataaaactgaagattaaagagactgtgagtagtgacacattcaagtgaggctgtaaatctaggtaagtgacactaagaacctgaagagaccctatgaacttttccctaggaggccgtttccaactgccctatgacaaacagctgatcatcacgtttataatgatggttcactcacggagcttcgaacttattcatacctacatttaattgatcaccacgaatgggtaggcagacgtgtcagaccttcaggggactctccttccccacagcccccaaaccttctatacaaagtccctctgctttaagtcaaaaggtcaattctggattaaaacttgtccgcactaagtttataggaggtaacatgcaaataatgtgataaagttaaaatgacttgtcaatagcaaacattataaatgtatgctactatctcattaagtagaggacctggagaaaccataaaggtaacaaaaacccaagctaaatttcaaattttgtagtaatttcattttacagtggttgaatttacccacccaatgcttaatgaccacaaaatgtttctgcaactaaaactaaaagatagggaattataggagttgggatacatgttagatactaacgatcttcaagctttgaagatgtcattgcatgaagaaaattatgggaaacactgttcccgataattacttacacccttagtgtaacatatggagatcactgtctccgatacagacactgtggtaggtaaaaactaccttgttctttatacattatggaagacactgctcccgataatgtgttaggattgtgacaaaggtactggaaattttgcaaaatgggaattagagttacaccttggataaactgagctataaaattttgcaggagtactaccacagcctttaagtgacattgatttataacttggtcacaattcactgcatttaggaaaaccagcattcttatctggtcagtgctcgcttcttagcaacccctaattaaatttaattcatctctaaatcttagcttcaactttattcaattacatttggctgacggctgttttctaaaacccttaagtgttgaccataaatgcaaaacttccagtatctgttgggttttattagcagatgctgcttttatttaaaaaaaaccgacagtataactgtcataattatggaaggcactgcttccgataattatattctattaaaaaaacaccatttatagtgaactctgtcactgataaataaacaataaatatctcagtgccaaaaggacagaaagctctcccctaagattaacactttggccaaaatttggcagcatattattctttaaagtctgacaaactgagtctgcaactaaacacctgaaactggttctctttcaatgtgctttggaagaaacaaaaataacaaagaactaaatggaggcttatgggggaagggacagaggaaaagaaaatatactaagtctttggcttctggtcccctcttttcataaatgacactgaggttaacatattaaggccttattcctgcaatcaacagttgaacctcattttatccagcagaaggacctccatttcagacctcattggcaagaaaacaagcccatctcttctgaaagttaactgtttctttcaggaatgaggaaaccagctacattccttatggaaaggcttagatctcatttggagaaggtctttcaacctggtatctcctatttagcatcaaatgaagttggaggatcactcaaagtaagcgaccacttacaaccttcagcagagaccagcccttaggattcagagagatcattcacataactggtttctgacattttcattaacaacaacaggaaagaggcagttcccattacaaagcacttaaaattctagagataggggaatattccatcatggacattttttaagtggttattcactttaacttgaagtacaggttatctaccctgtattaaaagctgctgcctaaagacatctagtagtaccaagatgatgggatggaattttaacatcaggttttgtagccctactgaaaatttagcacgatcagcacaagtctagaaaccagactaccctgctgttctcatggaagctatgggtatcacatttaaaactcattgtcaatgtcccaaacgtcaccagagagggcatttgcagctccctgaatagtccaagtagctagagccaactggtttctgaacagcgtttcattaaaagcaccgttattttgtttacgcagtttcaagttctccagtaaagctggcagcgtgtgagagccggagccccagaagacatgtcggaaaggagactcttttggagatacgtagggagagaggaagtgatactccacctacgaaaacaacacacaaggcaatttacacagccctgtgacttttgtagtaaaacaacagttcacttcaaatgtaaaatgtcccaaatttaagaatgccgatcagactttttttttttttttttttttttgacacagagtttcgctcttgttgcccagactggagtgcaacagcgctatctcggctcactggtaccctccacctcccgagttcaagcaattcatgctgggattacaggtgtgagccaccgtgcccggctttttgttgttgttgagacagagtttcgctcttgttgcccaggctggagtacaatggcgcgatctcagctcactgcaacctccacctcccgggttcaagtaattctcctgcctcagcctcctgagcagctggaattacaggcatgcaccaccacgcccagctaatttttgtatttttagtagagatggggtttctccatgttggtcaggctggtcttgaactcctgacctcaggtgatccgcttgcctcggcctcccaaagtactggaattacaggcatgagccactgtacccagccagctgatcagactttctatagcagagtaaggaaaaaagaatgctgagaaccaggctaatgctaatcttctaaggttaaaattctaaaggaggctaggcacagcggctcacgcttgtaataccagcactttgggaggccaaggcaggtggatcacttgaggttgggagttcgagaccggcctggctaacatggtgaaactccgtttctactaaaaatacaaaaaatgagccgggcgtggtgttgggcacctgtaatcacagcaactcgggaggctaaggcaggagaatcacttgaacctgggaggtggagggtgcagtgagccgagaccgtgccattgcactccagcttgggcaacaacagtgaaactctgtctcaaaaaaaaaaaaaatttttttaaaggaaactgattcattttacaaaggaaaactttaaatgtgttcagattcttttccccattggagcatacatggaagttttacagcaagtctcttccaaaaagactaggtttgactaagttctgaattagacagcagaaacagaaaatgacagctaaaccattaatgctcccttcttaaaggaattctagactcctagagtttgtccactttgcagaagtgtaagatttatcggttattttacacatactttagttcctcctttcccaaaagttcacttactctcatgacacgatcattgagtttcttcatgacaaatctgtctgttttctcagcattcccgaaatctgttgttagtctggaagtagcacggaagaagtctccacgagcagaatacagccactgtaaactcaggcccatttcctgaaacagacattattcgctatgagaagttttatttctaaggacattcttttgtatgcctttctaatttaacgtgcgttaagtaagattctgataaaaggaactcgcagataagctcaagactccgaaagcaccttgcacaggggttccaagctctatggactgtgatatacactcatatttgagcccagcatgtaagaaaaccattctcattaagaaattgaacataattatataatcctatgtactatattgtttccagttcaattctccttttgggggaaaatgtccctataggggaaaacattttggttcaaggtacttcaggatttagttatttccacctggtaagttccattttcaacagttacaattagtttcaagaaagacataagatgccgggcgtggtggctcatgcctgtgatcccagcactttgggaggccgaggtgggtggatcacctgaggtcaggagttcaagaccagcctggccaacatggtaaaaccccggctctactaaaaatacaaaaaattagccgggcgtggtggccggcacctgtagtcccagctactcgggaggcttaggcaggagaatggcgtgaacccgggaggcgcatcttacagtgagccgagatctcgccactgcacttcagcctggccaacatggtaaaaccccggcttctactaaaaacacaaaaactatctgggcatggtggcacacgcctgtaatcccagctacctggggagccgaggcaggagaatcgcttaaagccgggaggtggaggttgcagtgagccgagatcatgtcattgcattccagcctgggggacaagagcgagacttcatctctcaaaaaaaataaaataaaaataaaaataaaaaagatataaaaagattcggttgtcagtgatttacttcaattaagagatctgttaaaaatcaactcctagtaccataaaacaatctggaagctactttaatattagttttattaatttatttagagatgggattttgctatgttgcctgggctggactccagcaatcctcctgcctcagcagaagtagctggggctacgggtatgcaccacctcaccctgcttatcagtttcgtttaatagaatatttgacttttagatgcgcagatcactacgagatggaatcctgctagctgtgctgtctttccatccgggtcacgcccgagaggcacacagcccaactccttgctgagatcttcatattccgtgtcctactgacgggctgcctgggagacatgagtgacagaaaacctgacactgctctggattctgaaacacctgctgagctctgtcctaggtctctaatccacagcctcccgacttctctcaaacaagttaccaattctacatacaattatacctcagttcactttaaaatgtactatggctacaatcacccttccaacaggaacacacaggaacacatcacatttcaaaatacttgacattcagcaaaataaaaacgtaattggaatcagtgctcacctttatgtctgctctgtattggttcagatccctcacaaatgaaagcagttggctgttgtacctctcatagtccaggttcaattcaacatcatgggttagtttaatcacgaactgaccagcgacctctgcagctgctcgtgccactttgttcaactcaggaatcctctcaatcagttccttataggtgtccatggtggtacccaaataaggataatctgtgtcctgcaagacaacgcgaggctatggtactcacgtgagttctaagagcaagagcctcacattctggcttcgccatcgaggtaacagtgacgacagttccacccttgcttctaacatattcctaccgcaatttaccccaattctatctcattatctgctgctttaagtacattcttgctacttctctcaagctaacctactcctagagtgactactttcttccaggttctacagaatccctgttctatcgtatcatatgccctgaatagacttctagccaaattccttaaggctgtatgtttttctctctgggaagtttgggcctttatcaatgaaaaaagagaagatacatgaaacataccttgagacgaggtctctctgtcacccaggctagagtgcagtgatgcaatcacgactccccacagccttgagacaaggtctctctgtcacccaggctagagtgcagcaatgcaatcatgactccccgcagccttgagacaaggtctctgtcacccaggctagagtgcagcgatgcaatcatgactccctgcagccttgagacgaggtctctctctgtcacccaggctggagtgcagtgatgcaatcatggctccctctagccttgagacgaggtcactctgtcacccaggctagagtgcagtgatgcaatcacagctccccgcagccttgagacgaggcctctctctgtcacccaggctggagtgcagtgatgcaatcatggctccctgcagccttgagacgaggtcactctgtcacccaggctggagcgtggtgatgcaatcatggctccccacagccttaagctcctagctcaagtgacccccctgcctcagcctcccaaggagttgggactacagctggccactgggccacttaatttaaaaaattttttgtagagatatagtctaggcacgttacccaggctggtctcactcctggcctcaagtgatctgcccacctcagccacccaatgtgccggaattataggtgtgagttactgcacccagcctgaggaaaatactgttcagctggactgtccaatagatagccactgctcaatcactcaagaaattcagccttggttttttttttgttgttgttagacgatcttgctctgttgcccaggctagagtgcaatggcacgatctcggctcactgcaacctctgccccctgggttcaagcgattcttccacctcagcctcctgagcagctgggattataggcatgtgccaccatgcccagctaatttttttgtatttttagtagagatggggtttaaccatgttggccaggctggtcttgaactcctgacctcaagtgatctacccgccttggcctcccaaatgctgggattacaggtatgacccaccacactcggccaagcctcattattaaaactcataaagaagttttagcaataaactcaaatgctaattaagctaattgagattaacaagtctatgttaaaactaataatgaaggaacatgcaataattacatgtgtataacttttttttttgagacagggtcttgctctgtcacccaagctgcagtgcagtggctccatctcagctcactgcaacctctgcctcccaggttcaagcgattctcctgcctcagcctcctgagtagctggggttacaggcacacgccactatgtccgactaatttttgtatttttagcagagacggggtttcaccattttggtcaggctagtctcaaactcctgacttcgtaatccgccttccttggcctcccaaagtgctgggattaagggaggagaccacccctcatattgtcttatgcccaatttctgcctccaaagaaagaagaagtaaaaactaaaaggcagaggtggacagcccagcgctgccgcaccctggtcctggttaaagatcgagccctgacctaaccagttatgttatctatagattccagacattgtatagaaaagcactgtgaaaatcccgtcctgttctgttctgttctaattaccggtgcatgcaacccccagtcacgtaccccctgcttgcccaattgatcacgaccctctcacgcagactcccttagttgtaagcccttaaaaaggtcaggaattgctcactcggggagctcagtttttggagacgtgagtcttgccaaagctcccagccaaataaagcccttccttctttaactcggtgtctgaggggatttgtctgcggcttgtcctgctacaggattacaggcgtgagctaccacatccagcacatgtgtataacttcttaaaacattttaagcactgcagtaaatttggtctcaaagttgacacaagaagatccatggccaggtgtagtaagtagctcttgcctataatccaaacagtttggaggctgaagggggaggactgcttgaggctgcagtgagccatgatcgggccactgcaccccagcctgggtgacagagcaagtcaccattgtcaaaaaaaaaaaaaaaaacaaaacaaaaaacaaacaaaaaaaacccaacaactaagatatgtgcaagttgtcaaaatcaaaatggagtcactagtgttaacaaaaatgcaaccctgaagagaagggtctcacccttgtatgtctgataacaaggattaagggtttttttttttcctttttacaaaaactacaaccttacacaaaggccactgcaaccttgcaccaaaaaacttctctcgtgagaaaatctgcctagcaactgcctgtcaaccttggactggtgtcatccttgttattgatcttggtagccaagaataattacctcaaagtaattttgtaatcctcgtcatttgtccttaaaaacttgttttcctttactcctctgaatatgtacatagttgactatagcacaggcattcccattgcaatgccctattcccaaatacagatcacttccttttagagagcctctctccatttgtcatttaaatgaacagacttacctcgcaaaaacagaaagaaactgctgggattccagaatatgcaaggaaagggaaagcagcattgtctaaagtgagtttctcactgcaaagacaaagaatgtgtctttagaaagtgttttaaagaatagactgttctatcgtgctagtccccccatccaaaataaattctttagctgaatatctttaggtgtaagtaagttcaatgcaaggacagatttagattctacctaatgtagtaggtagaatctctgcttttctattagtttgttcattcacttttctcaacttacactttgctggcccagttgctgtcctgatatagaaattgcccagtaaccggatgcttcacctgtaagataagaaattatcattaaaactaaccttttggaacttatttattcaggctagtcactaacatgttactctataacaatttttaaataaaaaacttgtattatatcttcttgaaaagaaattatttatgatagttaaaacaatctcaactttaagttattactaactaggctcatgttgtcagttcctttagttatggtgaggaaaaaatgttttcttcttaattaacattttaaaagtgggcctaggccgggtggggtagttcacaactgcaatcccaacactttgggaggccgagctgggaggatcacttgagcccagaagtttgagactagcctgggcaacacagcaagactttatctcttaaaaaaaaaaaaggaaaaaaaaatgaataaaagctgggcgcggtggctcacacctgtaatcccagcattttgggaggccaaggtcaagagatcatgaggtcaagggattgagaccatcctggccaacatggtgaaaccccgtctctactaaaaatacaaaaattagccaggtgtggtggtgtgcacctgtagtcccagctcctcaggaggctgaggcaggagaatcgcttgaacccaggaggtggaggctgcagtgagccaagatcgcaccattgcactccagcctgagtgctggaggaagacagaggaagactccatctcaaaaacaaacaaacaaacaaacaaaaccatggtggcttacccacaattgtaaaagccctctctgggcttcacactatgcctatcttgtttctggtttcttccttctagtgcatcttatgccaccaacctaactggcaaattcatgatcaccttgcttgagatcctataatccctagtatctcttggatcaaggccaatgtctgctatctgacctgtttctaactttactcactccaatatacagcctctaatcccattaggcaaatattttcttttttatttatttatttattttttttttaattatactttaaattttagggtacatgtgcacattgtgcaggttagttacatatgtatacatgtgccatgctggtgcactgcacccactaactcgtcatctagcgttaggtatatctcccaatgctatccctctcccctccccccaccccacataggcaaatattttctttcacatgctctccctcattcaaaactatggtaattgtttattcaatgaatatttcctccggccttctcaaagtatagttcaagttgatttaagccttccttagcattgtgactctatagacaatcccctgtgggcccctgcactacagcttaggcctcatggcattttgttatatattcctaaataaacaacatattctttaagattggagccctcatctcatatggttcaataggcaagtatcccttaaataacgctgctataaaatttattctcaattcctattttttgttactgactacggtttacatatcagtgttttttatctcaggttgattcaacaaaaattaagtcatacatttttgtaatgaggtatatactcacattttgcattgttttctcaataagcgtatacaacagtgggctggcagaaaccttgaagttgctggtacctgaaaataaattgttttatcattgccccttctccattccgataattttcacactgctacttctacaactataagtacttgacaaataagacagtaatctagatcagtggccctgtgcaacaactatcccattcatcaagtaaacaaaagtaattttggtatcaagctctttagcaactaagctaacttcactcaagtgggctcgtactactccttgagtttgcatactttaatccaagtcaccttttttaaaaatatcagagcagttaggccgggcacggtggctcacgcctgtaatcccaggactttgggaggcccagacgggtggatcacaaggtcaggagatcgagaccatcttggctggcacagtgaaaccccgtctctactaaaaatacaaaaaattagccgggtgtggtggcgggcacctgtagtcccagctactcgggaggctgaggcaggagaatggcatgaacccgggaggcggagcttgcagtgagctgggatggcgccactgcactccagcctgggtgacaaagcgagactccatctcaaaaaaaaaaaaaaaaaaaaaaaaaaaaatcagaccagttttaggttcagcagcaaaattaagagaaaggtacctagaggtcccataaatccactgcccccacacatgtgcagcctcccccattagcaatttcatgtttaactttctggttcacccaggttagagctatacatagtatgcttgctatactcagcacattctgcggcaaacatacaacagggaaataactaacctagagaggtttaattgtaactctttccttttttcccccatgtagacatttcactattctcagctcatcagctacatctgcactttcttttttaccccattcctgttgaatgtacagctgcactttaaataacattcaaacccttttgtcaattttctgctgccagtgaacattcaaactcttctagaagtttcattatccaatatttctatcagtgatgccacaacgtaacaggatgtgaattactctctaagtaccattctatatggcatagtttagtttcttctcacctcaatatagtccagacttatggtcctaaaactttagtccatcagaattacctgtagtgcttgttaaagttttttgtttctttgtttgggtttttttgcttcaggatactttgtccttaagaaaataataggtttttattccccaagggttgccaaaaaaaaagcccagtttttttgtttgtttttttgagatggagtctcgctctgtcgcccaggctggagggcaatggcgccatcttggctcactgcaacctctgcctcccgggttcaagtgattctcctacctcagcctcctgagtagctgggattacaggtactcgccaccacacccggctaattttggtatttttagtagagacggggtttcaccatgttggccaggctggtctcgaactcctgacctcaggtgatccgcctgccttggcctcccaagtgctgggattacaggcgtgcaccactgcgcccagcccaaaaagcccagtttttagaccaacactcccatttctgactcaaaggtctggggtagacatgacagtttgcattcgtaacagttcctaatgctactcatctgggggccacactgagaactacccactgttctagacaagcaattgtgctcactgtgtaacttgacagactatttaaaggaaggttaagatacaggctgagggcaatggctcatgcctgtaaccgcagcattttgggcagctgacatagaatgcttgaactcaggagtttgacaccagcctgggcaacatggcaaaaccccatctctacaaaaaaaattagccaggtggctgaagtgggaggatcacctgagcccaggaggtcaaggctgcagtgagccaagattgtgccactgcactctagcctgggcaatacagtgagaccctgtctcaaaaaaaaaaaaaagctttcttccacttcaaagtagtttatctggccaggcacagtggcccacatctgtaatcccaggccgaggcaggcagatcgcctgaggtcaggagttcgagaccatcctggccaacatagtgaagccctgtctctactaaaaatacaaaaaattagctgggtgtggtagtgagcacctgtaatcccagctactcaggaggctaaggcaggagaatcgcttgaatctgggagacagaggttgcagtgagccgagatcgtgccattgcactccagcctgggcgacaagagcaaaactccatctcaaaaaagtttacctgaattcatacacagctaatgaaagggatacttaccaagaaccgctttatccagattaatataagtgaaagcctttaaatgcagggacgaaaggtatccctagaagagaagggaaaacactaataagtataaatctgtttatttatcacatacagtagcattagggattcattttcaattctggactctactgagactaaacgcaaaggcaaaagtggtaaaatcaaacctataaaaacatcacttctggacaacagcctaagcccacaagctcgtgtccaatatgggaagggatgataaagaatacctctagccattcagtggcaccaaccgatccaaagtctccagcactccaactggcaaagataatgcttctgctgggctgaaacccatctgaaagagaaaaaagttagctttacctgaggaaaggttatacacagacaaggatggaaggtatcccacttaagatgaatcagaaggtctaattccaagatagcagattccaaaatcttttttttctgagccaaaaaagaaaaaaaaaactaacaaaatctttttttgagaccccaggtaaaagaataaaagaataggaataattttttttaaagtaacctacaaagagcaagataggagatctgcaaataagattttgagtacatagcaggggccagtagtcaccctttcacaatttcattcttggagttccttaacttctggacccagagatcattgaaaacagtgtaagcatgatgatgcacatcttgagaaaaatcttcagaggtaaatccaaacattggatttttaaaaaaataattctaaaataaaataaaaattcacaaatttaagttacaagaagagtttgcagagaaactatatttgtgacagcaccttttgaggttacatgtatcacactgccctccatccctcccacttccctcactgtatctttttctccattaatgtactctgtattaaagttaagcattgcagtttgccctaagacccaaagattcaagaatgtgacgtgattttgaatgtgtgggtgggtaggagtgtgaaagagtggaaagtaggacagaaaggctcaaaaataaacaaaagaggcagggcacggtggctcactagcagcattttgggaggctgaggcgggtgaatcacttgaggtcaggagactagcctggccaacatggcgaaaccctgtctctagtaaaaatacaaaaattggccgggtgtggttgtgggtgcctgtaatcccagctactcaggaggctgaggcaggagaattgcttgaagtcgggaggcagaggttgcagtgagctaagtgagatcacaccactgcactccagcctgggcaacagagtgaaactctgtctcaaaaaatgaataaatgaataaacagaacaaaatttcaatagctgttaggcctcagtacatgagtagagaggtatgctactgctttcaaatagattgcttagggactatgatccaccttatcactctggatccaccacactaagcactagggctcagtaactccactgtctcaaagaaactggtgatttctagcacagttaagacactttatggaaagctgtttcaaaggaaaaggcagctacaacaaaagacaatctgccttgtatttaagaactagagtctagcatgagaaccacaggaatgcaggcaaagtgagcaaagcacagtataacatctagaactgtatgcagtgcaccaatattcaaaagaatcaaaatttgtactctaccttttaagaccatatctgagaacatctgggcaagtttcaataggagagctgtgcctacaccggattttgcagctccagggccccatgcatctctctgggccccaactacaacatagtgatctttaaaaaagaaaaaagaggaagaaagaacttatataatcagcttctaaacttttctagaattagcacatcagtagaaaggtaaaagcacagtatatgtattaaggataaaagagccttacttcaaatctgactaaaaactctgggaattaaaaattcacatgagaatattaattttaccttactagtagagctacttttttcctacactactaattaaatttactgactacttaagtccaaggacttatttcttagtaagtgttggctgtttgattgcatttaaagttaactccagggactggcaaactacagcccgcatgcccattcactacgcacagtctgtgcctgttttcttgctcccacagagttgaacagctaaaagagagactgtatagcctggcaaaaggtttattatctgcccccttaagaaatttgcttatcactggtctagtcaataacttagaatagattttctagtcataatggtcaatttttaacaagaatttcctagggccttattacctcccaataaaactgacacataggctgggcgcggtggctcatgcctgtaatcccagcactttgggaggctgagggaggcagatcacctgaggtcaggagctctgacctcatggagcctgaccaacatggagaaaccctgtctctactaaaaatacaaaattagccaggcgtggtggcgcatgcctgtaatcccagctactggggaggctgaggcaggagaatggcttgaacctgggaggcggaaattgcagtgagccgagatcacaccactgcactccagcctgggcaacaagagtgaaactctttctcaaaaaaaaaaaaaagaaactaacacataaacaattaactttaggacagacaagattgagcacttcataaaaccaagccaagccagcattcctacactcgctccttctctagccacatccttaggaacagaaaagaaaacaaaaaaaaagcggggcgggggggggggggggcggtctttacctggttctacaaagcctttaataactccaaagatgttaagaatttttatctctttcagcacattgctcacagtgagcttcacattcttgctttctgaggttaccatcctacatgtagagtctgttttccagtcagagggacagtctccttccatattcctagaatcagaaagcaggcgtaagttctgagttattgttccttgcccagggtttactcctgtccagtgaagttacagattaagaggacatataaacaaaacttactctcagcccggcgaagtggctcacccctgtaatcccagcactttgggaggctgaggcaggtggatcacaaggtcaggagttcaagaccagcctgaccgacatggtgaaaccccgactctactaaaaatacaaaaattaactgggcatggtggcatgcgcctgtaatcccagctactaaggaggatgaggaggagaatcgcttgaacctgggaggcggaggctgcagtgagccgagatcacgccactgcactccagcctgggcaacagagcacaagtcctgtctcaaaaaaaaacaaaacaaaacaaaacaaaataaaaacaaaaaaaaacttactctctagtggtgaaccatttgcgtcttactttgatctgcaggcagccaattggaaaccattaattaagcaatattttaaaacacttctctaactatgcgcctttctgccagacatacttacgtagtttatatttggaatacataccaagatggactcaaaatgaagttcttctaatatataaaagaatattaatacacttttatgtttcccaactgtcaccactaacaaggatagtacacattcttagctcagttataaaaaatattcctcagctgggtgcggtggctcacgcctgtaatcccagcactttggaaggccgaggcagaattccttgaacccaggaggtggaggttgcagtgagccaggatcatgccactgcactcctgcctgggcaacagagtgagactgtcaaaataaaaaaaaaatcttgtgcttcccctatctaattcctctgtgttacccaaataatagctgctcctaagggggcttacttacataaatataggttgaaacattattactcccctactacataaggataagatgggacgctggcttcacaggttggttacgatttgtaggtggtaggtagaatgagtcaaaaaaatcacctatgctaaatgcctcttagcgttatcaatagtcatggtatgttacacactcccctatgctaaaggcctctcagcatgatcaacagtcatggtatttcatatactccttatatacagatgttcttcatttgagactatcaagtagaatatattttcactatccaattatgttaaagaaacaggatcagagaacctatgtcatacaggagataaatgctttcataaaggcctgaaactagatctccatcctgtaataacaggaaatgataaatatgtccacatccaaatcaaaattaatgctacgtactctaatggaactgggctctgtttttaaagagagacactaacgttacagggaggatatccagaggagcgagccacaaccataaatggtttctctggaaaccatcataagaagcaaggcttctcaatctatagacaaggtaactggaatcataccgtattgcttagaagaaaaatccagacaaatggatgtttcggggaataggattttatcccaatatgaattctaacagattctctctactaactgaatgggctgctataggcatcgtgcttcagcacagaagtacttgagcagaagctatgccaggaatcttgcacaaggaattcactgggtttataagtctccttattctcctgtgtttataagtccaaagtccattattaagatctctttatagagaaaaattcatttatatctgtaccaaggtaacagctaaccatcctccaaattcccaaatgtggaaaattatcatcatgtttaacattttaatcaacatattaccgttcttccctaatcataaaacctcactatgcaagaccgctttcaaataaaaacttacccaaacagcttttctgcagcagctctggagattgtctggacaggtatattaggcaatcctgatgaccgagatggtggaaactgagtgtgattgaaggaagggaatccaggtgtgtaagggtcacctgtccccagatgagcctaggaaaacaaaagagcaattcactccatcacatacttcctcaaaacttctctgtaagattcaggtttggtataaggctgcagcccaaccttagtttaccaacttgaagcctcaaaaatctgagtggctctacaatgtgactcctgttttcatggcatatggaaattctcaaattcaaggcactattgacaaagtacttttagcaacaaataataaagcctcaaagtcaatgtaatctatcttcttgcttactgctaacgccctcccagaaaaaagagcagttaaggaagacacagtgctatttctgctaatacaggaatccaagaacaactcaaggaactcaaaacggtgatttactcaagaaataactcacatgtccaaagaatgaaagttctgcgttaacaatgggaaatttagtctggtccatgtatatcaacacaccaattgcatttaagctttcagcatttgcaacctaaaagaaaacatataaagctcagaaaatgaagatctgatcatacgaaatgagaatacatcctggacattatgctaaaggccaaatggttacagaggactaaacttataatacttccaaatatttcaaattgtttatctggtaatttattaattgcttcctgaaaaattaactcacttgtttgcaaaataagagtaacgggccaggagtggtggctcacgcctgtaatcccaacaccttgcaaggctgaggcagggggatcacaagctcaggagttcgagaccagcctggccaacatggtgaaaccctgtctctactaaaaatacaaaaattaactgggcgcagtggctggcgcctgtattcccagctatttgggaagctgaggcaggagaatcgcttgaaaccataaggcagaggttgcagtgagccaaaattgcgccactgcactccagcctggacaaaagagcaaaactccctctcaaaaaaaaaaaaaaaaaaaaaaaaagaataacaaaggccaggagtggtggctcacacctgtaatcccagcaatctgggaggccaaggcaggtggatcacctgacgtcaggagttcaagaccagccaggccaacgtcgtgaaaccctgtctctactaaaaatgcaaaaattagccaggcatggtggtggtgggcacctgtaatcccagctactcagaaggctgaggcaggagcatcacttgaacctgggaggcggaggttgcagtgagctgagatcacgccactgcactccagccagggtgacaagagactccgtctcaaaaaaaaaaaaaaaaaagaaaagaaaaataacaaaaacccatctaagacaaccacttttttgagtctcactgtcactcaggctggagtggcacgagtcacatctcacaacctccagggctcaagcagtcctcccacctcagcctcctaaagtgttgggattacaggtgtgagccctgccactttttttaaaaatgcagaaatcaccactgtcttttgatatgttccactctagttccttgtgtatgtttggctattaattttcctttttataaaacatgcttttagctgaattctgtatatgcgtaaaactgagttatacagagaaatagctttcacttaagcacttctgattaggtaagtggaacttacttcatttgttgagcattttaataaattatattatctggtatgagagtttaagattgctgattttcagaatgtaagaatattaacaagaaatatcacttacctgaagagtaagataccaaaagtactgtatttaatattataataactcatactcaccttttctgcaaaggtgattttccctgctctgacaatcactatagatccattcacaggagtgtataaatcctcaaaatcttttttagtaccaaaattagcatggaccagtttaccctagaacaaagacattagatttaatgagcattatggtatcggaacagctctaaaatcttgagacagaagagtgttatagatcaaacctaagacaggcaacccaagtaagagataaaaggaggccaaggcctaaaaaagacatgagttctaaaaaactttacaacttttaggtcagagctattggaataaaatcaagatttttggcctcctatgtctttcatgcttttatcccatgctgcctttcatctgaagggcatttagattaaagaggcctatgtaggctggtcatgggactggaggcctggaacaatcttagccttgaggacatcatagaaataggttttaactgaaaggtctgataataaatctgtcccaaaattaaaacaccatctattacaacaaagtgacttgcatacaccaactttagatgtgtcatgatgttcctaagctcataagagtccagatgaacagccataaactgacactaacaaccaagccctcaatacagaaagcttgaagttgaacaaaaatcttcaatgttctttaacagaacaacctacccatctctaaactcctggcttataggcagccaggcaaagggataaagcacaagtatccagaaaggcaaggaatcaacacagaactgcaccagccccgaaaggtatccactagagatacgcctgacttacaaatgtgattttttttttttttttgagatggaatttcgcttttgttgctcaggctggagtgcaatggcgcaatatccgctcactgcaacctccacctcctggcttcaagcgattctcctgccccagcctcccaagtagctgggattacaggcacccaccaccacgcctggctaatttttgtatttttaatagagttcaccatgttggccaggctggtagctctgaccttaggtgatccacccaccttggactcccaaagtgctgggattacaggcgtgagccaccacgcccagccacaaatgtgatttttaagctgaaaattattctatctatctgttctctatttctgtgttaatttgactatatttgcctaaatttaaaaagatcaagggctgggcgaagcagcttcctcctgtaatcccagcactttgggaggctgagggtggtgaatcacctgagcccaggagtttcaattgaagaccagcctggccaacatggcaaaaccctgtctctaccaaataataataataataataataataataataataaaataaaaaataaaaattaactggacatctcagctactcaagaggctcacttgagcctgggtggtggtggagaatgcagtgagccaagctcacgccactgcactccagctagggcaacagagtgacaccctgtctcaaaacaaaaatagaaaaagatcaagcattaacgaatcaagctaagactaggccccagccaagatggatatttacatctgtccccacagggaggatatgcatttgtttagcaaatactactatgtatgtcaggcattctccaaagctctgcaacatggcagtaaatagaactaacccatgattcttcatctggctcacattctaatggaaacaaaggcatagataatgtcagctgctagcagtactataaagaaaaaataaaacaggacatggggaaagtgattagagagagaagacaatgcatgttgactgtgtcattagagggttgaaaaccaaaatatctcatgatcatttacattttacaggtaaatttataactcctaagaacagaaaagatgagttttgaatgattcaatagggaagagtctcatgcactgttttgctttacttacagtaactgttgcagccttactatacgccacataacccccaggattctccaccaggtaaacaagtctaccgttcttatcaactatgatcaccgagttttgagcgctgttaaaaagattaagttaaaataagcctaaggtcatccttccaaaaaacacaatagcttacatttagtatgtcttgcattatttggcttgaggaaatttacctctaaatcttaagcttgatttttattttaaaagcctttgggccgcatgcggtggctcacgcctgtaatcccagcactttgggaggcccaggcgggctgatcacctgaggtcaaaagttcgagaccatcccacctctactaaaaatacaaaaattagctgggcgtggtggcgtgcgcctgtaatcccagctgctctggaggctaaggcaggagaatcacttgaacccagaaggcaaaggctgcagtgagcagagattgtgccactgcactccagcctgggcaacagagcgagactccatttcaaaaaaaagccaacaacactaacaaaaagtctttgctatatttagcacacctgaaaatagctacttgtataaaaataagtttaccatctttcaacatacctgtctttgacctgaatcttaacaaaatgttgatcacgccagactttgctgagtttaaattcacgaaattgattttcaacatacaacgcaagattttcatctttttgagatccagcctcacgagggacatatgaattttcattcagcagcctggaggagaaaatgccttttaaatgaacttaagtttactttaaaataaacatttaagtcaaggattaaacaaattgttttgaaagcaaaatattatccctcatagttcagataaatgaactgtgacccaaaacttctagactgaccagaatatcacaaaagaaaaaaaattttgccccaaatcttgtaacttcaaagcttctttacccactacaaagcactccttcaagagcctcatcataacacaatgtatctgcttaggatagttttaggggaaatgagtagcttccagatctactataaaatctaagatagtaatactgtgctgaacagagtgcatagtttcaattctcacctacttgtgaagcatctgaataccctgaagcagaactgctccttggtccgatctcccatacttctttctatttactcagcatattagttcttacatttttgtggggtggactatactctcactttaaccataaggtctggtgtacagtaaataaacacaaaagcatcaactagatgaagtagaaaatgccataacttaagactaaagaattatagtaccactgtaagtgtaggaagcttgcaaaaaggaaaagataaatttattctttgcacagaggcatgtatgtgcaaagatagtaaaactctatggacaagtgttacagctcttttagaatttgtctagcatgctttctagtttttgccagaaagcccattacaaataaaataaataaataaatataaaatagaaatttggccaggtgcagtgcctcatcctgtaattccagcactttgggagccaagacaggaggatcatctgaggtcaggagttagacaccagcctggccaacatggtgaaatcccgtttctgcaaaaaaaaaaaaaaaaaaaaaaaacccacaaaaattagcagagcatggtggtacaagcctgtgatctcagctactcaggagactgaggtaggagaattgcttaaacctgggagacagaggttgcactgagctgaaatcgtgccactgcactccagcctgggcaacacgtaagactccatctcaaaataaataagtaaataaataaaaatctaagaacagaccggcctgggagacatggtgagactccatctcttaaaaaaaaaaaaaaaaaaattagctgggtgtggtgctgcgtgcttatagtcccagctactcaggaggctatggtagggggatgaagctgcggtgagatgagagcacgccaccgtattccagcctccaccagagggagacattgtctctggatactgactggcctaggggttaatgggtgagtatcacagaaattaagaagcactagagacttaaggcaggcagttacccatgatcaaggagatgaaaaaggctacttctggcatgtgttgcttcctaaaacagagaaaagctactgatgtccttgtcagcaaagcagagcttagtacaacgttacaagaggttaagaagaaaaatcagagccagagaatgacagcaagcaataagctacaaagatggggaaaacatcaagggcctattaattttttaagaaaaaggagactccccagagaagttctaccttttcccctaccagtatagtttcagttttttacaggccccttcccctctttagctaaacatgacaagtcttgtcttctctaacaagccattccccacagtgtcaccattattgtttccccgtggcctatcataattcttgaattacttgtctagatacttgcacagcagctggcactcacttgatggtgccggtgaagtctgtgctgtccagtttctccgacaactttctcttcaggtcatcccaatataagcgacgtgctgcagggaagtcctctcctggctcctccctcactggagactcggttcctgccagtctctcacactcagtttttggttctacccctttacaatagcccaagtagccaatcataaatcctaaagagacaaagttccagagctgaactcagaatttcatttgtaatctatccctgttaatctgttaatattttcaggtaagccttgaaaatactggttttcatcaaattctaagtagttttaaagtatataatgcatctcagttttgtatactttaaaccacttaataaattatatactagctttatttcaaatagctacctattcaaaacataggtagttttttccaaaagacccccttgaaacatgagactgagctgctgcaccgccagtgtcctgcggatattttctagcgtagcatttgcttcctggtggagtgggagcaaacaaaaaaatacataaataaaaagaaaacacttgcacgtcgtattgaaataattcatgggtctctctttccaaccagattaaattcaatgacaggtatagaatctactcatgattgtcttcctagtggcacttaaaaaggcataaagtggacgggaaagtggctcatgcctgtaatcccagcactctgggaggctgaggcgggcagatcacgaggtcaggagttagagaccagcctgaccaacatggtgaaaccccgtctctactaaaaatacaaaaattagccaggtgtggtggtgcacgcctgtagtcccagctcctcaggaggctgaggcagaagaatcgcttgaacctgggaggcggagattgcagtgagccgaaatcacgccactgcactccagcctgagccacagagtgagactccaactcaaaaaaaaaaaaaaaaaaattagccaggtgtggtcgtgggcgcctatagtcccagctactcaggaggctaaggcagagaatcgcttaaacctgggaggctgaggttgcagtgagccaacatggtgccactgcactctagcctaggcaagagagtaagcctctgtctccaaaaaaaaaaaaaaaaaaaataaggtacaaaataactatatgctgagctgacataacagacttcccagagttggttatagaaaacattgaagtttggaatggtcattctcaccaatcaagaaaaagacgatcacagcaatagtcccatagcagatacttccactacacctttttggttttgtgacattggcctttgtgttattgtcagcattttcttcttcatctacagcaagtttcatctccacatgactgttatcgccatctacttgccgagccaggctgaaccgggtatatgacaatggttctccaccaaactgtgttgcggaaaaaggcatgatgaagaacaggcacgggaatgtttaggaaaagctcgtttaggtatatgcttgttattgggccattactataacttgctatatattccttagggtgttctcctttcaaaccaacattcttccctgggcccagtcaagggctagttcacactggtcttctcagtcagtctctccctttttgtaaatttttttttttttttgagacaaggtctccctctctctcccaggatggagtacagtggtgtgatcacagctcactgcagcctcaaaatcctgggctctactgattcccccacctcagcctcctgagtagctgggactaggggcacaaatcagttcaggatactatgcagtaacccagaccatgatgttggtgggagcaagggagcaagaataaaacaaagttataaataagcagaaattctgactaagcataagatagaagacagaaaagagagaatagaccagacacagtggctcatgcctgtaatcccagcactctggggggggccgaggcacacagatcatttatggtcagaagtttgagacaagcctgaccaacatggtgaaatcccctctcactaaaaattcaaaaaaaaaaaaaccactagctgggcatggtgtcgcacgcctgtaatctcagccacccaggaggctgaggcaggagaatcgcttgaactcaggaggcggaggttacagtgagctaagattgcacactgcattccaacctgggcaacagagcccaggctgagactccatctcaaaaaataaaataaaaataaataaataaataaatacaaataagagagaattgaggtctagacagagtgttaagagttaggctccttctcgtcatggcctggatggctgttttttttgtatgttctttcagctttcactcatactgtctactcaatgtttcttaaaatttcattttttttttaatagagatgggcttgctatgttgcccaggcaagtctcaaactcctcaagtgatcctcctgcctcacctcccaaactgctgggattgcgggagtgagccaccacacttggcctcattcagcctttgcttttttttttttttttgagacggagtctcactctgttgcccaggctggagtgcaatggcgtgatctcagctcattgcaacctccgcctcccgggttcaagcaattctcctgcctcagcctcccaagtagctgggactacaggcatgcgccatgacactcagctaattttttttttttttgtatttttagtagagaccgagtttcaccatgttggtcaggctggtcttgaactcctgaccacaggtgatccacccacctcagcctcccaaagtgctgggattacaggcgtgagccacagcgccccgcaagcctttgctttttacttctcctactaaaacattttgatcagggctttaattcgtcttatctactaagctgtccccgtctaccacacccagaaccactctgagaattcttccaagactttccataattaaccctactgaaggctgaactctttgtgagatcagttatgcctcaagactaccaattcaaatgtaaatgaatacctgataatagattggggttattatttcatgcttactcagttaaagtcatgcttgtatatttcacattcttgcagacacagaaatacaactgaaaatatcttaccaagttagagaatgctgatctagcttgatccatcattctgaactgccacacagaagaacctaggtatcagaatagagaattattgagaaagatactactgtatcagattagtgagctttctattaccaggctaaatgatacattaaatttttaaaatacattatcacttttctagaaaaggtatttaaccatagtttacatgacaactaaattaagtgggatcctttttaaagtttgttatatacataattctttttttttctttttgtagagacaaggtcaccctatgttgcccaggctggtcttgaactcctggcctcaaacaatcctcccaccttggcctcccaaagtgctgcaattataagtacgaaccactatgttctgagtagacaaaagtgacacatactgctgggcggggtggctcacacctgtaatcctagcactttgggaggctgagatgggtggatcacctgaggtcaggagttcaagaccagcctggccaacatggagaaaccctgtctctactaaaaatacaaaaattagccggacgtggtggtgggcgcctgtaatcccagccactcgggagcctgaggcaggagaatggcgtgaacccaggaggtggagcttgcagtgagccaagatcgcgccactgcactccagcctggaaaacaagagcaaaactctgtctcaaaaaaaaaagaaagtgacacatacaaaaagacaaaattaagactaaggcagacaagaccagttatgctacaaataccacaaaccatctccaatgggaaggggaagaaatactgatcctgactgaatgaatagttcctacaagtgattcgatctttgacacaagaagaaacatgaaacacagattacgctgttttacagatgaagaggccagttattagagaaactaagtggcctgttcaaggctgaaaattgataatctaagcgaagttaaatgggttactgggttatagaaattgtgttatcatctctggaaatttaagacattaaccttaacttttgtcaaagcaaaatacatctctgtaatcaaagtcctaagttaagttaaaggccttaactgaaatctgaattttccagttaatttggtttgagggcatctagatacttgaaaatgacattatcctgagatttgcaaaatggacatttattggataccattttaaagcttttcctatatacgagtacacttagggcatattaaacacacacggcacaaagcaagctgtgaggtatacgcaaattgtaaagcaaagggtattataactggcattaagaaaaagctttctggccaggcacggtggctcatgcctgtaatcccaacactttgggaggccgaggcaggtggatcacgaggtcaggagtttgagaccagcctggccaaggtggtgaaaccccatctctactaaaaatacaaaaattagatgggcgtggtggtgggcacctgtaatcccagctactggggaggctgaggcaggagaatcgcttgaacccgggaggtggaggttgcagtgagccgagatggcaccactgcactccagcctgggtgacggagtgaaactccatctcaaaaaaataataaaaaagaaaaagaaaaagctctaaaacctattacaaaaaattctttttaaattcaagctttaaaaaccagtgtccatatgcaatagaccatattcttagaagcataatctttttttttttcttgagacagagtttcggtcttgttgcctaggctggagtgcaatggcaggatctcggctcactgcaacctccccctcccgggttcaagccattttcccacctcagactccgagtagctgggattacaggtgcccaccaccatgcccagctaatttttgtatttttagtagagacgggattttaccacgttggccaggctggtctggaacttctgacctagggtgatccacccacctggcctcccaaagtgctaagattagttacttgataagaacatcccaaggaaatcgaaggcgtgagccactgcgcccagccagaagcacaatcttttgccccttctgttacaaaaagcttatcactaccactccaccagaacagtaaggacccaatcattagagccagaactggaaggccccaccctgaaccaattttaatcatccttttctaggaaaaaacatcttgcaagttttaacactcatctgaaccatcattcctcaagttttcttgttttaaattaattttaagaacacaaagcgatggccgggcatggtggctcacgcctgtaatcccagcaacactttgggaggccgaggcgagcagatcacctgaggttgagagtttgagactagcctgaccaaacatggagaaatcccatctctaccaaaaaaatacaaaattagccgggcatggtggcgcatgcctgtaatcccagctactggggaggctgaggcaggagaatcacttgaacctgggggaggtggaggttgcagggagccgagatcacaccattgcactacagcctgggcaacaagcgtgaaactctgtcaaaaataaataaataaataataatctaagctacttgtgttatctttggtgttctcaatggtgactgaaaacaacaattcaatttctcacattaataatgaagctcaggtaggcaaaacgtagccccacgttttgaaccatgaaatggaacacattcactgcctaacaacttcactaccctctattttctccaaaatcagacagaatccagcccctgtttttacccaccaacattcttctctgttccttgaggtcctcctcatttcttccaggctcagctcaaggcttcatctctatgaagccttctctgactgacttccctatcctgtaataactggtattgaactacctgataatgagtaaaaatattgtctttaacagtactggggcatgcctgatgcatgagattccaaatgatatgaaaaatataatgaaaacattggaccaggaatcttttcccgtccccatcactcttctggtttagtagggagtttttttgttgttgtttttgagatggcatctcgctgtcgcgcaggctggagtgcagtagcacgatctcagctcactacaacctctgcctcccaggttaaagcgactctcgagcctcagcctcctgagtggctgggattacaggtgtgcaccaccatgcccagctaatttttgtatttttcgtagagacggggtttcaccatgttggccaggctagtctcgaactcctcaccacaagtgatccacctgcctcggcctcccaaagtgctggaattacagacgtgagccaccatgcccggctaatttttgtgtttttagtagagacaggatttcaccatgttagtcagactggactcgaactcctgaccttaggtgatccgcctgccttggcctcccaaagtgctgggattacaggcgggagccaatgcgcccagccgagggtcatttttaactagcattgtgatcgattcaggtttagctgggaatcttgctccatgacatttaaatacattatcagaggcaagtaactgcctcgccttagggcggagttagccaaactgctgtctatctaacaatcttcaacacaggctaggtttacagccaccattacttgataagaacatccaaaggaaattgaaggatgctatgctatatataaccttgcaaaatcgatgacaaaaattatcttaactctgagttttcttgagaagcatattgtaacccaaaattcagggccggggggcggggggaaccagcagggtccacaagtactctagacagcctaaccttaattttcacagtaagcttagcatataagcatggggtagccaaatacaatttcctactttaatcctcttatcaacggggaagaaaatggaaaaagctgcagaatccagtcccccgggtaagtgaggtctctacaagcagtaagcagagggaaagcgttatccgaaaagagccgaatcagaatgtattttcttacccaccctcccaaccttaaaagaactgtccagcagaatgtgacacaatcggcctctccggcgcccatcaatccagcacagccctctgaccacaccgctaatctccaagtatctttcacaaataagtcactcctatggctcccgtcttgtagtgagaactgctagcaatattcttaatgtgaacacctgcggcgttcagtcggattctgccttgagaaaacagaatccacacacaaggcgaacaggcagagcatggcaagatcaggttgtaccagagccgaagggtaagtttacagaaacccgtatctaattaatgcctgtaacacgctagtaaccgaatcggggacagctttgtccctttccgcagtgagaacggggcccgcccggagcccggggaaccgaaggtttaggagcccaaggtcacccacgaatcccagccgttccctggggcgacttcctggagcagccacgtgttcccccggcgccgcacgccgcgcagctgcaccttggctgcgcccgcgctcccggacccgcagcccggagccggcgcactagggcctgcggccttcaagggcgaggacccgaagtccccggggctgagagcgacagtgggggtacacctggtctcgtcattcgtcgctctgtgaccgaggaggcgggcaagaaggcagagagaagggaagggacgagaggcgaagggacgagaggcgcagggacgcctctgcgcacagccgccgaccccgtgtacctgcagccgctcgaggcgccgccacagccccttccccacaggctcgcggccccgctccatcccggccgccccgcctggggccgcgaccgctttcccgctccccgtgcggctccctatggctgctggacagcaccggagcggccgctccagccagccccgcaggatgaagggaggacacgagggtcggtgtagttctagaagcccgcactcacactagcgcgtcctccgtcccgagccgccacccgatatcccgacgctctgaggggatggcggcccctaaccggcggtttatagcctggccccgcccccggcccccaggggggctgtgcgt

SEQ ID NO: 1455 - DNA, 61950 bp, Homo sapiens
tcgaggctgcgccgcgtggagtggcttggcttaacagcagggagggcagagcgatgctctttgacctcccagaagagtcacgtgggctgacccagagccggggcggaaaggctgcgtttgtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaaggtaggaacctgcctgttgcaccgtctttgactccaggaaggaatggctcactggagaggggagagaggaaatgagaggagtcggctggggcgagtgtggaccgcagcccagagttagtcttggctgcagtgcaactctttctaaaatgttattctcacgccctttctttgacctggacatgttgtctcctggtaaatatttgatggtcagcacacttaactaattgcacagagtgaacaggaccctaatgaaatctaaggtgcagatggggcagttacgtcgttcagcgttcccatctggatcacattagcagagggaaacgaggattgtggcatgagtggctttttcaaattttacaccaagtttatgcagctacgatttttttttccaaaaaccccaagcccatagaggaaatgtgaatgattaagctgtcttaggctgtcctcactagtattgtgtgaaatttctgttttgtaacaattgttttgaagataaaaatatttggttaatgtaaaaatacttgttttgctgtttatctttagcaggacttctgtaaagtcctgctaaaaaattcagactgtctagatagccagaggacttgggttgtatataagtactaatttgcaggccgggcgccgtggctcaaagtgctgtaatcccagcactttgggaggccgaagcgggtggatcacctgaggtcaggagttcgagaacgacctggtcaacatggcgaaactccatctgtactaaaaatacaaaaattagccgggcgtggtggcgggcgcttgtaatctcagcactttgggaggccgaggtggtgggcggatcacctgaggtcagaagttcgagaacgacctggccaacatggcgaaactcccaatctgctaaaaatacaaaaattagccgacgtggtgacgggtgccggtaatcccagctactcgggaggctgaggcaggggaatcgcttgaaccctggaggcggtggttgcagtgagctgagatcacatcactgcactcctgggcgacagagcaagactccgtctcaaaaaacaaaaacaaaaaactactaatttgctctttgctgtgaatctctctccctgtctccatagctgtatggagagaaaatcattgacaacaggggcatattaggggccagcatcactcagataaacctaatattcacaaaagttatggagctcaaatttactaggtgtgcggcttgagtgagttgtataatatttaatttctctgagccttactttggtctcaaatgcaaatttgtcaggattgttgggaggcgaaactatatgattatgcataaatggcctaggtcatagtaagtgttcaataagtgattaatttcccgacattgattgggaaagcaaagtcatctgtttttggtaacctgtgatctccttttcctttcctctttctttctttgcttattctacaaatatttaataagcaccttccgtgtgcaaggccctgtgttcataggtataccgtgttcaaaagagctgactctcccttcacggagtttatagtttctaggtgatatgggcaaaaagaaagcagaaagataagtaaatacaaattatgataaatattggtgaagggcaacacagctcagtaagggagaataaggaagaatattttaaattaagtgctctcctttcccccacttaggttgagaggtttttcagaatgaaaacctgaagcaacatttgggaagactttcccaagtttgctcccattatcaataggtaaaccagaataaaaataaaaagctgcactattccaaatagatgtctgcgtcttgtgtattcttaccctaaggttgtgcacaaacatttgcttttgattgtttttcatgtctgttttcgtaaaaagcagttttaatgagtatttaactatagtgtagcttctcctacttgtacttttcattgtgcattttcttggtgttatctaataactatgtcattctggtcctaaatgttttcctgggtctcaggttcagtcactaagttgcatttgaccatttttatctttttatctttaattcctttccctcttttaagttatgaaaaagtctcatttgttaatcaggaggaccaccaggccacttcattattgaaggttctgacaaaaacaacacaaaatattttactgaggaaaaatcattcggttgattgttcatctgtgtaatgaatagctaataattgtctgtgatcataacagattcttgcatctgctatgagtagccatctaaagccaagactttgtcagaagcatctgatcctaactttgtgcctgttctttacactggaaagctatttgatctggtgacatctaacaaaggagtgataaaaaatgcacggttctctgtaactccccataaagcaagcttgtccaacacatggtgcagggcgtctttgaatgcaacccaacacaaattcgtaaattttcttaaaacattatgagatttttttgtgatttttttttttttaagctcatcagttgtcattagtgttagtgtattttatgtgtggcccaagacaattcttccagtatggcccagagaagccaaaagattggacacccctgccttagaggactgtagtaacaattgactacttgtattaaatactttatgatttggtaggggtcctacatgatagtttttcttttcctcctctgccaagcagtttgttaggactcactgcaattagaagttggataattacagatgttttattggaagttaatataggtaaagcactcattctcaaaaggacacagatgatagctttctttatatgcttgaatatactctagaaaaggagagtatattcaaattttgtgccatttcaaatggccaaacttggaccagggaatcaaagtaacaaaaataggtttcagctcaatatgagggaattatctgacagtgaaggggcttgcgccgggatttgtaacctcctcttccctggggttatttaaaagaggtccctctggccattggtcaccggtaccctcaaatgacttatggggattcagagggtcggcagtgggaataggtttaaatcttttctagtcatttagtactgagatgttgagcagatcaaggcagccttctttcccttactggaaaggcagtgatgtccaacgaaaagagcactggactaagagaaaagagccattccttagccccagttctgtcatttgttttgcttgatgatgtcaggcaatttacctatagcttttaatctatgatactgggttagtactatctcttgtcttactttcctctgaggattgctacagagatcattacaaaaattattattattattttttttttttttttgagacagagtctcgctctctcgcccaggctggagtgcagtggcgtgatatggatcaccacaacctccacctcctgggttcaagtgattctcttgtctcagcctcccaagtagctgggatttcaggggcacacaaccatgcctggctaatttttgtatttttagtagagatggggtttcactatgttggccaggttggtcactcctgacctcaagcgatctgcccaccttggcctcccaaggtgctgggattacaggtgtgagccaccgtacccagctacaaaaatatttttaagaaatagggataaaaataagaactaagaataaagcccataataatttatgtggccctgcagttgatcaaagcctaaaaaaattaattagaaaagaaatgcatgcttgttgaagaatactgaaacaatagagaagtatataaggtactgtataaaagtgaaagtctctgttcccagttttagtcctgttcagatatagtcactgttaacactttgatgtgtacatttctagatatgtctgtatgatacagtgcatatgtaataaaatacatctttgcccttctcattcagtaaagtggatgtgtcagaacagaaagattaagcttattttttaaatggctgtgtaatattatacagcacaaatgtggattagcttatttaactactttcctattaataaacattgagttgttttcagttttgcactatgccaaaaaggccgcagtgaaattctggtattcctgtctgtattccacatgtgttatctggtaccaaacattgtgctagatattggaagtatagggttgagcaaaatatacagtcacagtcttaattgaagcttgtgatttggtgggagaagtgacaggcattaatcaaataatctttcaagtatgttaatactacagcagtaagagctatgaaagaacggtctagggagccctgagagtatctataatagcatgaagtcttgattatgtttggagggttaaggaaagctccccaaaaatcagaaggatgagtaacattaaactaaatggaggagcatctgtcatccttttgaggatgctattaataatatatatatagtcagtattgtttttaatagcatttcccaaaatatatttcttagagccccaaggtcatgtatcttcttcatagggcaggagaaaatttcatgatcaaatcactttggaaatactgtatactagatctcacttttagaggtgggtcgtagtatacattggaataaatcaatgttttgcagttaaaaaattattcaaccaaaacttgcttggctatggaacgctttgatttacataatacctattgaactaatttgttgtggagctcactaattttaggaaactatagtcttcatcttgagatggagatggaaaatggaagtctatgggtgtactctaaataattttggaaatatagttttattaatacaagttgagtattatttatctgaaatgcttaggaccagagtgttctggatttcagattttttcagattttggaatatttacattatatcagtttagactctttaatccaaaatgttccaacaggtatttactttgaacatgatataggtgctcaaaaagttttagatttcagattttttggattagggatactcaacctgttatagctaatatttgtgtacttaagtgtattaggcactatgtttaggcactatgtatacttgctatacattatctataataatttcatcttcaaagtaaccctaagatagatgcaaaatgatcccattttacatattgggaaattagggcttagaggtgaatgacatgcccagagttacataattagcacatgcctcttcattggttggatgggatctgtgggaggacaattcaaagggcaagtaaatcaaaagccctccatgtgtatgtgtgattttaaaaaatatatgtactgtatttttgggtgtaatggaagcagtgtgacaccagattagggtcagaacagaaatgagtgtggtttattgccaccaatactaaacattgcttgtttgaaatgttctagggagagtctttcctcatgaggtgtggcccctggagtatcacatgccatacatgtgggctggttggggtggatctcatctcatcagcctgggctctgtagcagaggctccttttgctgagttaatgtgaaagtagatactaatttagtccattttcttggctcctgatttaggcagaaagctgtcaagtttaagattagttatgattgcatttatacagcagaacaggattctgtgtttacacacacctttattcacagttgtcaaaaatggggaaaacctccaaatatctatcaacgggagaatatatataagctgattgtggcagaggcatgcaatggaatactactctgctattttaaaaaaaagaaaaactgatacaagcaaagcagatgaatcttggaaacactaatgtggagggaaacaaaccagatacaaaagagcatactatgtgattccatctatagagaccagaaaggcacaagaaaactttctggagtggcaggagcagtgaagattataagagcaaatatattaaaactcattaaattgtacgtttaaggcctatgcatgacattgatataaattttacctcagtcaaaaataggcaaacaaacaaacaaagaaaaccaagaaggctgggcacagtggctcatgcctgtaatcacagcactttgggaggccaaggcaggcagatcacttgaggtcaggagtttgcaaacagcctggccaacatggtaaaacctcgtctctactaaaaatacaaaaattagccaggcgtggtggtggccgcctgtaatcccagctatttgggaggctcaggcaggggaaccacttgaacccaggaggcagaggttgcagtgagctgagatcgtgccactgcactccagcctgggccacagggagggaaaaaaaataggtattacaggcaaaggactgatgaaccacctagatgttttaaagttctgtttttgtttgcttgccttttgttttgggaaagttgaaggaacactaattatattagtgttcctattttaaaagacaactattttattcttcagaaataaaaacaagttaacattctaacagatattgaatatctcagctaaccacaagtcacaataattctaattgtcttttcatctttacctttttgtaagtctttatctgcaaactctagtcatgatgtttgagtttgtctccctgtggagcaggggtccccagcccccgacccccgcatcggtccatggcctgtcaggaactgggccacacagcaggagttgaactgcaggtgagtgagttaagcttcatctgtatttacagccactccccaactctcacattaccacctgagttctgcctcctgtcagatcagctctggcattagattctcataggagtgtgaaccctattgtgaactgcacatgggagagatttaggccgtgtgctccttatgagaatctaatgcctgatgatctgtcactgtctcccatcacccccagatgggaccgtctagttgcaggaaaaaagctagggctcccaatgattctacattatggttgtataattatttcattatatattacaatgtaataataatataaataaagtgtacaataaatgtaatgcacttgaatcatcccaaagccaccctgatcccccacccccaccctagtccatgaaaaaattgtcttccacaaaccccgtttctggtgccaaaaaggttggggactgctgctgttgagtaaagatgatcattacaaagtagattttgtatataaggtactgagcctgggtactgatttttttctagtttcagataaagttgtaatcctaatttcgtgggttgtgatgcctgacactgtaaaatgaatgaatagactttgctgtgggaaaaacctttactgtactatttgtccaggtagcttggtatcagttgttagggtctttgtcctgtctccccatgcccagagatgttgagctttaaggaatagacccagattggttcatgtaatccctggtgtgaggaattttagtgtgagtggtgaagtgccagtcatgggaataagtgttatttctcagccaatgggcatcagcaattaagggtagccactgagcaaagcagttggccagacatagaatctaccatagatctgaattgaccatctctgacgttctacagatgattctagtgttatagaggtcaccctcttttatctttctccaaattgagaaatattctttgatatgtttcccagtgctattaaatgagtttatgttaaatgtattccctcctccattgatttgttttaaatttaacatattttttcaagtgacaagataatttgtggtgtgctaggcattatgatatacataatattatacctaatagtgctagtgaagctctttacttttcctttgtgcccttttcaatgctttgaagaattgtaatccgtactattgtttaccttttattttctcttctctctttcacacagcataatttcatctatgcttggggatgttccatatacttagattcccaggttgcttccacttgaagctaataaagcatgtttcttttttctttttttctttttttttttttgagactgaatctctgtcaccaggctggagtgcagcggtgcaatctcggctcactgcaatctccacctcctgggttcaagcacttctcctgcctcagcctcccaagtagctgggattacaggtgcacatcaccacacccagctaatttttgtagtttttagtagagacggggtttcaccatgctggccaggacagtctcgatctcttgacctcgtgatctgcctgccttggcctcccaaagtgtcaggattacaggtgtaagccaccatgcccagcctaaagcatgtttcttaatgttgaggcctgatataatataatttttttgtgtgcattaatcatatattttaggtacttcattttatgtctaatacatgacagctgaaattaatttgtcttgatttgctctactatggggaatagtactatacttactgtttttagggaatagtattatacttattgttggattaattatgacattttataattgtatcaccagtatttgtttctacataaattcacgcttagaaacagactattctgcaaattcttcattcaggtaaattcattaatctaaaagaaagttgtaattaatatgaattcacccccaaatgggccattttccttttagagaaacactatagtagggaggggcatagttagacacaaaaccttggggttgagagttacaagctgtggcatttgttattttaagcctcaggactccacacctgcaaaaatattactgtgaggtcacaggcaggtatacagtgaatcctgcatgtcctcagaacaccccagctgccagctcacttcaacctcaatggctggtgctgtttttcacatcttcacttttgtgaaaggaagaaatgaaataaggaggggataaaggaatagctgacatgcctaagattcttttcttagatttttcttatcactccagaccaaatagcacttaaatatattgaatgtgtaaaacaaaaaaaaaattctaagcccctcaaccaacttaatggaccccccctttcagccaaggggacctcaaagaaacttagaaaattaattcaggccatgatgggaagtggggaacaggtcaagacatgcctcatcatacccttctccatttggagtctagacacaactgaccagcagtaacattaaaatagagatcttaagactaacaaaatagactctgtagtagtaagataccaacttccaacctgactctagtgtagtatcacatgacagatagcaggccctgaaggaaatcaaagtatttttccggaaaatatatttcttttgacatatttaaaatagccctgcaaagctgtgttttgtggggggaaatttgcattctgtagagaatctccttccccttaggagagtctgacaccttttaaggtcttttaagagacattcactggctattctctctgaagcctgctacctggaggcttcatctacatgacaagaaccttgacttccacaactcctttatctaaaggcaagcatttctttatgctgtattcaattgttcaggcagagctgaactcttttaaccaattgccagtcaggaaatctttgaatccacatatgatctggaaggctcccccacctcccttccctacaagatgtcctgcctttccaggctaaaccaatgtgtaccttacatacagtgatttatgtgttagcctgtaacttctgtcttcctaaaatgtacaaaaccaaactgtatcccaaccagcccatcttgggtacttgttcccaggacttcctgagactgagtcatgggccatggtccttaacctttgccaaataaacctctaaattgattgagacctgtctcaaattctttttggtttacaaatgaagtaaataaacattccttttttttactggtctgatgtgtgcaaggcactgtccatgaaggtaattagcattaggattctttagttgctaacttaagcagaaagggaatttattggaaagatactgagctactctcttgaaacttccaaaaggcatttatttgttttggttggctttttattttttttttattattattattattattattattattttgaaacagagtcttgctctgtcgccaggctagagtgtagtggcgcaatcttggctcactgcaacctctgcctcccgtgttcaagcgattctcctacctcagcctcccgagtagctaggattacagtcgcccaccacagcttctggctaatttttgtatttttagtagagacacggtttcaccatcttggccaggctggtctcgaacttctgacctcgtgatccacctgcctcagtctcccaaagtgctgggattacaggcatgagccaccgtgcctggctggttggtgttttaatgtcctagattcccagatcattcattattacttttccctatttggtttgtacataccctaacccgatgcaattttccaacctttcaatgctccctcccctaatgcttccactttaccttctacaatttatagtctgttgtcatgaaatagagacatagtattgaatataaaatgtctttcactttcttgccctacctggctattcctgggagcactgtttccctgtaatcctcttaagtgatgatgtattttcaccccacatctttaccacccctctcccatgtagaaccatttctcccatttgctgtgtttgtttctccttactcaaaaactgtagctcctcggaaatacatgctgtcagactactatactctccagatgtgtactaaactcctagttacaccttctcattagtacctgggcttgctacctttccacagttcctgtcatcatacttagtaattgctacatacacatggataatctgtccaacatctgacatctcattgccacctcagaagtctaccctcatggtcagaccacagacttgctcctcactggtaactgctgtacttacaaagtttttaaaagactgggccaggcgtcatggctcacgcctgtaatcccagcactttgggaggctgaggcgggcagattacaaggtcaggagtttgagaccagcctggccaacatagtgaaactccatctctactaaagatacaaaaaaattagctgggcgtggtggtgcacgcctgtaaccccacctactcgggaggctggagtgggagaattgcatgaacccagtaggcagaggttgcagtgagctgaggtcgcgccgctgcactccagcctgggcaacagtgcaagactccgtctcaaaaaaagactgaccaccatccatctggtttccatatccctcagataatatttattatccccattgggtagtcctgtccattagcccttctactttttactgtacttcattcatgtcttgatttccctgcttttctattttatttttatttttttgagacaagagtctctccctgttgccagactggagtacaatggcatgatctcaaagctcactgcaacttccgcctcctgggttcaagtgatcctcctgcttcagcctcccaagtagctgggattacaggcatatgccaccacgcctggctaattttatatttttagtagagatgggttttctccatgttggtcaggttgctctcgaactcctgaccttatgtgatctgcccacttcggcctcccaaagtactgggattataggcatgagacacggcgcccagcccttccctgcttttctagtttggagcctatgtttcatcagtgtaactgttcttttgcatataccccagctcccttgtccatctttccctctgtggtactcagctgacagaacctcactctgcttagattcagctttttattaaaccaccaccacatctatcaaactaccaatgtctgtacccatatattttattttattattaccgtagatgaaactatccctgaggctagccgctccacaacaccctggagcccatcttgcctacctaaggatttaatgtgtaaatttccttagattgttcatgctttcttgcatcctcaatctttccatctctaatgggttattacaattcctattaaaacactccctagatagaacaaatgttaacctttaagtcgtggcttttggggacagatacaggtacccagatgaccaggctcttttcagaaatagtattagtggatgtgaaaaagcattccaaaagatcctcttaactgtttaaatatacaaagcaacttcagataatccttctttgggctgaaagaaatcagtgtgatttgattttctaacagtgattaatttggtccctgtagggttttttggcttctaaaaatatcaagtgaacttagactttcccatagctttggagttgattttctcaaccttagtcctaattcttttccaatttatctgcttattcttgaggtggaatgacatttttagaactttatggcaaacattttctttgatattttctcagatgtatttttagttagaagagttggagctacattctaaaatgttaacgcaaattgtccttttgtaactaacttgtatgacgcattttctgttttgcttttgtttttgcagagtcttatgtcataaagaagtatttcttcttgtagttgatggagttatgtatatgtaataattttcaaatgatggtccatcagcagtagaattcaattacaactttacactaatcagacccagttttggaggtcagctgatattgtaggccattcccagcatcatggatatgaaatgccaagctaagctagggattattttaaatgctttgttgttctgagaatatttatataggttgcttacatcaggtgtctgtcttgtttgtttttaaatgactcatgccactgaagtcatcaatttgagtaatatatttgacatcatggtatatacttatatatgtgaatgttcaatataccatcattagtctttatcataaggcactatagtaataggatgtcatgtttcccataaacttgaatgacataataatgctaaatctggttttcagtaaaactagaatagtcatgtgtggtaagttgtcatctattattgatataaaatagtattgtggttacttttacatatgtaacactgttgcttgaatttaaacgcaccaatacagaacaatgagcagttctttgactctcatatgatgattcaatgtcagctagtccttagtatattaaaaaaaaattcctggcttactgtggtagttaattctaattttaatgtgtctctagggacacatttattaaggtcttttattcactgcccagtaagaaaagtcagtcaaatttaactgaggtatttttctaattcaaaatggctgactgaacatgtacttaaaattttccttttcttggctgggcacggtggctcaggcctgtaatcccagcactctgggaggccaaggcgggtggatcacttgaggtcagaagttcaagaccagcctgatcaacatggtgaaaccccgtccctactaaaaatacaaaattagccatgcatgttggtacacgcctataatcccagctacttgggaggctgaggcaggagttttctttttccccaaatctcagtaagaagaaaaagaaagaaaaaaagaactatgataccaaaaaactgaagaaggttctgtcggcagaaagcagcattaaggagagcaggacaaagacaggtcccttctctgaagctggaggagacggtggactccgttgtccaatcagactctcttgggaaaaaatatagggaggcaaaattcgaagaaaaggaacatatagctgaaagagactgttttaatcagtcagtagcttctgataaaggccagattatctataagaaatgaacaagctgtttttttatatatctgaatgtagcgaactttgtaacatatacattgagcagttaaacaaaaaagcaaaataagttctacttttattttaaaaattaagataactaaagatatggagaggattagatttatacaactaaacagtgtatgaatttacaacataatatgggtggaagttaaggttttttcagtaaaactctagaataatgccaagatagaagaacaactttctaaagtggggaaatgccatgaaagagaaaggcagagcagtatacctgatccctgttggtcttagagcttaacaaagaaacccttgtgcttagaagcaaaatgcttcctgtgtatactaaagcaaagccatagctcttaatttttagtctgtcaacagagccagggattgtataattaatatctgaattcacttccaaagcaatagtgattcccaattctgctttagtaatgcattctatagctacagctctttaatcactagcagcactgtccattagacctttctgtgatagaaatatgcccgataattgctatccattttggtagccagtaaccacatgtccctatcgagcacttgacatacaaccagcacaactggggaattttaattttatttaattttagttcaatttaaataaccaaatgtgaatactggttaccatattggataatgtagatttaggccctcatttataaatatgagctaagcagactaaactttttaggaaaatagaaaccatgaaacgcatgctagaaaccctcccatgcccagttaagagaggtaatgtaagtcacagaagagtacttttaaaaacccgaaacccgaagtatcctaaattatatccttaatgattcaaatagctttcaaagtccaaaaaccagcaaacactgctgttgaaaaaaaaaaaaaaaaaaagaatcctgtgacattgcttaaaaactaccactgtggttgtagaaatgtaaacatcttaatagaaaggctgaataggacaaggttaaagactaaattagtgatttgggagatcaagccaatgggcttgtctaaaacctagtcaaaaaggtcaaagtgataaaaattatgaaataaaatttgatatttggaggctcaagctaagaaagctgctctgtctaaaggaaatacagaggacatggaaggtaagaaagaaatgataaaaagaaaaaaaaaactccaaagttaaggaaaatcttaagccttcaagtagaagggttctatcaagtgctttctaggattattgtgggaaaaagatgttacctagacatatcatggtgaggttggtaaactccagtggtaaagagaaattgctaccctctttcagaggaacaaaagaggttaactacaaagcaactgtaagtaggcatcagacttctcatctattatcataaaaagtagggtaaggtctacaaaatactgtaaaggagtattttgaatttagaatttcttatagagctaagctatggctcgctcatatgtcagggcaaaaaatcatccaggctgaaagtttgtcaaaaaaaaaaaaaaaaaaagtatacatttaggggtgtactccagaatataaaaagatgcgagagaagaaactgatgaaccaagaacttaggaaaactgggttaactttaaaaatgattgacaatatggtagtgaaatttaatgctgttgttatatagaattataaaaatagaagaggtaaatcttttagaagaaaaaaaagtaaactcatagttccaggtttcaaccaaacctagggattaaaaataaatgcaagctaacgatcttgtcttgtttgggtggtggagaagccacaaacaagaaaaatcagtattgccatcaaaattttaaagtctgagtgcctatcattctggcctttgtagtgttaatagtctagctgggagataagaccagtgtacaagaagcaatagtaagcaatctagtaatattactaagaccttcttatgataaaaagcttaaaattaaaaatagctgataagttcttgaagtagatttttagttcattagtaaagtgatatttgaactgtagtagtatttatataatataacattaaaaacacggggtttctcctctctgtaaaaaacagttaactggattactttattttctgtcctttatcaagttacttgcatttcatggccaggcacagtggctcatgcctgtaatcccagcactttgggaggccaaggcgggtggatcacttgaggctaggagtttgagaccagcctggccaacatgatgaaactccgactctaactaaaaatacaaaaattagtagagcatggtagcacattcctgtgatcccagctacttgggaggctgaggcaggacactcgcttgaacccaggaggcggaggttacagtgaatcaagattctgccactgtactccagcctgggcaacagaatgaggctctgtctcaaaaaaaaaaaaaaaaaaaaaaaaaaaaaggcaatggcttatgtgaatatctgcacgagctgtcaattagccctgtatctatatgcctccttctcaatgcaaatttttctaaaagctcactttgaagaaatcagttagttaatttcttattttaaacactattttaactctaagaatatattgcttgctgttcagatttatagaatgcactgtgaggaagggactacacatcatgaatcttctgaatctttgagatgcttagcataatgcggagtacatactagctcatatttttttggattgttcctgtagacaataaagagatggtcatgatacagactgtacttaattctaacctgtgacacattttatagtttaatatgttggaaggagtcctaaacttggagtcagggccacaccaggagtagactcttcacatgaatactgagtcactctttatataactgtgggtgagttataccaactctttataagttagaatatcaataaataacagtaccacttattttccttcacacaaggatgatttgagaataaaatgaaaagaattataggacaaattcagatacagcaaaagtatggaaataaaaggtagtattttattacaggtaatttgcattcttcattaagaatatatattaattttatcccttagatttttatattcttgtcatcaaaatcctctttctgctgtttctaagagtgagaaaatgctctcaactgaagttaggcaggtcacatgtgaatactgagctttaaaccaaatgaatcatggtacaatctaatttcttcctgatgtgagttgactcttgaattcattgttaccataaatagggtattcttgtgacatattaatatgaccagagcgaggcacctatctttgaggaagttagttttaagatggtcattgtcctcttacacctgccccaagtaaatgacttacgaagcagattttttttaaagacaaaatcatttggtttgtggacattaccaattattatgtttgtaagacttaactccatacatccctattaggaaatctcattcttcttttttgtttaatacatgttaaacaatagtccatcagtggtttgtctcttttaagatcactaacttggggcataccgtaccggttggacaagatctcaaatggtgacttaacttttaatgagtgcttataaaaacatgtgtgttgcctcatgacactatgcaattgctgctttagtggtgctttttgcattccagttgaattgtacataggttggcccatattgctcaccatttagttagatcttcattgtttagatctcagtatgttgaaaatctgggaacagcatcatagaaaactatatcctcctctcttagaacattgcttagcaaaaattatgttttgttctctaaatgaacttttccaacttcgaaattttgtgacttttaaataatgtataatactctaatgttattctaggaacaagccagcatgtttggccttatttacaaagcagttaatataccagtgttagaataagtcaaaacactgtaccaatgaaaatgtgtgctcttccaagtagtatatgtgttttattttaatatttagaagatctaaaaagctataggaacacatgttccacttgtaacttaatagcatgccttaaacttaaagatatctttttatggattctgcctctgctgcttctgattaattttgtgacctcaagcaaatctcttaattctttgagccttaggtttctcatctgcaaaacgaggataattatacctactcgtagccacaagaatgttgtaaaaatagcagggagaatttttatacagaattagacatgtggtttgtagatttatggtagcagtcttttgaataaaaattatttagtttgctattatttttataataaaaaccaaaagatttattttataataaactttgtagataaataattcttccctaagaatgcttttgtctggacacctgaccaaagtacagccatgttccatgcacataaaatcactcagacttgagtaagcagaagaacattgaccagaaacataaacaaccaagcagggagctaaatgataaggatactagaagatctgagaagatagaaactcatgcatatagctatatttcctttaattttcatgtggatattctctgttggaagataatgttccaggttctctattccctgtttttccccaaaatacttattactctcccgttaattatgatttgccactttctgtatatgatgatgaaggtatggctatgtggacagtaaagacagaaacaggccaggcatgttggctcacacctgtaatcccaacactttgggagactgaggtgggaggattgcttgagccccaggggttggaggccagcctgggcaacatagtgacatagtgagactctgtctctaccaaaaaaaaaaaaaaatagccaggcatggtggcacatgcctgtggtcccagctactagggaggctgaagtgaaaggatcacttgagcctgggaggtggaggctacagtgagccgtgatcccaccactgcactctatctgggtgacagagcaagaccctgtctcaaaaaaaaaaaaaaaaaaaaaaaagacacaaacaaaggttgagaatcactgatctagaaattacccacatttcttagcatgttcctaattttagattcactagcacatttggtctgacctttgaacttataactaaggcagaggtaattcagtgggaagagtgaggaagaaggaatagtctcccaaccttcgaggtgtttagatttggcttaaatttcaggaataggaataaaggccagaaactactgatgtaaactttattttttctgaccatggaggaagtcaatccagaaaacagctgatttctgtacagtgcagtacccatgtcaatccatgtctgaattaagggactttagtcatacagagtgagaatctgggaaaaattacatctgggggtgatgccttttgatacgtgattttggaaaagcttcttaaatgatagctcttctggattcctgacttatgcctctaccatatcttttcctgtcagttcagagattattctggagactgtttctgcgtatgctagactaatatatcagatatctgaaacagtctccagaatgtttagtctgtaactaaacagtgtttagtctgtaaacactgtatgtttcaaagctttctttaagtcacttgtttggagctcagaattcatcaccccaaagaatcagtgctctcaatggtgaaattaaaaatcagtctaagatttagtttccaaaagaaaggcagtatggaatagtggggcaaatgatgaaatttggagtcagaggcgtggccttgagctctggttgtaatatttggtagatgtgtgatcttggacagattattaaacctgcctggatttgtttcttcctatataagataggaatagtactattcatccctcaagatagttgtaaggaaatgatttaattaattgtaaaaattgatttttaagcagaaggtactctacacttgtcagcgatttattatttctcacctacactaaccagtgttgtttaaactataagaatcataactttctttttcaggaaaagtatatcacgtccttaatagtattcccagtagcagaggtgagatagggaacacatttctctagaaatgtcggtttgctttagctgcctagggcagtggttcttagactttggtgtgcttaaggatcatctggaaagcttgtttaaaatgcagaatcccaggtgccagacattcttaatcagtatatcttagggttgagtccaggaatgatcattcttaacaagactcatctgtgattctgatgtatgtgctcctcaaatcatacatgaaactattctagtaattaccttctcctgtatttgatgctcagatctgatactccagtctacatgagtagctttccaaggagcacacacactcagtttgtacacactcagtttgtacagtttgtacacactcagtttgccttgggaaatggtcgggggaggaagagattattttcatagaagctcattctatctgaattctttcttggcattaatcataccttgcttgctctagtgcactccccatcccttaactgtaggttgtcaaagtgttgtctatacaacagaaactcctgagttataaaaccacaatctcagaaggtagggcctggaaatctgatttttgatatagtcttcagtagggtcttatagacactagagattgagaactggcttaacagttgctcttctacagagtcatgactttgcctcagctctgtactaatcattttctgtgtaaccatttattgaatctagatcatttcatctttatgagacaatctacgataataaaaaacaaaacaaaaagaagcaaaccctggggaaagaagagaatctgacttccagggttactatcttatttgattcaaatgttcggttttcaagaaaaaaatcataaggcataaaagaaaaggaaaatatggctcattcaaaggaaaaaagtaaatcaacagaaactgcctctgaaaaagaagtgatggtggatctattagaactttgaaatagctgtccgaaagatactcaaagaactaaagaaagatgtggagagagtcaagaaaatgatatatgaataaaatgtaaatatcaataaggaaaaatcctaaaaagaaaccaaaaagaaattctggagctgaaagtagagtaactgaagtgaaaaatttactagagggattcaaaggcatttttgagcagccagaagaaagtatttgtacacttgaagataggacaatggaaattgtcaagtatgagaaacataaaagaaaagattgggaaaaagtgaacagagtctaaagaatctgtgggatacccttaagtggaccaacttacatattttggggattccagaaggagaagagagaaagtggcggaatatttgaagaaatactgcctgaaaacttcccaaacttggtgaaaaacatgaatgtaaacatccaagaagctcaaagaactccaagttaggtgaatttagagacccacattgagatacattataatcaaactgttgaaaaccaaagacaaagaattttgaaggcagcaagagagaagtgactcataatttagaataatccccctgttatatgcaggaggaaatgctccaactttttcctactacacaaattttacagatagatttgttcttaccatagatcttagcaatctcaatgcacaatttgttttttctaagttgagaactttcaccttttcacttaaaggaaccactctacaacttctctttggcatatctgaatcgctagactgctcttgggctttggggccatgttacgtgtaatagtaacttaacacatggccaaggaagttatattcaggagatactttgtcccctgtagaaactaaagataacatcataacatatgtctttgagttgctttttggaaacctggactcccactagatggatctgctggcgcatagacctcagataagagggaactgagaactaaactctaactgctattgtttgttctaattttctttttgaagagccttcagaaggtcatgcccataagccagagctaacttttttttttctgatcccgaatttttagacaaagtttcacctccttaaccaatcaccaaccagaaaatatttgaatccacctatgacctgtgtgctcccatttcaagatgcccctcctttttaggtcaagccagtgtataatctccatatattgatttatgactttgcttgtcacctgcctttaaaaaccattacctgggctgggcatggtggctcatgcctgtaatcccagcactttgaggggccaaggtgggcagatcacttgaggtcaggagtttgagaccagcctggccaacatggtgaaaccctgactctactaaaaatacaaaaattagacaggtgttgtgccaggcacctgtaatcccagctacttgggaggctgaggcatgagaatcacttgaactgcactctagcctgggcaacagagcaggacactgtctcaaaacaaacaaaacaaacactgtctcaaaacaaacaaacaaaaaatccttacctgtaagccatctgggagttcaggcatgagctgcccagttctctttgtttggcgtcttgcaataaatgcctcactttctctttctgctatcagtatttggctttgctgaaaatttaaacatgtttttgcatcaaaagacacttatcaacagagtagaaaggcagctcatagagtgggagaaaatgtgtacaaatcatatacctgataagggattaatagccagaatatatggtcgagaacagtggctcacacctgtaatcccagcactttgggaggctgaggcaggtggatcacttgagcccaggagtttgagaccaacctgggcaacgtggcaaaaccctgtctctactaaaaaacacaaaagctaggcaggtgtggtgccttgtgcctgtagtcccagctacccaggaggctgaggtaggaggattgcttgagcctgggaggcagagtatgcagtgagccaagatggtgccattgtactccagcctgggcaacagagcaagaccctgtctcagaaaaaaatatatatatgcagaatatataatactataactattactcaacaacaaaagaaacagcccaattcaaaaatgggcagaggacctaagtagacatttctccaaagatatgcaaatggtcagtaagcacacaaaagcatgctcgtcactaatcactggggaactacagatgaaaactacaagataccacctcatactcattcggatgactattatttacaaacaaacagaaagtaacatgttttgaggctgtggcaaaattggaacctttgtttattactcttcgtgggaatatgaaatggcacagccgctctggataacagcatggtggctactcagaaaattaaaaacaaaatcattatatgatcatatgatttcacttctgggtatatccccaaaagaattgaaagcagggtcttagagatatttgtacatccatgttcatagcagcattatttacaataactaaaacctagaagcaactgaagtatccatctagggaagagtagataagcaaaatatgttatatacatacagtgtaatattagccttaaaaaggaaggaaattctgacatattctacagcatcaatgaaccttaaggacattatgctaagtgaaataagccagtcacaaaaagccaggcgcagtggctcacacctataatcccatactttgggatactgagacaagaggatcacttgaggccagcagtttgagatcagccagggcaacacagcgagaccctgccccccgacccaaaaaaaaaaaaaagacaaatactctgtaattccatttacatgagatacttaaagttgtaaaattatacagacagaaagtggaatgatcgttgccaggggctaggaggaagggacaatgagagttatgtgtttcagatttggaagatgaaaagagttctggacatggatggtggtgatggttgtacaatatgaatgtatttaataccactcaactatacacataaaaatcgttaagttggtaaattttatgctctgtgtatttaccaggggagaaacagaaaaaaaataactgttggctgtttggtctcactccctccgtctttactctgtaacccatcttctgtttgagaggccacttcagtaatacagattatataaggaagtaaagagatatacaggtgaaagaggaagaagtaaaaaaagtgacctaagtttttttatctaaagatttttaaagatgaggtttgggacacaggaggaacagattgtattgctaattgagtgattgctgtttggtctttgaatctgaggtgtctcaaggatttctgtgaggagaaaaatgggtatcttgcctgcaatctgagacatcagaacttccagagacatgagttagcactagggacatagttttggatgtaatcttcgttgagctcattgctgaggctgtagttatgcattcagttgacctggagaaaatagtgtcaaaagaagggactgaacagggttgagagagaaagttgatgactaaaagaaggagatgtattggcaaaacatcttgagaaggaacaaatgggattgaaagtattaccctacttgtagagagtcttttttttttcaggaaagacatattatttctagataaagtgattggcattcaaaattttgaggaaggaaaggtgtgcttcccatattactgctgcaacaatatagctatttgtttccatttacatgagtttttcttgagttattatttactacgagtgactcatagttaataatgaagatagttcaaagataattttaaaacattgcattgtagatcctttcttaaaaatattttctaatgttcataacacgccttgctgaattggaatggagaaaattaaaaatcttcatactagagttctttgttcaagctttttttttttttttttttgagacagggtctcactctgtcaccagtggtatgatcacagttcactgcagccttgacctccctggctcaagcgatcctcccacctcagcttctggagtagctgggaccacaggtgtgcaccaccttgcctggctaattttcattttttttgtagaaacgggatctccctgtgttgcccaggctggtctcaaactcctggactcaagtgatcctcccatctcggcttcccaaagtgttgggattatagccctgagctaccatacctggcctgttgaaactttcaaagttgcgatagatttatcagcgcagtgtttgttagaatgcttcgcaaatatttatttgttaaaatacaatgccaacctattttaatttccttaaaagtaagtgagaaaaatatacttgggaaaataaagttgcttaaataggttttctcaactgccagaaaaaggtactgccacagcatgtttctgcctgtaggtaggtgtggctccactttgtgtatgcattaggtttgtcagtgaaaatctcggtagtttgcttggttgctgaaataaatcagtggttagtttgtacacagaccctgtctgcataattgcaactgaatagctttgcccacttattgaaagaatggttctctgtttgggatgatcagaactcattttatattcagtctttggataaaaatgtgattgttcatttttgtagatgtcatttgttaaagattctagcagtaacaaggaaaatgggaggagggaaatattatttcttgactagaaaaagatattgtgagtatattgaacaagaggatcattttgagtatttctagtatatactttcacttctcagtttgttattggtgttttaaaaacttgtgatgaatttagagtgaatgggagcaagagggactaaacttcagagaatattattttagctcacagtgcagatctatatcacctatactttagatatcttttaattaaatttttatagattaaaaatcaaatattactgaaatattgatatatgtgtgcatatcaggttttttagggtaataaatttgctcaacttggacttaagtttttgtgaagaattcttataagtgttgatttctctctaattagctatgtggaacaaacgtaatttcctaaaaagaagtaagctagtaataactttgattttatatttctccttaaatgacaaaccaattttactaccagaactcatttcaaaagtatttctgggctatttgtatgactagctcattttgtgaaataataaaatacataaaaatagtaaggctcagtaacttgtccaaataaggtatttttgaggatagtacacatgcaaattattacttcatatcacattttaaaagggcttataggtttgaaagttttcatatagtaggggtgttctgtctgtaggaaatgtagtaagttgattatagcaagaattttaattcctttctcaaaaagggaactgtcagtgtcttctattcttttaaaaaatcttaactgccaggataaaaaagcgaagcaagtttttacggacggtagtaggaaacatttgcctcactatccaaataattatgtgtactcattctaagtttggtcatttttttaaaaatataagtcagttgagttgagtaataatgcacaaatttgagacttgttgtatactttattataatagcaacaatgtttacaaaataaaatcattttgtaatgatttctgtattgatacagtggcaaataaaacaagaacatgaactatttttttctcttattcttatccatacatgtaaactctttttagagaagcttaataaagaagtagtacacacttgaccaaagaaaggggacatttattttttactatgagattttgcatctaataaaattgcttgtattttcttacaatgttgttcatatggaaccagaacttgttatgtataaatataatgggatgagaatttacatgtttattagaagttttctgatatttataggccaatatatttaaaatatatatattcagaaattggaaacatttaaactgtcaaagagtagataataggttaactaaatgatggtattactctgagagactatagtacatacaataaagacatgctttgaaagtatatatattaatatggaaaaatgaatgttataaaacaacatatgtggaaaaaatgtgaacttatgtaaatatatacttgaagtgctgcaaagtgtagaatctctgagtgataggacttgtctttattctttatctgtatttttataaaatttctatattttgaatatttatatgtaaagactcgttttagctctataaaattgatctgtagaggtatttttcatctataaaagtaataaagtccagtaaaaaataatatatatatacaatgctatattattgtatgattttcttatgtgtgattttcttattattgtatgactttcttctcttgtgctcttctaagttatataaattctccagcacctgagaaccaaaacagacaaaaccaaaaccaaagacattggaaaaaaaaatccaaattactatagagtacaattcctcatgcatatatattccaaaatcattaaccaaatactagcatatggaattcatcaatgtataaaaaggacaatatattacaaatgactggggtttatctaataagaaatggaatgttcatggactgaaagattgaatgttgttaagatgtcagttcttcccaagattgatttacagtttcagtgtaatcctaatcaaaatcatagcagggttttttgttgttgttgaaatcaacaaacagattctaaaatttatatagaaaagcagaggaattagaatagccaaacaattttggaaacaaaaatagttggaagaattgaagtactgatttcaagacttaccataaagctacaggaatcaacacagggtggtattggtgaaagactagacacatagattaatgtgacaggatctgaatccagaaatagaccttacacatacttaatttttgagaaaggtacaaaggcatttcaatggtgctggaacaattgtacatctgtatataattttaaaagaacatctacttggattctgcactatgtacaaccaaaaattaactcaaaatagattatagactaaatgtaaaatgtaaaattactgaacttgcagaagaaaacagattaagatcttttttattcaagagtcaaaaagtatggttcatgaaagaaaaaaattgataaattgttctttgaaattaaaaagatctgctcttaggaaaaactattaagataatggaaatgaaagcatggattgggagaatatatttgcaaagcatacatctgataaagggctgttaatccagaatatattaatatgtagaactctcacatctcaataataagaaaatgaacaatttaaaaaaaaaagacgcaaaagatttgaatagacacttaaccaaagaaaatacagggtggggccaggcacagtggtttatgcatgcaatcccaactacatgggaggcttaggcaggaggatcacttgagcccgggaatttaaggttgcagtgagctatgatcatgccactgcgctcaagcctgggcaacagagtgagattttgtctcttaaagaaacaaacaaacaaaaaacccacgatggcaagtaaacacatcaaaagatgttcaacattattagttattagagaaatgtaaattgaaatcgtaatgaaataatactacatacctatttgaatggctaaagtaagaaataaaatttcaagtgcaggaaataatgtagaaaaactggatcttcatatatggctggtatgaatgcaaaatggtacagcaacattgaaaaactaatagtttcttataaaattaagcattccattatacaacccaaaaatatcattcctagtaattaacctaagataaataatatgtccacacaaaaactcgtatgcaaatatttattagcactccaaactagaaacaactccaactgtcctttaattggtgaattgaataaacattatggtaatttatacaatggaatactattcaccaataaaaaggaatgagctcctcaaatggctatatacttaaccatttcatttacacaacatgctggaaaaggcaaaactgtaggagcagatttgaaatcattattacctgggaggtagtagaaaggactgacaaccaaggggaattagagaactttttggagtgatggtagtattggaagtttggttgtcagattcattagaactgtatacttaaaatgggtgaattttttgatatgtatgtacttctcaaaactgatttaagctgacgatcttttttaaaaaattaatatagaaagaaaagaattcaagttagcattcttcatcacttagtaaaatgaatgattcaggcaaagatcatgagtggatgccaaaaccatgagggaaagtgttactgtggtacagtacattaacatggcctccatagattattgtagccgttgtaatttgaagagatctgggtcaccaccttaagcaagttatcaaattcagcattgctgacaaggcaagaactggacagtatgtgcctcctgacttggagtaataggaagtacacaacagtagcagcatcacctatgaattattctgatccaaaaaatatttaaactggatatagttaagcctgtaaacctaacttccactttacaggaaataaagcaatgagttaaattacagcatgagaaaatggacaaatccagaatgtaggatattctctaaaatgacttgcttgttactttcaaaaaatattcatgtaataggggaaaaaacatacataggtgaaaagagagataacagatatacagtacttgaatacggattgatcctgatttggagaggaaaaaacagctctgaaagctgtcttggagaagttgaaatttcaatataaactgactacattcagtgacattaaggagttatctttcatttttcttaggtgtggtaacagtattgtggttaagcacgagaaggtctttattgctaggatatgatgagtattaagaagtgaagtgtcttgatatccataagttattttacctgtacccatacacacaaaaagcaaaaaggtaagaagatgttaatagttgtctctgggagtgtatatatgtatgcattagtattattgtttccactgttttctgcaagtttgacatttctcataatagaagggaatgcttttagagctaagttgagagaaatagtgtttattgaagatggccttattatatgtagtgcattcctgcagatcctatgactatcagggatctgtacctacattgtacacctaagaataactgtattgcactctgttttggcattgtaacactggcctacattgagaaccaggatagaaaacagttctgtgaaatgctttgtgttgtaaggacatttttgcgagcatcgcttactgtatcacatggtataggaaagatgaaactttgcacttcagtaacaagaatacttgtgctgcttctgagaaactggatttttggcatgttacagacaatgagttatgttttactgggtgctagaaagctcagatttcatttgtggcccatctctaacaagtgcactttccagctgcactcctgactgctttgtaatttccctcctgcccttacttttctctcattctgattccctcctctattttttggttgtgttttgtaagatactttatgtccaacaatgttctagccatatttaaaggaatttaaataatgtagtttatgatttgaaactcacaggctaaagccaggtgctgtggctcacacctgtaatccaagcaccttgggaggccaaggtgggcggatcacttgaggtcaggagttcgagaccagcctagccaacatggcaaaaccctgtctctactaaaaatacaaaaattagttaggcatggtggcgtgtgcctgtaatcctagctactcaggagcctgaggtaggagaatcacttgaacctgggagacagaggttgcagtgagccaagatcatgccactgcactccagcctgggcaacagagtgagactccgactcaaaaaaaaaaaaaaaaggaagcagcagcctaaaagtcagattttcacattattgttattagtcacgtgagttcttgcccccaaatccagggatcttttatcctctagccaaatttagaataagggactctttccagcaaatttcaaagtacctacttttaaatatgattaaataagatataaaagtttctatttctggagtaacattgttacagcagtagtggcataaaataccttattttaggagaagagtactgcagggaaaagaacaaagccagtttatggaaatagatttttagcattggaattggcattggcatttttctttgagaatttcatttttttaattctgtttttgtttgttttttgttttcagttaagaggagtaaacaggcctttgttttacctttggcaattctgaaagaattatgtacaaaaaaaacctaaggaaaaattattttagttgcttttgaatggtattcaaatttcttttcaactaccgtagtatcttccttctgttaaatgatactttataaaatatttttcagcatcagcatgttgatacagatataatatttacaatttgctcttgctaccttcttgggagttgaagtcctttctcgcccagcttcttttttttgttttttgttttttttttgagaaggagtttcgctcttgttgcccaggctggagtgcaatggcacgatctcagctcactgcaacctccaaatgccaggttcaaaggattctcctgcctcagcctccagcgtagctaggattacaggcatgcgccagcaccccggctaattttgtacttttagtagagacggggtttctccatgttggtcaggctgttcttgaactcccaatctcaggtgatctgcctgcctcggcctcccaaagtgctgggattacaggtgtgagccaccgcacccggccctttctcacccaacttctgtatggcattactgtgttaaagatatattgtttgacaacaaatagaatgcttaaagcagcaataacaacactgactctaaaatatatgttgtataggccgggtgcggtggctcacgcctataatcccagcactttgggaggccaaggcaagtggatcacttgaggccaggagttcgagaccagcctggccaaatggcgaaaccccatctctactaaaaatacaaaaattagctggcatgctggtgcacgcctgtaatcccagctgctcaggaggccgagacaggaggattgcatgaacccaggaggcagaggttgcagtgagctaagattgccccactgcacaccagtctgggcaacagagtgagactctgtctcaaaaaaaaaaaaaagttgtaggaatgatggctaagacatttttaagacgttatgtatatattaagtaggcatgttttttgatgttccttaagtttattctaactttgaaaagtattcatttgataagtaagggtttcttctttcactgattcctaagttcagtggactcttccactgaagattttttttttcttcacaaatctggaaagtagcttgttgaacgaactaaatgacctttataggcttttgtatttataaaacttttgattttatatttggacagacttaagttttaaccttaattacctatgatcttctaccatgagggatacactaaaagtaattgccaaaatagggttaattgtaaatataaatgtgaataaggttagattgtcatttccttccccccaggcagaaggattcctagaactaggattaactttctttgctcacatctctggaattcacttctgttttgccaaagaatggtaaaacaggtatatacttttctttcttctgcacctatttttaagtgaaaagtactattctttctcattcttactctcattaatttcttaacacataaaaatcaagtttaatttgatagtagtgcctgttagtcatatgaaccctgtacaacatatctatttatactgcttcacacatcactcacaggacaagttcccacaaagacctgttttgttctactgttgatccaccctaaagaaaccagtttccaaactctgcacagctttgtaaatcaagatgaactggtcagaaattggatacagaaacaaacaaggaaccaaagaatgcttcctagttaacaagcagaatgtgttatatacaataaaattgcaggtagtgaaatgtctgtgttctaagaatgttccaattaggaagttaatatcacattcatattgaagtcatagttcaaagtcattcagttaaggaaatataagtaatgcttagtaagatgttctagacgacagagaagacaaatgatgaatgtgaactttgcttctgcatttcttagctagctttgtccatgataactattaataagtacaaaggttgagaggacgaagagtttggtgtgtaggcacagatttccttctttctggcaacagttaggggcctagagtaagcaggggatatagtagcatgcagaactgggactctccatctatgtccagaaggaaggaatgcacccatacacaatttgtaagtaacagaatgtatttctcatcacaaagttaaacataatatattcacacttcctgatggtgaagattccttgaagaaagagaaaaattaaataaaatgaaatatattcacagcttaatttatggtttttcacaatatttctaaaatattttctcattgaataaatgttttatcaaatattttatctttttgtttagaactttcaagaatatcaagcgctgttcaaaaattgtttctttcagatgatctgatgtaaacattgtgcttttaacttaatatctaatagcctcccaaagaatctgcatacttgtggtgcatttctttctccccttgagaaattttaaaagaaaacaaaagaagcaaagaaaattttaaatgtcttctgctcattattccaacaataggcaaagaccaagctttcacagccaaagcaaactagagaattctcagagtactcagtgaaaatatatagtctgtgtcctgaatcaaatgagtatgttacaaaaatataaaactattagagaaaatacatgacacatttaaatttttcctatcttccttctttcccaacacattttgaaaagaaaattacaataaaaaacttttccttataaagccctttctccactacagatatttacatacaaatacatattatttaagtttgaagaaaccaagttagtagggggaacttttctaaaacttttttaacatgagaattcaaaagcataaaactgaaaaatgaaatgcctttttgcttccagctgcttctccctggcaccccttcctcaaatttcagtctctgttctcttcaacaaactgacaattcaggacagcccaatttctcagtttaattccaactcacggggaggatttgaattgttgaaatgatagtcttcaaatatgagcaaggttttcttttctattattatgtttttattgagatataacttacatactatgaaatacacatatcttaactgtgcagttttgagttttgacacatatatacatcagaatcaatgggaaggttaaaaattttctagatgagggccaggccccagtggctcatgcctgtaatcccagcactttgtgaggccgaggcgggtgaatcatgagctcaggagttcaaaaccaccctgggcaacatggtgaaaccctgtctctactaaaatacaaaaaattagctgggcatggtggcacgcgcctgtaatcccagctactcaggaggctgaggcaggagtattgcttgagccccaggaggtggaggttgcagtgagccaaaattgtgccactgcattccagcctgggcgacagagtgagactctgtctcaaaaaaaaaacaaaaaaaaaagaacgattgcctttgtaagaaaaaataacaaattgagtaatatacataaaaatacataatatatcataaattgttatgcagattaaggttcagttatattttaaaacttacatctcatacactcttttatgggatttgcaatgctggctcacgcgtgaaattctcaatttgtctttctgtttgtttttaagaaaattaatgcaaaacttcatgatggagtatgtcagcgctgtaaagaagttcttgagtggcgtgtaaaatacagcaaatacaaaccattatcaaaacctaaaaagtggtgagttaagattcttcattaccttacttggtggtatatgtatcatagtttattatttcatttcctgattttcaaaattgtgtccaaataaatgttaaagtaaatgatgaaaaaattccattctcccctgtagaatttcatcttgtgtgctgaatcttggtttgtgaaggccgacagatttaaaaagttaaattcatcatttcctgccccattctttcataaatatgcatcatttttatagaactttattcatgaaaggtgggttagggctgagaagagagtatttgttttctacaattctgtcttccactgataaggtaatactatgcaccataaattatcaattcttaaaacggatcagacctttagaccttttaattcaactcatgaagattacagaaatggctgaggttaaatattagaagtgaatcactagattgataacttattatttctttgggaatagaggtctaaatgaaaagatactagattttgtttctgatcctgccatccctaaatccttttttttttttctttctttcttttttgagatggagttttgctcttgtcacccagcctggagtgcactgatgcaatttcagctcactgcaacctctgcctcccaggtttaagcgattctcctgcctcggcctcccaagtaactggcattacaggcgcccaccaccatgcctggctaatttttttgtatttttagtagagacggggttttgccatgttggccaggctggcctcaaactcctgacctcaggtgatctgcccgcctaggcctcccaaagtgctgggattacaggcatgaaccaccgcgcccagacttaactcttgtgtaattctggggttctcttatatcagccttctgtgcatcctctacagctccctgacatccttcagctcagctgtgtaaggacaatattggagagtaattgctgcatgaaagagaaaagtgattatcttaaataaaaattagcattgttccttttacattataagatttaatttggtaatctatatagtagctatttagactatatttgctctctgttgccttatttttctgactattcaatagtttcatcatctttgaatgcattccttcttcctttatgggaaaaaattttgcttacagtttagaaaatcagtctaaataatagatacaatatgacctttgtttatatctactaaaaaattatgacagccttttgcaaatctgaaacttaagatataaaataatttgtttacttcaaaatatttgaacactgaaaggcaaaagtgttaaggaaggataaactaacttaagctttttagatttttttttctgtactccgttttggagcagtctagtatttattacaggtatagttgaccccccttttgttttattttatttatttatttatttaatttattttgagatagggtctcactgtgtcacctaggctgcagtgcagtgacataatcttagatcactgcaacctccgcctcccaggttcaagcaattctcctacctcagcctcctgagtagctgggactacaggtacataccaccatgcctggctaatttttgtatttttttggtagaaacaagatttcactgtgctggccaggccggtctcaaactcctgacctgaagtgatccacccacctcagcctcccaaagtgctgggattacaggcgtgagccacgcccccccccccccctttaaatagttttaccagcttcttgctccttttagtcttttcttcctctagcatttcctcccaaaagaaaacactcttaaacaagtctgatgagttttatgcttagtggcccaaattagcagtaaggaaatttggcaactatttgcattacccaattttagatttccatgaatgaattgtgttctctgctagagtaattagatgttgattgcaaaataaatcatgtagttttagttaataggcctcatacaagatttgtagctttctgaatattttcaacaagtttttattcctataaaggtattttaagatttcatgatccatctccattttctctttatagtgttgtttcctaaaagaatttgaagtgtaggcaataaacaacatttatgtagtcacagcattttaatagattagtgctgtgtaacaaaggaaatgatttaaaaacattcctgccttatccatcatcagtatttaaatctcttacctttaatatgtgctaaatcctatatgtttatcttcattttaaatgtgtcagtgtgtaaaaaagatcacatcagttattgtaaattttccagatgctatattttgctgtagaacttctgaacttatgtattttgttttctcgcgacagagcaagactccatctccaaaaaaaaagaaactgctagttaaaacaagatcttgtagaggaggaaaaaagtcctttccttctaccagtctaagttctcacccttggctctctaacaaaaaccagattaagaagagaaaaatatacagatttatttaatgtaagctttttgtgacaccaaagccttcataaggaaacaaagacccaaagaaatgggtaaacctgtgtggttttatgctaggtttgatgggagtggaaaatcatggggaaaatgtgataggggataaaaacaaagggctaagcatagtaaactaaatgagctaagggtagtaaactaaacagcagggcttgttcattcagattcctcttactgttcctctgtttttagagataagcatggtcctttcctctaggtataggaagggcacctctcatataagggtcttatggcctacttcaggggtggatcagagagtccttcctacatttgctgtttgtcacatttcttcagctcaaaatactcagtatgccaaagcgccatattttggggtagcatgttctgaatcccatcagtctaaacatattacttaggaggttacttgcctggcctagaacatcatgtatttcagaaggtcctgaacacatggcacattagacatactggaaagcctagctttcaaactccaatccaggattgagagtgttatagaaagtaaaactcacttatattcattcacttcactttctctgcatattaagacttgaccaacattgtaagggatttgaatccattgcttatgctgatggtagcattacttaaaatgtttaatgttttgttcaagctaatcacttatgaattagatttgtcatttgttagggtttgtatatgaattttactggatataccttttgtctttgtttttttttgaggcagagtctcaccctgttgcccaggctagaatgcaatggtacggtctcagctcactgcagcctctgcctcctgggttcaagcgattcttctgcctcagcctctggagtagctgggactacaggcacacacatgccactgtgcccggctaatttttgtatttttagtagagacagagtttcaccatgttggccaggctgatcttgaactcttgacctcatgatccacctgcctcggcttcccaaagtgctggaattataggcatgagtcaccacacccagccttggatatatcttttgtataaagatttatttttctgccatgctgagtatttccatcagttaaaatgttgaatattgtttcatgtgtctatctattgccacaaattgtgtaactaaatgatgtagataaagaaaagttctgcacaacataaaatacagggcatggtggggctttttataagtgacatttcttttagaagtaataatatcctggatattgggaaaattaaaactttttctcccatttgtttaccttgtgaatcaccaaaaaccgcgtgttaattagcaaatttccatttgttcgtgcgatccaatgccaaaagttaaatcaaagaaaaagagtttgacctataaactcttcagacttacctgtttcaaccatgggaaacaaaaattttactgcgttcgtagctgacagaatattgcatgtttctctttttcttttttcagtgaggtgacatgctgcagtatttttataaacatgttctttatggaattttctctcagttactgaatacaatcctggaccatctccagagactttttagaaaagaataaatgtcctaacttaagttggaagagagatgaattgaaaattatgtatgtactgaaggaggataggatgatggctatgaaagatgaggggataaaaagcatctcacttatcagcgatacataaacagtgtgacagtggtactgtcctttgacgtaatgagataaatatctctgactactcaaagctttaggtctttataggaataaagtgataagctcataaagataaagcaccaagaccagccaccacccttaattagaagtcagcacaatctgtaccaagatcctcctacccatttcttaaggccagtacctactactccctgcgggagggctgcaatggtgctgtcagtatctcccttgacacaggatggcataagcattgttagacttgaaaaagagggttcagactttaagattattcatatatataagaattagggttcaggaaaagtctaaatctttttgtataaagttttatttttcaagtgccttgttttttacttttgaaaaagaaccccaaaataaatgaaaaccattcattaccattcctggtcaatcccaagtcattcatgaacctgtaaataatctcgatatggagctgaattgttggagaaacaagagatcttataaatataaaacaatcccagtcagtaatgcctatgaaaaaaataaacgtaaaaatatattaaataatttgtataaatcttaaggaaggaatcttgatatttttatacttaaaagtcattatagacatttatatatttttcaaggtactagaaatataaatgtttaaaagattttgtccctttcctcaagcagtgcaaggccagatgaaattagttattttctttattctgggctcagaaggattatacttcttaccaagacaaaagtaaagcagatggaggtaagattcaaatgcaaattgattggattccaaagccttgttttccttttctctcagtgatttctcagcattgtattattcaattcaaaaagtccttttctcctcttcacctggacctaatgcttcattaatttttacaaatatcacctatcttgtttatggacattgtctgctgttgagtaccacatatcctgctgaggaccaccttgcttttatttatttatttatttatttattcattctattttttgagacggagtctcgctctgtcgcccaggctgtagtgcagtggcacgatgtcagctcactgcaagctccgcctcctgggttcacacaattctcctgcctcagcctcccgagtagctgggactacagacgcccaccaccacacccggctaattttttttgtatttttagtagagacggggtttcaccgtgttagccaggatggtcacctcgtgacctcgtgatccgcccacctcagcctccccaagtgctgggattacaggcatgagccaccatgcctggcccagcctgcctttattttttaatacatatacttgtggaaagataattggattttgctttcaggccctgaaatgcctatgctggtacctagaaaccttttttgacttttatttcaggtaaccaagcaaccttttctcctattaatttagaaatgtggcagacgaatacccccatttatgtgagaatctcgagcctgcttttctctacctattaaaaaaaaaaaatcaccagcattataatgttagccaatgtttaaccttgccatagtagtagaaaagaaaagagaagctggtataaaacagcacagtcctcaaacagattggggtctgagcttggaactggacctgtgaattctttacatctgtggttctcagttaaggaggtggcttgaggatggagtttgtccccaggaagggtgctactgacacacagtgtaaagagaccagggatgctgctaaacatcccacagttcacaagacggcccgccacaataaagaaacacccagctcaacatgtcaagagtgtcttggttgagaagccttgctctgtaccgaatagatagatactcacaaagccaaggcactgaaacatcctgtatcttagttcagtggttttcaaacttttcagctgtcaaattctttaataaaacgcttatccaggagtcccatgaatacaacaggctaaaacagaactgccctaaatgaggagaagggagcccagaccttacaagctgtgtgataaatgttcactgaaagaagatttcatcataaaaatatttcaagtgaaggaggaaaaagctaatataacctgccttggaaccagcattactctagagatgtctggcctgagagtttcatgtcatgaggatgctttattccttaaaaaactgtttccttttcattaaatattttaattgaacagagtcactcttctggccctcacatccaggtatttaaccccaccagatttattgcctctcaacttttgttcccactgattgcccaagtgtaccccttacctattcatacttcattgcattgaataagtaaattctcctcttttaaattgatcgttgcatctcatctcacctctactcagatacctctgtggcttcagagttgactaaaccagtggtttaaaaaaaagtgggggagggaggcaggcacagtcgctcacacctgtaatcccagcactttgagaagctaaggcaggaggatcacttgattctaggagtttgagactagcctgggcaacatagcaagacctcatatctacaaataattttaaaaattagccaggcatgctgacgcgcacctgtggtcctagctgctcgggagactgaggcaggagactgaggctggaagatcacttgagcctgggcagtcaaggcagcagtgagctgtgatcacaccactgcactctggcctgggtgacagagcaagaccccagcttggaaaaaaaaaaaaaaaagcgtattttacataagttgagtcaagggctccagtggtgatgggtgggactctagcagcaggaggctaagagagctttgtcagcagagaagttctgcttttatatgtgtactataatgtgagagttggctggggggattggttggtcggggggagggggtcctctagactgtagggaaaaaggtgttactgtttgggagaaaatgagatgggggactgagatgttgccaaataggttatgttacaggacaggggtcccaatccagaccccaagagagggttcttggatctcgtgaaagcaagtttattaagaaagtagaagaataaaagaacagctactccacagacagagcagagccgagggctgctggttgcccatttttatggttatttcttgatgatatgctaaacaaggggtggattattcatgtctttgctttttagaccatgtaggttagtttcctgacattgccatggcatttgtaaactgtaatggtgctggtgggagtgtagcggtgaggacaaccagaggacattctagtggccatcttggttttggtgggttttagccagcttctttactgcaacctgttttatcagcaggtctttatgacctgtattttgtgctaatctcctatcttattctgtgacttagaatgtcttaataaccatctgggaatgcagcccagtaggtctcagcttcattttacccagctcctattcaagatggagttgctctggttcacacacctctgacagttatgccaccataaggctgccttcctaaccgtgtgcttgctccctctttgctacaaagctttcttgtaactaaattagccaaaccaagacgttaaagataatattttattaaccaacccctttcctttttttagcctctatttttaaagggaagaatttctatacccctaaaatgttgcttaatagagtatcactgtcctcatttttcaatgaagacaaattagtggacagagagatatattggccagtttatggttaaattcatgatagtttcttgcactcagtccttggcattgtattattgtatgtgtctatcaattggcattcattacttatatttgttcattgagtaagcactcaaggaaaccagagtctccttaaactagttgtaatcacaattttgataggttatgttaaaagaaaactttagacaaattaaatttaacagagtttaattgagcaaagaatgaagaatcaggcacctcccagaaccagagtagtttcagagcaactctcagggctgccatgtgcttcaataacggttttggacagaaaaagggaagtgacctttttctgtccaaaactgtccaaaggtcattttcctttttctgtccaaaactgaagtacataaacagctggattggttacagcttggcatttgccttatttgaacctactttgaacaattggctgactatggttggctgagacttggttactgttacaatagtaggttacagtcagtttacacatcaagttatgttacagttcagtatatagagagaaacctttaggccaaacttaaaatatgtacccaggcagctttaggccaaatttaatttatcagtagattccatctgtagccatccaagctgtacttgttctcagtgcttagaaactgagcataccactcactaggaggtacctgaggaataatgtatgctatatgcagtgatcagtacaaagtgagtccttgatctccatgcaatctgaatttgtagcatctgaatggagacctatgatttaaatggctaatttttatagtccgtatgttttaaccactttgacttgcctccattttgatatatttgtagtcaatgaaaaggaaaaataaatggatacaaatccatttagtttacaaataaatacatttgtagtcaaggaaaaataaatggattttttagtgcattactatgaaagaatttttacatgttttttcttctttaaagaatatgtttatttcaggacatctgaacattatatgccttattgtagaatcttctaataaaacaactgtttacatgctaataagcattgggtatcacaattggtaataggaaggggaatgcaaaagtttttttttttttttttttttttttgagacagaatttcgctcttgttgcccaggctggagtgtaatgcgcgatcttggctcgccacaacctccacctcccaggttcaactgattctcctgcctcagcctcccaagtagctgggatcacaggcatgcaccaccacgctcagctaattttgtatttttagtagagacggggtttcttcatgttggtcaggctggtctcaaactcctgacctcaggtgatctgcccgcctcagcctcccagagtgctggaattacaggtgtggaccactgcacccggcccacaaaagctttatattttataatacagttttagcgtcccaaattccaaatccaaaatgtcctaaaatctgaaactttttgagtgccaacataatgctcaaaggctatgtttataggagcatttcagatttcagatttttggatttggaatgctcaactcttagtattagcaaatatttcaaaacctgggggaaaaaaaaatctgaacacttctcaccccaaatattttagataagggattctcagtctatactagggtcatagccagagaagagtctttgacttgctcatattttctaaagagaaatagctaaagagaaatgaacaaagttaagtgccttcatgatagaatatatgacaagaagaaacagtatagaatgtaaaaggtcttggttaaaattgagtgtttaatttgtgtgtttattccctgaagactgactttttttttttttaagtagacacgaggtttcaccatgttggccaggctgaactcgaactcctgacctctgccagccttggcctcccaaagtgctgggattacagtcatgagctacagcaccggccaagactgactttctatagttttatgtttaccacttaaactaacatagcaatgtgattatttatccagttgatagattatcaagccccttcacatcctgccccaaatttcacccattatttttgttattaatttagggtatcagactaagtggaaatagaagatgaagttcatatcagttgtattcattacattttaaagatttattggctaagacagaagaattggtatttttaagcattgagttaaattttgcaccaaactccaggtgaaatctcagtcaatttcattgaaataagtaattattaaatatcatattactcagtgaaaaactgattacttactgctgcaaagaacataataaattaggaaggaaaatttgttctaaaatacaacaggagaaagatattaaatgattaaaacttcattgttagcctgttcctctctttagatgagtgtgtacctatgtgtagtttatttgaaaaatcaggtaagtttgtgatggcagaggttattaagatgaagatagtcaaaacataaatgctattttccagaatccaagcacaattaaaagatagtaaatacttcaacagtagtccaggtcttttctttctccttcctccccattcctcataaacacggtaaagatctactataaatagctgagaaaacccctgcagttgtgtatgtttttcccaccatgagccatgatacagcatcacttccacaaataaggattaggaatggcattgcagagaatatgtcttagatcaataaaatccttattagtaagaattgggatgtagaagtagctttggtattatagaacctttactggtattttggaagtgcagtctttgtactatttaaggtctgaatgatgtatcctttctagtggaattttaagtgtaaaaggttgaaaccagaacagttaagtcccttaaaactagaaatcatactctattggtgggaattttgagaattattgctggaattcttcagagaatgttcaggaagctggtgttgtttggggaaatagggtaaatggaaaggaaaagatcccaagtacttcaagctggcctaaggaggtaattgaaggtaattaaaatatatatatatattatatatatattttttatatttttatatatataaatttttttttttttgagacggagtttcgctcttgttgcccagactggagtgcaatggcatgatctctgctcaccgcaacctctgcctcccgggttcaagccattctccagcctcagcctcctgagtagctgggaatgcaggcatgcgccaccacgaccagctaattttgtatttttagtagagacagggtttctacatgttggtcaggctggtctcgaactcttgacctcaggtgatccgcccgcctcagcctcccaaagtgctgggattacagacgtgagctaccgcgcccggccagtaattaaaatattttaccctgaaaatatatttctttgatgtattttgaaatggctgccacttcaccatcctgacaaaagtggccttgcaaagctgtcttaagtagggaaaattggtatccgtatagaatctccattaatgcagtcataccccctcccctttctctttctttccccagatccaggagagactgagagcaggacacctttaaaagtctctctgagggaggctcctctacataaccaggccacttttgctggccaaacctcttccctgctctgctttaccagaatctaagcccccattctttctataacctcaagatattatataagtttctgaaactgttgagaacttggatcttcattctgaaggctcctgtgtatgcacattaagtaaatttatagccttttctcctattagtcaatccacctcttgtcaattatttttaacaaaactttaagaggccaagggccaatggctgccacatcatatatattatatattttaaccccagaatttgaattcagagtggacaaataagatatttattttaaatttaacattttcttcttttttttttttcttttttgggacagagtttcactcttattgcccaggctggagtacaatggcacgatctcggctcactgcaacctctgcctcccaggttcaaatgattctcctgcctcagcctcccgagtagctgggattacaggcacgccccaccatgcccggctaattttgtatttttagtagagacagggtttctccatgttggtcaggctggtctcaaactcccgacctcagatgatccgcctgcctcagcctcccaaagtgctgggattacaggcgtgagccactgtgtccggccaaagttaacattttcaaacctctgtcacatatgttggattctaataacaaccctgtagaggtagcaagaacagataaggaggtagccttagaaaaattaggtgtcttactctgtaagctagtaaacagtatactcaaaactagcatctagattttttaaagtttcataatctatttctggcttttattttaatgtcaggtccctaacttaagtagagttttcctttatagaaccaaaataatacctgttagaacaccttgtcttgtgtaaccaggtctgctgttacctgcaagaaccaagaagctggactggatgtgaaagataatttactataattcacgtgttgtattaagaacaaaattgtctctaggaacagtccatggttatattggggaataatattccaatcagagctcttaatttctgagcaaaagcaagattgttaaagatgacagataggaaactgcgttcaatttgcaattattttaaatagcatcctcaatgtacaagacactgtgttgtatgtcaaaagaagatagcaaatgaatctgtgacgcccaggaatttaccatctatttggagagagagactccacagataattctgggcagtttgcaaaaagtgctaggtgtgagtaaaaggagaaagagatgcagaggacacaaggtaaggctgcagaaaaatgaaatgaaacccagagagacaggtctagaaaaaacttaaaggtagaagagtggtatgaataatcacagtgataggaaaccctgtgaggagggaccagggaatggagggaaaatgaacaagaatcctgttgactttcatagacaatacagataatcccgggctgtctttatatgtcctgtttttttgttccacataaattatcatttcttcattcatttgctcttgttactttttcttttttctcattgcataacttttggtgatccatgaacagtaatcaaagttgcctatcaaaaggaggtttcagtctattttgaatatacattaaatgaaaagaaaactaaacttggaaagttggcttagggtctggatttctagtttttaaaaactgggttattatttttgttattttatcaaacaaaagtaaacagttacattttacaggtcttttttgtctgtttttgttttttgagacagagtctctctctgtcacccaggctggagtgcagtggggcgatctcagcttactgcaacctctgcctcagcctcctgagtagctgggaattcaggcgcctgccaccatgcctggctaatttttgtatttttaatagagatggggtttcatcatgttggccaggctggtctcaaactcctaacctcaagtgatctgccacaaagtgctgggattacaggcgcaagccaccacacccggccatattctacatatctatctgttccttcatgtttaccagtgtgtggcaatgcacattggccgtttttcagttccaaattgttttttttttttttttgagacggagttttgctctttttgcccaagttggagaaaagtgacacaatcttggctcaccacaacttctgcctcccgggatcaagtgattctcctgcctcagcctcccgagtacctgggattacaggcatgcgccaccacacccggctatttttgtattttcagtagagacgggatttctccatgttggtcaggctggtctcaaactccggacctcaggtgatccgcccacctcggtctcccagagtgctgggatttacaggtgtaagccaccacgcctggcctccagcatttcttataacaggctgaggctctgaaggttaattagtgatttgaaaattgggtcaccacggccaggcgcagtggctcacacctgttatcccagcactttgggaggccaaggcgggtggatcatgaggtcagaagttcgagaccagcctggccaacataagtgaaaccctgtctctactaaaaatacaaaaattagccgggcatggtggcatgcacctgtagtcccagctaccagggaggctaaggcaggagaatcgcttgaacctgggaggctgaggttgtggtgagctgagatcgcgccactgcactccagcctgggcaacaaagtaagactccgcctcaaaaacaaaaaaattgtgtcaccacattccaagagtattaaaatgttctagagtggagttttagtcattgatagctctttgtatcacatgatagtataaaataactgtaaactgtggctgtattgtcgtttgttgcccacaaccatggtcttactgtctttaaaggtgaaagcagtagagagcttttattacttccttcaatgcctctccagttcatgaggactccagttcatgctttgatttaaaattgcctgccctaaagtattgaataatttttattttttatttttcataaactacacttggtcagaggtaaatattttgtacccgttatgaattatgggctgtaaacccagtattttgggaggccgaggctggaggatgccttgagcccaaaagtgctagaccaacttgggcaacatagtgagaccctgtcactacaaaaaatagaaaaaattagctaggcgtggtgacgtgctcctgtagttccagctattctggaggctgaggtgcaaggattgtttaagcctgggaagttgaggcttcaatgagctgtgattgcactactgtactccagcctgggcgacagagtgagaccctgtctcaaaaaataaaattaagaattattgtaatctacttgtctactgcattaagacaaggtagtatatatagcctcttcatttactttcaaacttgtaatctagggacacaaggaagtgaactgtgtaataagttcttatactcgagatacttagaatttggggatattgtttccttaaaagcattctctaagtagcatatgatgttatcccatagtaaagttttatgatcttgctatgttgactacagatgacttagagccattgcaggaaaataggactttatgaaacttcagcaatgttgcgtttctgttttgtacaccaagggtggagtactgtggaacactgtttacaaaagtacctcgtcatcacatacatgaaagtacgacaggagctaaattatgttaaaggttaaagtgtaataaccaggaaatgaaggcagtgccagaagagttgtaatcacgtaaagtcttttatttctagcaagtagtaatctattttatgtcagtcccaaagggaaaccctaagaagatagaggagaaattttacttccttcaaacagatttgccagatgttgataggtttaattatacaatacaaaaagttgtgttactggctgggcgcagtggctcatgcttgtaatcctagcactttgggaggccgaggcaggcggatcacttgaggtcaggagttcgagaccagcccggcaaacatggtgaaaccctgtctctactacaaatacaaaaattagccaggtgtagtggtgcgtggctataatcccagctactcgggaggctgaggcacgataatcacttgaacccgggaagtggaggttgcagtgagccgagattgcgccattgcactccagcatgggggacaagagtgaaactccgtctcaccaaaaaaaaaggttgtgttactatgacaacagtgtcataaaaaaatcttaagcgttttttgttttttaactggggttgtggaagggatgatacagtgattactagtataatttgatgctactgtttttgttcatgctaagctgccaggacttttagtatccattataaaaaatgagactcagagaagttaaagtaactttcagagattacattgttaccgggggatccttgctcccagagctcccaagatggtggcaggccacttccaagatggcggtgtgctgcttccaagatggtggtgagaggtgacggcgtgctggcagtcctcacagccctcgctcgctctcggtgcctcctctgcctgggctcccactttggcggcacttgaggagcccttcagcccaccgctgcattgtggtagcccctttctgggctggccaagtctggagccagctcccgcagcttgcagggaggtgtggagggagaggcgtgagcgggaacccgggctgcgcgaggcgcttgcgggccagctggagttccgggtgggcgtgggcttggcgggccctgcactcagattagctggccggccctgccgccccgggcaatgaggggcttagcacccaggccagcggctgcagagggtgtactgggtcccccagcagtgccagcccactggcgctgcgcttgatttctccccgggccttagctgccttcctgcggggcagagctcgggacctgcagtccgccatgcctgggcctcccacccctccctggactcctgtgcaacctgagcctcccctaccagcgccaccccctgctccacggagcccagtcccatcaaccacccaagggctgaggagtgcgggcgcacggcacgggactggcaggcagctccatctgcagccccggagtgggatccacggggtgaagccagctgggctcctgagtctggtggggacgtggagaacctttatgtctagctcagggattgtaaatacaccaatcagcaccctgtgtctagctcagggtttgtgaatgcaccaatcgacactgtatctagctactctggtggggccttggagaacctttgtatagacactctgtatctagctaatctggtggggacgtggagaacctttgtgtctagcttagggattgtaaacgcaccagtcagcgccctgtcaacacagaccactgggctctaccaatcagcaggatgtgggtggggccagagaagagaataaaagcaggctgccccagccagcagtggcaacctgctggggtccccttccacactgtggaagcttggttctttgcaataaatcttgctgctgctcactctttgggtctacactgcctttataagctttaacactcaccgcaaaggtctacagcttcattcctgaagccagcgagaccacaagcccaccgggagcaataaacaactccagacgcgccgccttaagagctgtaacgctcaccgtgaaggtctgcagcctcactcttgagccagcgagaccacgaacccaccagaaggaagaaactccgagcacatctgaacatcagaaggaacaaactccagacacgccgcctttaagaactgtaacactcaccgcgagggtccatggcttcattcttgaagtcagtgagaccaagaacccaccaattccggatacagtggcaagccttgtgttctctgacctggggtgcttggcctcacggattccaaggaatgaaatcttgggccatgtggtgagtgttatagctctactagaagctgtgggtcacggaagagaactgtggaacccagtgactagtgtttagctcagttaggacgaacccgggcacttagccgtgcaggaacaatggcaagcctttagtccagtcaggagcggcaatgggcacctggtaagatcaggagcacagcggacaccctaccggatccagagggatggaagtcagtggtgggtctgcgacggcagcaaacagcagtggtggacaatgagtgaaagctcagctcgagcagtaacaaacagaccagaagagagtgcagttgtaagatttaatagagtagaaacagagctcccatacaaaggtaggggacccaaagagggtagccattgccggcttgaatgcctgggtttatatcccaattattgtccctcccactgcgctctcaggcaatagatgattggctatttctttacctcctgtttttgcctaattagcattttagtgagctctctttactacctgattcgtcgggtgtgagtttagttgcaagcctgatgtttaaaggtggatgcggtcaccttcccagctaggcttagggattcttagtcagcctaggaaattcagctagtcctgtcagtatgacaaggacatgtcaagggcgggctagaatcaaggtctccagtttcccaaactagtgttcttttcctactattttattgccagtgctcaagtgatcatcccacctcagcctctgagtagctgggactactacactctggtaggtggtgtgcacccctacacctggctaatttttgttttttgtatagatggggtctctctatgttgcccaggctgttctctaactcctgggctcaggcaattctcctgcctgggcctcccaaggtgctgggtttacaggcatgagccactgtgcccacccaatagtagtatttttaagaagtatattgtttcctttatcaagaaacatgtaaacagtggtgacctgtgtttttatttgaccatagtttccactaaaatgattagttgtggtatatgtatggtcagaattgtttgagtgattgtttctgggaattgtgtgtgttaaagtgaactaaagatagcttgataatgactccctatttctatatttgagtccttgtggatgaactgcaacctaatttaataggtagacaagattgaaaacctaagtttaactaacaggagtatgcgcctgtaacaatagctgagtcttggccaatcccagcagccatacttcaaccattcatacactgctgagtgttcaaactgttcaaataaggcaaatgctaacctgtaaccaatccagctgtttctatacctcccttcctatttctgtactgcactttactttttttgtctataaatttgttctgaccatgaggcatgcctggagtctctctgaatctgctgtgattctgggggctgcctgattcgtgaatcattcattgctcaattaaactcctttaaatgtaattcagctgaattttttcttttaacatgtgtattccataaagaaatgaaaagaaggcaaaactatcatcattttgacatttctgaagttttcttagcaatggactcataaaatacaatatagccatttttaagggaaatttggaaaaatttatatttaggagaatttaaaatttttccttaccattttagggaggtttgaatttttcccctgaagttttggtaatctgaatctataaaacaaacataatacatagattaacaagggaaaaggatgtacaaattttattgtgtgcatacgtgtgcacaggagtcatgactataaaaaaaacgcaaaggcaagatggttaacgcttttgtatcatcttgatgttacagagagaatggggggctcagattgtggcaaagcaggatattgtggaaagacagttatgagtgggggagaagaggagaaacctgggcaaaggcagtcttgttatgcagatgaaacctcacaggtggtagccccacagggcctctggtaaatgtttctgtcagacctttaaagttttagagctgagttgatctttcctagatccagacaagggcgggattcagagaaagcctgtttatatctgttgtttacttcactttatttcctctgcagatgcaaatcatcctcacaaaagacagctttgctggccgtttgtaagatgttcaaaatacttaataagttttgtgccaccctctggcttgttttttcattcttttaagagtgtgttttgaagaggagacattttttattctggagagggcccatttaacaaattattctttctagatcatggttttgttgttgtagataagatgtctttgcctagctgagggttcttcttctagaagttgtataattcttgattttatatttgaatttatgttctatttcttgttaattttagggatagtcagtttttccaacattgtttgttgaaaagactgtcttttctctattcagtttcctttctactatcttgaaaatcagttggtcatatatgtacgtgggtctgtttctggtctttattccattgatctgtgtgtcctttcaccagtactacactaccttgatcactaccttgtgataagtcttgaaatcacatagtgagaattctccaacctcatttttcattttcataactcttttggctgttgtaatttctttgctttttcttatacaaagtaattaatcattgctagaaacataaaaatacagtttatgtttgtttactgaccccatatattgtgattttattaaactcactgtttatgtccagttcattttaaaaaatagattcattggtgttttctatatagacagtgattttttcttctaaataaagacacttatttcttcttttcaatctctatgacctttcttttttttttttttttttttttggctgccattgcactgcctaggacctccaatatcatgctgaaaaggagtgttgagagcagatattcttgccctgtttctgatcttacagggaaggtattcagtctttcatcattaagtaggaaattagctgtagtttctttgtagttatctgtttttaggttgagagtgtttccttcagttcatagtttactgagagttgttataaacggatgttatatttttgtaaagcttttttcacatctaataacatcatcatatggtttttcttagaacattgctttagtgaattttttttattggctttgaatatactgaattagccttgtattcccaggataaatccattgctgcatatatatatatatagagagagagagagagagtgcatgcaagagaatgagcatgcgagagagtgagcaagcgtgtgtgcaagatgtttatatattgctggatttgatttgctaacattttgtcatggatttttacatctttgttcattagaaatactcatctgtcattttcttgtttgctttttttttgtcttgatattagagccttatcaaatgagttgaaaaatatttcttcctatttgtttttctggaaggatttgtatatgatcagtattatttcttaaatatttgatagaatttaccagtaaagccatttgggcctggagttttccttaaaaaaaaaaaaaaattaggagagtttttttagagttatgattaaatttttctttaatggatagaggagtatatttatttcttcttcagtgagttttgatattctttctttgcaaaactttggctatttctacagagttgttgggcttatatgcatagagttaaatctaaaattttcccattattctttgttttttgagacagagtcttgctttgtcatttgttagaaataaattttcggtgccaccaaagaaatagcactcaaacataaattttctcagcaaggcaattttacttctatagaagggtgtgtctcgcggatggagcaatggcaagagtacacctgaacaaaggaggggaaggggttcttatccctgacgcaggtagcctctactgctgtgtcgttcccctattggctagggttggaccacacaatctaagctaattccaactggctattttaaacagagcagggatatgagccagagtggcggggtgagcagtttcggcaggaaagacggttatggaataggtgactaaaggtgactcaggtcagagtaggtgaccaggggtgactcaggacggagcaggtgaccaggggaacagatgtgaactactgattagaactggcgggaaggttgtttactgaaactaggggcaaagagatgaagagaacaaggaagttaaacttgaaaatggagaacaaagaactgaacatactgacatactgattctttgaagagaaacttagaactcgctgtgtttaacacccaggctggagtgcagtggcgcaatcttggctcactgcaacctctgtctcccaggttcaagtgattctcctgtctcagcctcccaagtagctgggattacaccaccatgcccagctaattttttgtatttttagtagagatgtggtttcactatgttggctgggctggtctcaatctcctggcctcaagtgatccacctgcctcagcctcccaaagtgctgggagtaccagcatgagccactgcacccagcctcttattattctttcaatgtctgttagatctatagtgctgtaccatcttttattcctgatgtttcagtgtatgtatttatgaattatattgatcttttcaaagagcctgcgtttggctgcattgattttatttttctgttttcagtatcattgattctgttcttattacagcacccctttgtttgctttgagtttaatttactgttctattttctaaaggtaaaagtttagataacttttttgtttaatataatttgtaatcatgtattaaaataaatttctcaaggacttctttagctccgttttgtaaattttgatgcattttcattgtcattcaatcaaaatattttctttttgtgtgtgtgaattcctctttgatctgtgggttatttagaagtgttttattttctaaatatttgagcattttctagatattttctgttattgattttttgttaatttcactgtggcaagatgatatatactttatataaatttcagggttttttcttttttttttcatacaaagtttcactcttgtcgcccaggctggagtgcaatggcacaatctcagctcactgcaacctccgcctcttgggttcaagcaattctcctgcctcagcctctcaagtagctgagattgcagatgtgctcccccatgcccagctaattttttttgtattattagtagggacggggtttcaccatgttggccaggctagtctcaaactcctgacctcaggtgatccacccacctcgccctcccaaagtgctgggattataggcgtgagccacggcacccggccagttttttcttttttaaaatatgttgaggttggtttcatggcccagaatatggtctgtcttagagaatgttccatgtatacttgaagacaatgtattgctcttgtatagagtgttctaaaattgtcattttggctgataacgttcatacagaataagtacctcacgatccttataataatatacttccaattcctcccggccaattttgtattattgttgtcatacattttacttttacatattctataaatccataatatatttccactattttgcctgtagactctcaattctattctgatgacctatatacgtctattcttatgtcagtactacacagtctgggttactgtaggtttgtagtgtgttttgaaatcaatacatgtgaatcctcacattttattgttccttttcaagattgttttggctatcctgggtgcctagaatttctgtatgaactttaggattagcttgtcaatttctgcaaaaaaagccagctggaattttaatagagagttcattgagtctgtagatcagtttggggagtattgctatcttctcaatattctcaatattaagtcttttttttttttttcctgagatggagtcccactcttgcccaggctgaagtactgtggcacatctcccaggcatgccaccacacccagctaaatttgtgtatttttagtagagatggggtttcaccatgttggccagactggtctcaaactcctgatctcaggtgatctgcccgcctcagcctcccaaactggtgggattacaggcctgagcactactcccggcctacaatattaagtcttttcatataaaatatgggatgtctttccgtatagttaggtctttagtttctttcagtgatgttttgtaattttcagtgtattggtcttgcacttcttttattggatttattcctttattctttggtagattgtttcttggtagtgtatagaaatacagttgagttttgtatattgatcttgttttaacacatttttaatgacactttaaaaaattttaagagtggataaatatccagcagttttattctgcagctgtaaactgttatttagaaatgtgatataattaatttagagtgacataagataaacacctgaaattgaaacctaggaattttgatttcttaggctttttaactatacatttagacacatcttattttatcaaataagtctgaaataaacataaataagttaacattttattttttattttagtgttaaatgtttacaaaagacagtgaaggattcttatcacataatgtgcaggccatgtgcctgtgaacttgaagtttgcgcaaaatgtggaaagaaagaagacattgttattccgtgagtgtttccttttatgtttgaattttactcttagtgattgatacatgaatttcttttaagagatgatccttgctaggcgcagtggctcacgcctgtaatcccagtactttgggaggccaaggcaggtggatcacgaggtcaggagttcaagaccagactggccaagatggtgaaacctcatctctactaaaaatacaaaaaaattagccgggcacagtggcaggcgcctgtaatcccaattactcgggagtctaaggcaggagaatcgcttgaacttggggggcagaggttgcagtaagctgagatggtgccactgcactccagcctgggtaacatatagtgggactccatctcaaaaaaaaaaaaaaaaaaaagagatgatccgtgatccataacccttagacttaagttgtatgtcaaactaatatagacttttaaaattatttttctatcattacaataaaagtgaaactatatttttaagaaaataaaatatttatgtgtgagattcatattcattacaaaagaattacacattatttaacaacttttcttttaatagacatcatatattaatttatttgagcctactttagtgacaatagtattataattggttggatctcaagttagcgttcaatgattttttttttttgagaaggagtttcgctcttgttgtccaggctagagtgcaatggcacgatcttggctcactgcaacctccgcctcccaagttcaagcgattctcctgcctcagcctcccaagtagttgggattacaggcttgcaccaccacacccagctaattttgtatttttagtagagacggggttttgccacgttggccaggctggtttcgaacccctggcctcaggtgatctgcacgccttggtctcccaaagtgctgggattacaggcatgagccaccactcccaggtggatctttttctttatacttacttcattaggtttctgttattcaagaagtgtagtggtaaaagtcttttcaatctacatggttaaataatgatagcctgggaaataaatagaaattttttctttcatctttaggttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcatacatgaacaatataaattgtgtatattacttaacatcaaactaaacaagattcagaattgatggttgtataagaactagctcatgtaaaaataaaataacattattacattgcctcaaaaattggtcctcggtaagtgccttttgataaatgatctcaaataaatgactcatagcaa

SEQ ID NO: 1456 - DNA, 61875 bp, Homo sapiens
tttgttggtttcttttcagtgttttatttttcaaaatatacaatttaagtttttatttcacaaccgtagttttgtatatttattccaaaatctttaaatagctccgcagcaaacagtacaaatcacaaggtccgtcaaactgcttctctttagcctttacacttggcgagttttttaagtttcaagtagtaatggtttgtgggtaagaaaggaaccaaaaacaggaggaaacaacattttttacataagctcaacatgtaggattagaaagggccgtctgaccagctccttggtctgggaccagactaagaacatgtatctggtttataaataagaccgtcctgggagcagtgagggttttggttacgaggaggaaggggcaggaacctcatctgcggaggctgggaggcagggggaggtgaggcactgagaggtggctccttctgggagcgcccgagtaggggcctgagcggggtggaggccaagaatggccagggacggggtggggctgccactggtggagaagcctcctcagcctcccttggggagaagggctgtgattctggaggcaggggagggacggcaagaaaagctgccaggtcctaaagcaagcagctgggactcctgccagccaccctgggcccaacgacgcaggcagctggcagggccagaggggctgccccagggtctggggtggactgtgggaggcatcacgctgtctcttcttgcgagagctctttgtccacctcagagccaccaaagcctccccagaagggacagcagggaggacagggaccacagatcccacagacccacttctgactgtgaaagcgagctgtgccgtgcaggcagctcctaggcagcccatgaggctaaggcacaagggtgacacaggtggccacgagggctcagttttcttcatttccccttgcggctgctacctgtggccacggcctgaagcagtcctgtgggctgagctctaggcagggacgctccaggaagaagtgggtcaccaagggccacctggccaccaagtggatgtgaccctcctaccaggggtcaggagggcggtcctgcctcagggccccctcagcaccttccactaggctgcagggccggacacagcccatcctgcctggccaagccaaccttcttaatggggtctgaatggcgggtgggggtcgggaaggggccagggccgggctgagggcaggacggagggggtgggagttgtcactgcgtcttcaggtggggtttctctggagtgagggtgtggaaacagtaatcccacaatttagtgctgataccaaatcctagagagggagacaaacggggagaagatgaggcattgaaggagcaggcgtgcgctggcttgggaagggtgccagggtagggataagaggtggagacaatgtcaatatctgtccccttggccttcccaactcccgaggccattctggcagaagtcaagggtggggaacctgtgtcttttattgtccccagcatgaagctggaataaaccctaattccttatctggccttcgtttctaggctacgtggccccctcccaccccccacctccatctccttccccttccttggggcccaagttcattcctgcctcagggctttgcaccagtcgctcttgggacgccagatgctgatttctcttcattagggtcttagctctaatggcacctctgcaatgacacctggaccatttaatctctttgctgtccaactagcccttagccacacatggctactgagcactagaaatgtggctagagctccagagaaactgaatttctaacttcatttaattctgatgaattaacatgtcaatgtaaaaactgatgcttgattgagttactggaatttttttttttttttttttgagatggagtttcgttcttgttgctcaggctggagtgcactggtgtgatcttggctcactgcaagctccgcctcctgggtccaagagattctccttcctcagcctcctgagtagctgggattacaggcgcgcaccaccatatccagctaattttttgtgtttttagtagagagggggtttcaacatgttggccaggctggtcttgaactcctgacctcaggtgatctgcccgtctcggcctcctcaagtgtgttaccggaaaatgtttaagcatgtttggagcaacttacctatgtgaactactgtttgcaaattttataaaatctagatatggatctagtatttctaatgaaactttagtatctgaattgagatgtgctgtaagtacaaaatacaccttagatttcaaagacttagtataagagttgctaattatttttttttaaagagactttacaaaaagggtctcactctgtcacccaggctggggtgcagtggcatgatcatagctcattgctgcctcaaactcctgggctcaaatgatcctcttgcctcagccttctaggtagctgagattacaggtgcatatcaccacacatggataattaaaacttttttatgtagagacaaggtcttgctatgtttcccagactggtctggaactcctggcttcaagcaatcccctgcctccgcctcctatagtgctgggattataggcctgagccactgcgctcagccattaatgattttttaatgttgattacatgttgaaataataatttgcttatgttaagtaaatgttattaaaattcttttcatctgtttattttcatgtcttagtgtggccactagaaaatttaaaatcacatatgtggcccacataatatgtcagtggaaatcgctggaccctcccccacctatgtgatattccatcaccttgctttactttcttcttcttcttctttttttttttttttttatagacagagccttgctctgttgcccaggctggagtgcagtggtgcaatcttagctcactgtagcttctgcctcctggattcaagctattctcatgcctcagcctcccaagtagctgagattataggtgggcacaaccacaccccgctaatttttgtatttctagtggagacaggtttcaccatgttggccaggctggtcccaaactcctgacctcaagtgatctacctgcctcggcttcccaatcccctcggctgggattacaggtgtgagccaccacacccagcccctttattttctttatggcatttatcacagtttgaaatctttgccatttattgatgtccttgcctgtctctgcacagctgtctgcaccagggaagagagtagagggaaccctctgtatatgccccgtacatggaacagtgccttgccgttcccaggagctcgatggtagttggcaaataaatcaatgaacacacatagggggctgggaagcacaggcccatcctcacctgacttctgatgtgcaaagtggtgcttgacgtggtgggccttcaggctgtacaggtaggagcccttgtgcggcgagccaaagtgcaggtagtaatgggtcatgtcatagaggacgtagcccaggaggccccccgcaaacacagtgccccctactgcctcgggcaggatgagctgcatgcacaagtagaagacgccgatcaccagggaggctggcacaggggggaagaccaggcgggagccgtcgaagggtgcctgcagatggagaggcttgggcatcaggaggcagccaggggccccggcagctggccaaaccctggccactccctgcagaggacaggggcacagcggcccagacattccactgcgtaggcttggcacctttggtggctttggggagggcgggccaccacgtctggaagatctggagagactgtcttacttcccatttgtgagccaggaagggacctggcagattgcaaaggaacatgggatgggcgggatgggcaggatgggcaggatgggtggggtgtgctggcggctcagagcccatcttatagaggccactgtgactctggaatttgtcaggtgctagacaggtatcccatccctaaatgccgtgcccctggctagaggggcattctggagacagggcacctagactgaggcctgatgttgtctgggagagcaaggcactgagggcaactgaggttaatgcagcctctgtggcgggatgacccggaagtgtcactagaggtgtcctccccacccccatgtccaaacaggaggccttttttgttccaagggggtgtcgccacagtgaaccagagaacaccgcttcaccgtggccctcgagcttcagaagccaagggcctggcatagaggtgagatcttagctatggcttggtgaggagtctgagaagagaatcctgcagcctctctgggctggaggagagagagagaaagcaggtgacagtgacacaatgagatgctggcgtgggcctccctcccttcagaccaggaacaacaggaccagtgatgtgctggaaaaccagctctcaggaaaaggaggaagggagagagctggggaatgagggagggggaaataaagggagggagggagagccctgattggtagtgtttgccaattcctgcagtgtgaaaactgccctggcgctttcaagcgctgaggtggcgtcactggaacagaaacaggaaaggatgtgcatgggtgctcttgtgagctggtatgggccagatccgggtcacagctggatcaggatccttagatggataggtctggggatctgagaacacgttcctgattggagcccacgtggctacaggccatacagtctcctcgggtcctcatggtgtggcagcaggggactggacagactggggtggaagtgtctcaaaagagggagcctgagacagcccctggggccccagaatggcctgagcaggttcccagaaggttctggtgtcccctgtggatgggaaagatagcggacagggcagtggatctgaaaaggcttcacaaacagggcaagggacacagaagcagatgcagtgagctctgcagagcagaggccaggtgaggctggaggacacaggccaggcctgggctgcgctacctctgagagcatacctgagagacaggttggcccaggactgggcacccaccctgatactggcccctaggaaagccccctaggatgcagatcaactctggggagagccgggaggaccacagccaaccaacctgagaactgtcccaggcggccgatcaaaccccgaatcggctcatcgagatgaaccggattaagttgctgctgggaaaccaaggtgaaacccacgttcagtatcagcgacatcagggtctaaactggtgtcccgaaagtatcatatctgccatattttctctgatttatgcccagcagagaacagagtgtggagacgggctggggaacagcctgggatgggccaaggacagcacaatgcagggacagagaagcagcggggggtacaggggaggtagcttcctttgggcagacctatcttctcgggccagcttctgggactgtcgtggagtccttgaagggcctcaggggaagggtgattgagagcgcagactctggaatccccagaatggggtacgacatcctggctgtgccaagtgtgacctggggcaagttccttagtcctcctaggcctcagtctcctgctctgtggaacggggagaaccatggggctgttttcagcacaagctccaggagcgcaaggctttttgttgttttgttcaatgatgtctagaacagtgtctcgcacacaggaggcactcactgggcatttgctgaatgaatgaacgaatgaatgagttgttttgaggattaaaggtgatgcgtaaacaagggtgcagagggcctggggtcagcttgatgctgcacacccacgctgtccccgcctggcttaggttcggatgcccaacccagttgccccgtgagtcacatcaaacgtcccgtccctcccaacccacagccagactcccaggaggctccgcagcacctgaagctgcggctggctgccgggccctctcgggctgcacatgctaggtccgggctgggaccccgccccgctcaccttgtggtgctggccgtgcatgacgaagtgcagcatgatgaggtaatagctgtcgctggggggcttcatgtggaacaggaagcggtggatgaggtactcgatgaggctccagaggaatgtccccagcatgaagagcccggggaacatggacttgggcactgccaccgtgtactctgcagggtggcagggagagcgaggtgaggaccggtgcatagcagcctggtagctccaggtgtccctgcctcaccatccccatcagctcgggagctgctgccctctgttggacagctacagggccaggccatactgctggggtccttgagtcaaaatgggaaggaggctgtaggactctggtctgggtctgggaagtcctttacaggagtgatgggccactggctggaggcctgacatcctccttacagaggctgtgggaggagtggctgtggctggggctgggcctttacctggaagggtgaccttgccccaaggacattggagaagagaaggcgacactcctgagccagggcgttgttattattatcttgagacaaggtatctctgtgtcgcccaggttggaagactggagtgctggagtgctggagggcagtggtgtgattacagcttactgcagccttcccttcctgggctcaagcgatccttccacctcagcttctcaagtagctgggaccacaggtgcatgccaccgcacccagctaattttaaatttattttttatttttattttttttgtagagacgagatcttgctatgttgcccaggctggtctcaaactcccagactcaagcaattctctcgccttggcctcccaaagtgctgagataacagaagggagccactgtgcctggcctccagggtgttaatgatgggaagtgtgacccaccagggaccatggggcaggaaggacaagaaaaaacaagcaccgagatctcaacagacaagacctgaaatcatagcacaggaggaagatgtgaaaacactgaagatgatcagcctaggtggagaggagaagactggagacagggcaccatcttcaagcacatgcttcccaccaccctccggagacagcctgcagtcctagcggctttcagctctttcctccacctcattcattctttgacctcatggagatttcagctctcattcctgtttgctccatatattcatcctcatcctttttttttttttttttttttttttttttttgtgagatagagtcttgctctgttgcctaggctggagtgcagtggtgtgatctcagctcactgcaacctccacctcccgggttcaagtgattctcctgcctcagtctcctgagtagccgggattacaggtgtgtgccaccacacctggctaatttttatatttttagtagagagggggtttcaccatattatccaggctggtcttgaaatcctgacctcaagtgatctgccctcctcagcctcccaaagtgctgggattacagatatgagccaccgtgcccagcccatcctcatcctcttatctttgtttcttttctctacaaaccatagctttggccatatcttctctcttcttaacggctttatctaaatctaattcacatccatataattcatccaaataaaatatataattcagtgctttttagtacactcacaaagttgttaaaccgtcaccccagtcaattttacaacatttttatcacttccccgccaagcccctgtacccattagcagccactccccatttcttctcagaccctcccaaccctaggaagctacaggtctacttcctctttgttggatttgcctattctggacatttcacgtcaattgaatcatatgacatatggtcttttatgaccggcttctcttaccgaatatgttcaacattcacccatgttgtaacatgtattacaactccattcctttttaagactgaatgatattcaaactttattcatccatccatcagttgagggacacctgggctgtttgtagctcttggctattgtgaatagtgctgctatgcacattcgtgtagaggtttcagtgtgaaaagatgttgtcctttctcttgggtacaagcccaggagtggtactgttggttcatatcataactctatgtttaaccttttgaagaatagccagactgttttccaaagctagccattctctctctcttttttttttgtgaggcagagtttcgctcttgtcacccaggctggagtgcaatgggacgatctcggctcactgcagcctccacctcacgggttcaagtgattctcctgcctcagcctcccgggtagctgggattataggtgtgcgccaccatgcccaactaatttttgtatttttagtagagacagagtttcaacatgttggtcaggctggtcttgagctcctgacctcaaatgatccacccaccttggcctcccaaagggctgggattacaggagtgagccatcatgcttggcctagccgttctcttttaacccttactccatctccctcacctgcacccatgaaccctcacccctgggtcagcgcaggaacctgcctttgtaccccatacccaagctgctgagcatggagactcacacagctgtgggtctggcacctttaacctctgcaagaccctagacacagcctgatggatgatccctgtgcatcttcaagttcagctccctccccactgcccttgaacacgctctactcccctttactgcctctccttccacccagcttcctacttcacagagaagagaggccctggggttggggaggaactatcccctccacatacttcccccaacttccaagcacaccacattctgccggtaccctggcgcatcctccttgcttctcagggaagaggtgtgcaccggcacgcgggcgctggatgatcagagcaacagtaacggcagatgtgtcctgactgattcctgtgtgccaggcaccgcccaagggccttccatggattacttcctatttcatctcaccacagccttacaagggaagccctgcattgcctgcatgattgaggacgtggaggcccaaagtccatgacttgccaggctccccctgctcggcagtgcaaagccctcagccgcctcctcccaccctccctcccaagggactcctctgggctccttcagtctctccttttctcctggctcttctgctcatctttctgaggtaggcaagactttcccatcatggactcagccccttcatcatcaaggctcctaaaaagtcaggctaggctgaacatgggggctcatgcctgtaatcccagcactttgagaggctgaggtgggaggatcgtttgagcccaggagtttgaggccagcctgggcaacacagtgagaccccgcctcaacaaaaagtaaaaaaattagctgggcatggtggctcatgcctatagtcccagctactgaggaggctgaggcagggggatcacttgagcccagcagttcaagcctgcagtgagctgtgattgcaccattgcactccagcctggatgacagagcaagaccctgtctcaaaaagaaaaaaagaaaagaaaacgtaggttggactcatggctccactttgccacttcccattggcttgtcaagtccttaaaaatctgtcttctgggccggatgcagtggctcatgcctgtaattgcagcactttgggaggctgaggtgggcggatcagctgaggtcaggagttcgagaccagcctgaccaacatggagaaacttccgtctctaaaaatacaaaaattagccggtcatggtggtgcatgcctgtaatcccagttacctgggaggctgaggcaggagaatcgcttgaacccgagaggcagaggttgtggtgagccaagatcgtgccattgcactccagcatgggcaataagagtgaaactccatctcaaaaaaaaaaaaaaaaaaaaaaatctgtcttctgccccaaaccaccagaacttcaaaggctattcatgatgtctttcttgccaaatctaagcatattttttagtccacctctaagctggctgtggcatatgacattagctctactctcttcttcaatctgcagctgcctaggcgtttaacctgaggcttatgaatatccgagggtactacgttggattgcagagtgtctgtgaacttgctaatatatcaaattgtacacctatgggcattttttctctgtactgtgtccacagtttctcaaattctcaaaggatccgggagcaataaggttggaatccatagctcccccttctgcctgccgccacacttggcttttctcctcttccctggatctccctgctcaggctccatcttggaaactctgccctttgtccccagggtccaaacctggaccctctgcctctcagctcaatcccttcctctcccacatgctgacgaccgaagctctacaccaactccaccctgggtggccacgccctactggacagctccatgtggttgtccacagtccccaccgtgaacacctcccaaatgaggccaaccgtcttcctccttcttcccgcccacctcctcttgggtttccttcctgggaggctgtggttactgacatccacatattaccaaaggagtcaggttcaagtgacccctctcccatggagtcttagctgggctggtctggttggtgagagaccctgcttccagagaaaccctgatacctctggggtccataaggtcattccggtgaagtgcagagagcacaggcattggatttgcagacctggattcaaatcctggctcagcaccgcctaggtgttacagtttcctcagggaaacaccctacccatcttggaggggtgtagttaggatggaggtaacagagtatctgattatatgatgagtatatacattgtattatataataatattaatattatattttctttttttgagacggaatctcactctgtcatccaggctagagtgcagtggcatgatcctggctcactgcaacctctgcctcctgggttcaaacgattctcctgcctcagccttccaagtagctgagattacaggcacacaccatcatgcctggctaatttttatatttttagtagagactgggtttcaccatgttggccaggctggtctcaaactcctgacctcaggtgatccacccacctcggcctcccaaagtgctgggattacaggcgtgagccaccgtgcctggccttagctctcttgttggtaaggaaaggactggacgtacgggagcactctccggcgcagactaaggtcctggcctctgccgggccccgcacaccaccccactggaagcctgcctcccctcctctcagggatgccactcgctctaacgtgctctcagaagctgctctggagccatcctgagtatgcagcgccgccccctttcccccgtctcctcagcttttgaaagcattttcatgtgcgcatctaggaatgtcagccttgaactggtgtctgcgttcagcttccactgcttcttggcaccctgactcttctgtattgattccagtgcgtcctttgtccagcagctgcactaggatcccgccgagtctccccttgccttgctttgtgggctcttattttctctgcctgtggcttgtgccttgcatgacaagctgggggctgagggaggcacgtggagacgttatctctcatgcccccatcactggcatcatggtcacaggcttactaaccctctacactggacctttataagacaggcacattttagctctctgccaaggccgtgtggctgatagagccctcaaatcatcctccctgccatgcaggaaagacctctcctataggtcaagcctctgcccgccccctcaccccagcatcacccctgtctgcccatccggccggagctggtactgagtggcatctctggaggaatccggcggagggacctgggccaaagcttcagcatccccttccccctccggctgccagccctggcggccctgccactgtttgtgattgttaggggagtgccgggcggacagtgggtgattcagcgagcaggccttctgagcaacaagctccgtgctgtgcctgagctattcagcgtgagcagaacagggcaaccatggctcgagggatgcctgcagtaaccctcggtgaccgggaggagctctgggctggatttgggggaacttcctgcagctcgctcaccagactcatcctgggtcaggtggataaatgaagttcctgatgccgtgaccatggcccctctcatgtcaaccattcaggcacttgacttgcagagtgcagggaaaagagcttcccctggcagagtgagggcagctcaggaagctcagagccaggacagacagaccacagggcaggtggcatgtacctggaggcccaaggtaggcaagatgcttgtggggctggctgtcccagcggctatacttaaacccacagtcatcctaaaccccagtctcataggctctttagacactgccccatatcagcctgtcttttcatcctctgccccccagctagaagctggggcgcacctggtatccacatcctagccacacgcctttcagctactcccttgatatctctgaggctccatttcctcagctctaaaaggggataatgacaggacccttcttatggggctgctgggaggggtaaatgaggcggtcctgggagaacacgtggccccgcacatggcaagtgtcccatagaggttagtgggccattactcccagtctgggggtctgctgcctgagcctttgccttggacacactctaggacactcccagatctttctctcccaagttctctgctaatctgtgctgggttcataggccagtccgagtctagctctcagctgtgtcacccgatgaagtgatttcatttagtttcttagcaaagaatcccacatcatgtgtcttttggtgtgacactcaatgagaggcactcaatctctctctctctctttttttattgctatgccacccgatgattccatttagtttctgctgatgtgttgttgggttttgtatccatttggggggtagatgggagtcagacaaaattcttctttggaagactatttctacagagaggcttcaccaaaaatgtctgtgatgtagtttggggttctgtgctctcagaaactctgggccagggaaagcactgaggtctcctccctctaggatcctcagggcaagtcaggaaagaaactggcattacctgttgtaaatgacgtgaagagtcggacgttgccctgggcaaaggttcggtagtaggaccagctgagatacagcaccaggggcacccagatgatggggacactgtacctgcaggaaggccatcagggtgagagagatacatgcacaggagcttgacagagtacagctttctttttttttttgagacggagtttcactcttgttgcccaggctggagtgcaatggcgtgatttcggctcactgcaacctctgcctctggggttcaagtgactcttctgcctcagcctcccaagtagctgggattacaggcatgtgccaccacacccagctaattttgtatttttagtagagatggggtttcaccatgttgtcaggctggtctcgaactcctgacctcaggtgatccacccaccttggcctcccaaagtgttgggattacaggcgtgagccaccatgcccggcagggtccagctttcttagagacacataactcaactggattggggacaagatgacaccaaagcatatgcagaatgcctatggagacctggggtcaaagggacactggtacagggagtggggaagagaaaagaggagagaggctgtgagtccatctgcctcctgtctctgagatgagttactggcagaaaagaactgtgtccccagggctactgactctatgcaactggtcagatgctgacctcttgtggcagaggagctaattgcaggcaaaattgttcccatgcgcatcgtgggcaagaaactcctcataagagtctggaatagaccagaggtggcattcaatgtagtttctggctacatgctgggttgtgacccacccagtggacaaaaccatgcatagggatgaattattcccatggcatgttcctccctccctgacagctttacagcatagacctgggctctggggagggactcaattgccccctccctttccatatctgattggcaccgtcagaagagagggacagcctgccacaggctcagggaagagctcaccagacagtcttagagaggccctcaatgaggtctgagtggaagaggcggatgggcctggtcaccggctggtgaacccactcatcgtacttctctcccaagtggcccacctgccacaggagaggctttcgccagtccaccaggtcctgcaagagatgaagccaagtggacgtttgatattcacgtcttcccatattcgttctcccatttcctcgttacagcatcccaatcccctgctcctacctcagctcctgtgatctgtgtggggccacccaccctcctgcttcagtgatcaagaactgaccaagctgctcatcccagcccccagccacagcaataggatccggtaaaggtttgcgacctaagctggtgtgatgagccatcagatgatccctctttctgttggaggtgctaaatcggcagggcatgagcctggatttactagcagagcctgcctgaagatgccaccagcacagaagatggccaaaccaagagctagagagacagaatctcagtgatgatatctgagcatccagattcagccacatctgaagtttaaagtcttgctcaggactcttgaggtacaggaggtaatacattttgtatcaggaatgaagtgggctcttttccccaggcttcttggtgttggcctgggtaattaattcattcaatcatttattcagcaatttattttttatatatatatttatttctatgctaggtgctgggaagaatcaacaggaatgaaagaggccaaccttgtttcatgtagcttagtgcttacagttagactcggaagtcaggcctgggtacaaatccatttgccatttactgtgtgatttctggaaaattacttaacctctctgagcctcagtttccccagctataaaatggaagtaattgttggttgcagtagctcatgcctgtaaaccctgcattttgggaggctgaggcaggataactgcttgaggccagtagtttgagaccagcctgggcaatagttcgagactccgtctcttcaaaaataaaaaaataataacggtacctgcattaagtgctcaatgagatgtggcatgccaagcaggatagtttagtggagatacaaagcaggctgagatccagaggcagaatggctggtacaaatgcccgggtcacggtaggcgaggagggctttgcagaggatctgggttttggtttggagttcatcaacatgggggatttgacaagggggagagaggaaaggatgacagggagtgtgggcacagatgtaaagttgaatatggttgtggcctttctggcaccttaacagtgctctgtgggcagcaggaaaaaagctgctgaaggcttagatgatagaacaccctgtaccacatccaggagttgcttattctccaggcctgttgtctccaaggcaaggatgtacgtgtactccatcggtactcacaggctaatccccagaggcagggagaaaatattaacgaccctatttctattgctattatttctatttatttgtgtttgtaatatatttatctctttctttttttttttttttttttttgagacagagtctcgttctgtcgccaggctggagtgcagtggcatgatctcagctcactgcaacctccgcctcctgggttcaagtgattctcctgcctcagcctcctgagtagctgggactacaggcacgcaccaccacgcccagctgatttttgtatttttagtagagacggggtttcatcatgttggccaggatggtcttgatttttttttttttttttttttttttgagacagagtcttgctctgtcaccaggctggagtgcagtggcacgatctcagctcactgcaacctccgcctcccgggttcaagtgattcccctgcctcagcctcccaagtagctgggattacaggcacatgccacctcgcccgctaattttttgtattttagtagacaaggggtttcaccatgttggctaagatagtctcaatctcccgatcctcgtgatctgcccgcctcggcctcccaaagtgctgggattatgggcgtaagccaccacacccggcctcttatttgttttattaagaggtgggtcttgctgtgttgctcaggctggacttgaactcctgggctcaagcgatcctcctgcctcagcctcttgggtagctcagactacaggagcgtgccactacgcaggctttatctcacctttacacggcatttgaatgttttctaatgcacagactgtgagagtacattaacacatgcaaatactttagaaataatttaaatggacacataatggagagtgtgtgcagaaagtttcactcatagggatgcaagctcagaaaagtttgcaggtttcagctccaggcaactagaagcccttgaggatttctgacaagccagtgctgggttaatctggaccgaatccaggaaagaacaatgaacctggagtcaggggaacaccattagagcctggctgtgcctttgaccagctgtgagatcctggacgtgcatcttttcctcccggagcccctcagtgccctcatctgtgatgctggtgggccccaatctgccacacacaatcggagtgaggatgagggtgtctcggtggatgctcagccaatcttcagcacggggagtcaggcagccactgcaggtgggaagtaggggaaccacaggcagggagaggaggggagaggagcaagggctgcacgtggaagagcttgcaagcctggacgaaacagccatcagtgattccagaaacctccttcccctggccctggctgcaatctcatccttgtacaggcctctccaccaaagcctgcagccacagcgggtcttccaggaactagcccttacatgccccccagctgctctggaggtggagctggtctcgcccatcacagcctgggagcaggggggtgggggtcctgggagcaagcaggcaaggccactgggtttctctctgtgcctgtgaccagggtgaagggcccaaaggaagctgtggcttctgccatgtgaacttggcaggtcccaggtactggctgccttcctgtggcaggggtgggggttggggggttcacttcctgcttctcaggctggaagatgatccaagtcagcctggagctatcccgccctggcactaactaaatcaagcaatcatccaaactccacctagtcgctgctcccttccttaccccagtctccttgacctcagcccttgagtctagcagcaagtggagtcattggaagtgtgctgtctcattccctccagtcctctgccctaggtctgtaaacacacacacacacacaccctgcaccaccacaaccgctaccaccaccatcaggaaaaagaactggaggaaccagctggtggcctgtgtttacaccttatcttgcggcagtctgcagagccccaccttagaagaagttgggccagggtcaaggcgagaatgtaaggctttgtcccagctacagtagcactcagagctaatccccatggagccctggttatgtgtcaagcatggttctaaacacctgacacaggttcagtcacttgatcctcgccatacccctaactaggcgtgtattctaactattgtcattttgcagttggggaaaccgaggctgagtaatctgcccaaggtcgcccagttatgtctccttgatgagttggcccctttaccactgggaaagagccatcttgggccctggaaatactccttctcccgaagtccgcttgggtattaatagaatcacactggtttcctgaagcttgctgtgcgcaggatccctgttttcccatacttttactttcaacctgtgtatgtctttacatttaaggtgcatctcttgcagacagaatatagttgggtcttcctttttaatctagtcagacaatctctgccattttttttttttttttgagaaggagtttcactctttttgccatctcggctcatcgtaacctccgtctcctgggttcaagcgattctcgctgcctcagcctcctgagtagctgggattataggcgcccaccaccacgtctggcttttttttttttttttgtatttttagtagagatgggatttcaccatgttggccatgatggtcttgaactcctgacctcaggtgattctacccgcttccacctcccaaagtgctgggattacaggcatgagccaccacacccggccatctctgcctttcaattgaagcattaaatctatttacatttaatgttggagtaggtctcctctggttttcttttctcattctttccttctttttttgagacagggcttgctctgtcacccaagtgggagtgcagtggcccaatcttggctcgctacagccttgacctctgaagatcaaataatcctcccgcctcagccttctgagtagctaggactacaggtgggcgccaccacacatggctgctattttctatttgtctcctctgttcttcctttgtcttgtttgtatgaaatatttaacaatattccatactatctcctctattgactttttagctatgcttttggtattttccttgcagttgttgctgtaaagataataatacacatctgtagcttacgaccatctctctcaaatgaatcccctggtcctttctttttctttttgagacagggacttgctctgttgcccaagtgagagtgcggtggcatggctgtggctcactgcagcaccaacctcctaagctcaagcaattctcccacctcagcttcccgagtagctgggactataggctcacgccaccatgcccagctaattgttttttgtttgtttgtttgtttttagagacgaagtatcactatgttgtgtaggctggtctcgagctcctgggctcaagtgatcctcccgcctcagcctcccaaagtgctgggcttatgagcatgagccactgtgcctggccagcgcccctggtttttctatgtcccacttttgcatgttacacatgacagatactgctatcctgtgattcacttgtgcactttacacagactgagcgatcttgaactatgatcttttccagctatagcacagggatgtggccagggggcccctctctcagcctagcagtggtttgggcaaattttaatctattgatctattttgtctttattttgtgaagcaagtagaaaatggcataggattctttttctttttctttttcttttttttttaagattgagtctcactctgtcacccaggctggagtgcagtggtgtgatctcggctcactgcaacctccacttctccggttgaagtgattctcctgcctcagcctcctgagtagctgggactacaggcatgcaccaccatgcctggctaatttttttgtattattagtagagatggggtttcaccatgttgaccagactggtcttgaactcctggcttcaggtgatcttgcctcggcctcccaaagtgctgggattacaggtgtgaaccactgtccccagctgaaaatggcataggattcatacgttgaattcagttgaaccacaagaagaaatgtctaggtaagctataagcagggacttcagcctagatctcacacctggatgtacaggaaacagaacaaaagcacagaactgtcgtggaaaccggagctagaccgtggaagatgtgtttacaggtgtggtgggaacagagccccagcacaggggtctgtcatttgatgtcattggattgacctgatttcagttactccctgggtagacccgcaagcactgccacctgtacacatggtggacttgtgcttgagagtcagtcccaagctgcctcttgcctgtctggggccgtggagggcctcacacccgagctctgtatctagcctacgctgtgtctccacgaggaagcccacctgggtgcccagggaaggtgcccacttcactctggggctgaaggaccaccctggaggaatcccagggaggcctcgctctcccttctgtgaacacccgcctcagtcatcaaaggccaacacctatagttctatgactggggcctcagtctcgctattccaggggaagccccgtgagccttccagataagcacagaaattcaggcccgccgacccccgacccaatttatagatgaggatattgaggcctgagaggtcaagcggctcttgagataggattggttgggcctgaagtggaagcctccctcccccttcccccagcttgtagcagcctccacacagtttcccaagagctgggactggcaccctgtgcacttgaccttgatttaggtggtacatgcactgatagggtgtcctttcttaatcatcttccagtcgtgagcactgaaggagaaaggctcagctgggtgctgagaggttccaggcctctcacttgctggtcgtttccaacatggcagttggcgggaccgggttttgagatgggaggacagcagacgatgacggcttgggatccaatgagatgggaagcgatgcaagacacatttcgcttcctgctctacctgaccaaacaattgccttagctcattgccatgggggtgggcagcgctgctgacactgagcagctgccccgtcccccgcctgcccccgctcaccacatttgccaccttggggagcagattctggacacacccttccccaggaaagcgtcctatgccacctggccctgtattgcctgggaggaggggtcctggggaggcagaggaggaaagcagggaaggcccccttctacctgggcaccacgcccttccacccaccctcttctacctgaccgaagacccctctcctactcccaccacattagtgggtctcttccttccagctcgttcctggtccgggccccatttacttcttatgtcccaaggctcgggggacagagggaaggcatgggtctgtgggctatgtacgtggctcgggtgggggagaaggggagatcaggccacactgatgatgcctccacttcccaggcatctgggggctcccacggctccccctacagtaacaagtccccttttacagcagtggaacccgacgctagagaggcatgtccagcactcagggccgtccagaggaagctggcctgcatgggcgacagcacggttatgcccgaaactgctctggaatgagcagctcattggggtggagggattttttggtgattcaaagacccgaccaacgggccggggcccaggaagcagatgcaagggggagtggattcggccaaagcaccttgtgccgactgtgtggggtccatgcccctcccccagcctgctcggtccctgccttagagagaaggggagggcttctcccaggctatgccaggaatgtggcccacagcagcacggcagggggaaagggcagcctgctgcccagagggtgggcggaagggcatggtgccccggtagaagggggccttccctgttttcctcctccccctccccaggacccctcctcctgggcagcacagggccaggtggcataggacgctttcctggggaagggtgtgcccagaatctgcttctccctaaggtggcaaatgtggtgagcgggggcaggcggcgggggcagggtagctgctcagtgtcagcagcactgctcacccccacagcgatgagctaaggcaattgtttaaagaaatgtccacccaaactcaggcatattgccccagggcagctttctgagcagaggtggagacaggcttccaggcagccggggctgcgggagaggagtgggggccggttgtctgcaacctggtcgctggtcagctggggctcaggcctcacatcccctatccttcatgagccttaattctgggagttggggccgatgatgacctcttttgacagatgagaagacagggtcagatgttcggctgcatatgctgtggcagggcctggactcgagtgccccactcacagcccaggctcggccaggaggcctcctgtcagccagattgggatcccatggctgtgacttcctcagcacaacggctgtgattcctcacagccagcagcggtcagtgggggcagtgaggtggggctcttggtggcgttgccggagtggctgcaggcccgtcctgcgcggtctaactgggacaagctgaagtccacagaggtggttccggatcacctgcctcctccccctgagccctatgaccctcccgtcacccaggggatgtgaggacagggaggtggcctcaggctcaccccacgaggattcaggcagcggagagtggatagggagcaaaaatgccagagacacagggagagatgaaagacagcttgagcgctggcagaaagcaggcatgacctctgcccttagggctgaagacgagcgaagggagcctgcccaggggccccaccccaaaaccaggtagggtggtctttcccttgcagcacactttctgatatcctttagtacattccactagatcctccagataatcctacgcaataataagatgcagggttgcaatcccagcaccttgggaggccaaggtgggaggatcactgaggctgggagtttgagaccagcctggacaacatagcaagaccctatctctacaaaaaaatttaagaaaattagccaggcatggtggtatgcacctgtagtcccagctaattaggaagctgaggtgggaggatggctcaagcctgggaggttgaggctgcagtgagctgcaatcttgccactgtactccagcctgggtaacagagtgagaacctgtctctaaaaaaataaaaaagatagagggaatagctttctgcatcatactggaacactgtggcatctcttgcctcccagcctgccctgtccactgccctcccagggtgtcctctaagacccacggaagcagagggcagtgcccagcccacctgcctgctttctgccttggggtattttttgagcaccgctgagctcctctgaagaggggccaggagctctgagcaaggaggcaggcagagaggagactcagggactctaagcccagtatggacagccttggggaggccctttggatgttgggccctccagacccctactctggctgggagggattatagagagaaaggaggcccaaggggacccaaggcgactaggcaggcagggtgcctagaggagagccaggccagtgcccacagtgccaaggctggtccccccgagagtgtgttggccaaaagggccctttctctgatctggatgctatcttcctgagttctcagtgactgatctgggggtcctaaatgggcaaaacactatggccaacttcaatagcctttccaggccctggggaccctggtggtctgtgttatgtcaggcagggggcagggacagggagtttggggatgcctgctggatgcgtctatctgtcccttgagggaagaggctgatcacacccattggccagccccagcagctggttatgccagcatctggcttagcctgaggaaggatggggaagaggatgtggctggcttgggagacactgctggtatctgctcagcctcctccctccctctgccactccctctcctactcaccggcctcagggtcttattcatggtcagctgttggggtgggaaggttccaggaccttgtggaggggaggggccgctatctgggctgctagtgtgcccagaggtgactttgggcgggagatttaagctcttccttatcagttaaatcaggataattataatccttatccctcgtgctgtcagcaggattaaagcagataaccaataatacattgaaagcggctggcacacagtgagggctcagtacaagagatgtgaattcagggctaactccgctgctgagcatctgggcagcgaacttctgcaaacccctcaaatcacacctgttcttgccccctccccaaagggaggctggtcccccgggtggaaagggtggagagggctcccaagggagggctccgaaaaggacatggcgaagtggcaaaaagaggctgctggaccagggggacacgtgtgtccaggagctgagagtggtgggcagctctggccacctcacctggctgtgttctagaaacagggagggatgtggagggtgagaatccacaacctggcttcttgtcccataaggaagcctggaccctgcctggctgggtgactgaagggatgatttagaaactgttctggtaaaattccacacagagcccaaaagtaagaccatccctcacctctgagcagagcggggcaccagggtttgcttcctggcccttcttcctgtcttttcagatccttctaactctgccctggctcccctggcctgttgtcctctcactcttcccagcattctcactcaccccttctcacacacaccttcccactctgtccccaccttctagggccagggaaactgggccccgggaggccaggactccagtctttggcagcaatcacagtactgagcttggaggtaaagccagaagagttaacaccagcaagcccttctgccccaggggcaggtgtgcaaacccaccccaggcctggggaccctcggctgagacaaagctgccaccttcatggcctctttcccagctcctccatgtcccgatccaaaagacctaccccagcccccgctgcctgggtcagcaacagagagagggctcaggttggagcaccgcgggctcccccagcctctctgttcccactaacggagctgggattgcccgtgaggtgaacgaggcagcagcagcacccttttttggaaagtcaaaagtgaaaagaaaagaaaaaagcagaaaagcaccctctgccctcctgggaagccctgctccctgtgctgattttctggggcgctgaaggggttcccatgcacacccgggcaggtgggggctccgtccagagtaggcctccacatcctcccagggcccagccctcgcccttccgtctcagcccagagacacaggaggaaggggaggaagagtgagtgtgtagagagagaatgagagagaggtggggaaggtgagtcaggctgcttggacagctggcccggagccaggcagggagcagtccatgggggaggaggggcccctcgtccccttgggtgtggtcgtggtgacagcataggtgacggtggcacagcctgggttaatcctccccttgcctcctgcagtgatggggccggggtcagccctgaaccacagctcggggagactgggaggagctgaccacagagctggcaatgtgggctggatctcccgtccccagccagcctcagaccccagctcctccctccaggacagttttgttcatgtcacatcaccctgatggctgccacatttgttcagtcccggtcagctcttttcagaattcaagccctaagccaagctcacagatgcctctctctgcagctccttccagtaccatccactggccactcaggacaggaccctgagccaggacacactgtagctcaccctttggtcccctcatcagtccccaaactctccccattcccctccgatctccccctgttccagactgaggtcctgaccctgccagtgcccagggcccaagctgggggttgaggttcggaaaccaggtcccagctcgccggctgcatggccgggcagcctttcctctggctggcctccatcttgccctgggttctgcacctctcaggaggggacatggcacagcacaacttccttcggcctctctggttggatcctgaggcgtctgtgctgtgggcggatgggttctcccagaggcggctgtgatctcatgcgacaggtgggatctctgtgttcccagtgtcagggccaagggggcccagcagacagtcagctttgtggggtccccaccccactctgctcacctgtgttccttgggcgagcatcccatgccacctcctggggtaataactctttatggcggtggtggggaggggttactgtcccctgcaccaggctgtgagctctcgcagggaggggcctgtcccatttgtttctgtgtctttgaggcccaaactaggcagagggcatgcagggtaggggtttatggacatgcacatttgtgtctgttcctaagctggaaggaaatggcaccaagcccagctccctccagtgaccccctccagtgaccccctccagtgacccctccaggcaaagctgcttctcccctgccgctgagtgactccttttccaccgtgaccgctcagctcctccagggctcatctcaccagtctatggggtctgctcagccatagcaaggcactggcctcttgatgccaaaagaggcttatcctaagactgcaggcatctctgactcctcccaaacacggaggatggcttcagcgctgtctcctgctggactcagcagtctcctgtgccctgcactggccaatgtcgcttccacatggctgcaggtgccaggggcagctctaccttgtgccctggtcaaaatgggcatgtctgggcctgccaagcctgtcacagccccttctcagcttcaggggtcctggcgggagaattcttcttctccaggggtgtctgggatctggttccatgctcagaacttgtctgctatttttctgaactttccaccagtgaggcacccccacacccctgccggagtttgctgtcccaggtcatgcctctgggctgtggacacctgcttctccttccccttctcccctgggcacacgtcatgcccactcccagctttggctccacacaccctcttcctctcctcattcccgccagcccccagtcatcaccccactccatcctatgccaggtaccttgtcccaatccaccactttgaaccgtggttccatagcaggatctgtcttctgagtttcctcaagggctacaggctcgttctccatggagccctggaaggagaagatacaagaggattatacacagtgggtgagggaagagggcagagccccgagctgccccgagaagaggcagccaggagtggtgagagccccgtgggtggggcagggtggtggagatcaaggacgctgggtactttggaaaacagagagaccctgatgtgagcattgttattctctgtattttacatttcccttaaaaaaataatttccagccgggcgcagtggctcacacctgtaatcccagcactttgggaggtcaagatgggtggatcgcccgaggtcaggagtttgagaccagcctggccaacatggtgaaaacctgtctctactaaaaatacaaaaaaagtttaccaggcgtggtggtgcgcccctgtaatcccagctactcaggaggctgaggcagaagaatcgcttgaacccgggaggtagaggttgcagtgagccgagatccagcctggcactccagcctggacgacagagcaagactccatctcaaaataataataataataataataataataataataataataataataataaaatttctgcataaataaaagaggcagaaagatctgggagaggaagtgagccagtggagagactgcagggaaagaagcttgcttagtgggagccctccgggaaaggggtccctgccggttctccttcaggtccctggcaggtgccaggcaaagggagtcccagggtagcgcccagggcacctggtggggctcacagggccacactgatgagtcacaggctgtggcttctagggccacatacccacaagaaagaaaggcagcagggagcgagggaggctgtccctgcagcaacacccgagtgccagtcagcagccacacgtggggtgggattggcagagcagtgcccaagtgggctcaaggttaaatcgaactcacaaagaggtaaagtcagagggaaacgggatgtgctgggaaaagcacacagccccagccagctctgacgtcacggagggtgaggccagagacagcaggctggcacgtaagtgaaacccatgctgccccgaaggaggggcagagagagcgcttgccttctctgtgtccttgtgactgaaggaagccatggtgctggtggccatggcagggagctggaagctgggcattggccggcggccaagaggctactgtcatgacttgtacatttttgtttccaaacggacccaagagaacctgatggtgacagtgactattttggcattttatgggaaaacccacacgtaacccaagtaaaagtcggcttttgtggtcctttcttagtctgtgtgtctcagcatatttagtctgtatcatcaagctaatatctgaatttttttgtttattattttgagacagactcttgctctgtcacccaggctggggtgcaacagcccatgccacctctgtcttctgggcctaggccatcctcccacctcagcctcccaagtagctgggactacaggtgcacatgaccacacccagctaatttttgtattttcagtagagatggggtttggccatgttgcccagactggtcttgaactcctgacctcaggtgatctgcccacctcagcctcccaaagtgctcggattacaggtgtgagccaccgtgctgggccaacacctgattaaatatatatatatatatatatatatatatatatatatgtgtgtgtgtgtgtgtgtgtgtgtgtgtatgtgtgtgtatgtgtgtatgtgtgtgtgtgtatgtgtgtgtgtgtgtatcatgctgtcttgagtacaaagaagagtagattttatagcacatcatacatggaaatgccttaaatatccaatataaatgtcctccctcttcccgtgacagcagctcaataatcctgttccaattctgtttaacctcaaaatactccagtggtgtgataggttccaacaggcagggaccttgtggatttctgtttcctgtttccagacccacgcctagcacgggtcttgcaaataccagatgctccacccacatttccccagtgggtcgtgtttcaatgctgggtctctgcaagcagccaacgtcttccaagactcctgccatgtggtgggcctggctgtgggggcgaagccctgaagctctgcaggactcacactccttggggatgtgaaacaaatggagtgggtgcatctgcccaccctgccacgtggtggggaaatacggctgtctgcctgagggggtgggccaggacacaaaacatgcatcttgcactctgggctggataggacagtgcccagataaaaggatcaaaactccaacaacctagatcatagattctcagtgcccttcggccgagtacataggacaggcacgagcagaatgaaaagtatataagactggtatgagattgccagcgttttattttgccaaataaaaatatttcaaaggcaggcacggtagccgatgcctgcaatcccagcactttgggaggctgaggtgggaggattgcttaaggccaggagttcgagaccagcctgggcaacaaagcaagaccctgtctctatcaaagaaaaaataaaaaagccaggtgtggtggtagtgtgcgcttgcagtcctagctactcaggaggctgagggaggaggatcatttgagcccaggaggttgaggctatgagtgagctatgattgtgccacagcactccagcctgggccacagagtaagaccttgtctcaaaaaaaaattttttttttaatttactatcagcaacatttcataaacaagaggaaatttcaataccaaatatataggaagtatgtgttttcaggataaaaggcagttctttccaaggaaggcagttggcaactttatactgacatttaccaaaaaaggttctattttattattttttaattattttctttttatagatatagggtctctcactatgttgtccagtctggtcttgaactcctgtgctcaagtgatcctcctgcctctgcctcccaaagtgctacgattactggtgtgaggcaccatgcccgacctctattttacagtatttatgaatgcagaacaattacaacaacattctgtttttatgagcattaactacacataattgttcttttggctcaagctggttgatgtggggctcgatgatctatctgtaacaggaagtaaatcaaatgttcaccatgtcctggttctaaggttctacttcaaaaattacaaaaatcctgtttcttagagagatgctggctaaatagaaacagcacattgaaagcttcattcaactggaagtatcctgagtgacatgaagaaaccggaggagtccctgctctgtggatttctgtcctgctcctgggagacagggggaagggcagtgggtcatgcctcgagcggctccatcccccgcacagaggggccagggattctctctccagaattcctctgaatcatggaccagcaccagtcaagggctggaagagggggcaccctctctatggaggctgaggaaaagagggacaaaggggaagggggtcggcatggcctctttctatcctccttcctgcttctgctctcgggtcctagggccaccccagggagcaatgtcaggactgatatgcttctggcaaataagccccagactgactaagcaaggtgctttcctgggtggcttcattgggaccacacccctccttggcagaagcccaggttcttatcacaagatgggacacacctccaacatgggaggagactccaaggaaaaccagagccagcgtcacgcggtgtcagtagcaggaatactcctaggtacagggacacgtcctccggtgcattgttcattaatcgattttctcaagtctagttgtgagattctaggtctaaaaaccctccctacacacagctaagacaaagacccttctgaagaaggtctcccattcccacctggggcacgccaggactccaggaactgggtcctgccaggagcagctgtgccgcacgcatgccacacacgttgatctgggccacgttttccagactcccgccccggtgtttattttatagttgagccagctcacccttgaattccacaggcgaacaccatccatgaatcaggagtgtgtagaggtcattcctgggaactagggtacaaccccagctttaaaaggcttttagaaagtttcttggaaactttcacattcattatttaaaaggttctcctggtcctggaagcaagccaaagggtggtttttaaacactttaaaaaccaaaaagtgcctcaaatgaagatatgtgtgctttcttttttccagtatttggaaattattccagatgatgcctttttttttttttttttttgaaacaaggtctcagtctgttacccaggctggagggcagtggcatgatcttggctcactgcagcctcaacctcctgggctcaagcaatcctcacacctcagcctcccaagtagctgggatgatgggtgttcaccatcatgcccagctaatttttaatttttttgtagagatggggtcttgatctattgctcaggctgctcttgaactcccacgttcaagtgatcctcccacctcagcctcccaaatagctgggactataggtgtgcaccaccatgtccaccaaattttttattttttatagagacggggtcttgctatgttgcccaggctggtctcaaactcctaagctcaagcaatctgctcaccttagtctccgagagttctgggattacaggtgtgaaccaccacgcctggctggtgatgcctttgaactgggtaggtttcagtatttggtaagggaagtgaacaattttgtagttagacccacactggctttcacaggagtgatcagcacaagtgttgatgagtgtggcttgacagggggtgtccaacccatctgtgtcaggtgattgctttcttgtaccctgaggcgaacgagactgtcccagggcaacagtctggtgctgaggacagaagccctcatcccagtccctccaggcctctctgccttgggaaggtaggcagaagagacagcttgacactcttgtgttcagctccagggctgttgagtggcaagggggcacctggctctcctgataccgcatttacctgttgattgtattccaagctagcccataagcaccgtgcactagagaccccactcaatcttgctaactgctcactccctagtccccagcacaggcttggccctgccaatacttgctgagtgatccattagcgagcaggtgggtggcctgggtcgactctgagagccctccccaaccccctgccccaggcctggagaggccaccgatgcgtggggagggcaggcaggaaaagagccttccatagcccacgtctacttggagagaaaaggatgggcacaagcaatggccaaggtgctctgccaaggagacggggtcagcaggcactgctcattcccagccaagagccactggacgtgccgggcaatggagggtagggagggcacttcaacctccttagagccttccagccacagtccaaggccacacaggagagaagcctttgagacagaagtaccaaccctcactgctcccagcacaacgccaattcctggctcatcaccaggcgttatttcctctctggtcagtccaagccacaaggatggtatcgagtcactgtcaatggattttttttttttttttttttttttgagacagagtcttgctctgtagccctggctagaatgcagtggcaccatcttgtctcactgcagcctctgtgtcctgagttcaagcaattctcctgcctcagcctcctgagtagttgggactacaggcatgcaccaacatgcctggctaattttttgtatttttagcagagacggggtttcaccgtgttgcccaggctggttttgaactcgtgaactcaggcaatctgcccgcctcggcctccttgggattacaggcatgagccacagtgcctggcctgtcactgcatcttcgtatcaaggaggctgcagggaatgaagcagactacagtgaaatagaggggccacaccctgttacaagagggcagctctgacttaggtccaagtcataggaggatggggaccaagggttgtcagaccttcagatttcttttcttttctctttttcttttcttttgacacagggtctcacttcgttgcccaggctggagtggagtggtgtgatcatggcttgctgcagccttgaactcctgggctcaattattattattattattattttttttttggtagaaaagggggtctcgctatgtggcccaggttagtctcaacctcctagcctcgaaatcctggcctcaggtgatcctcctaccttggcttcctaaggtgctaggattacaggcataagccactgcgcctggccctgatttctatgaaaagctggaaaaatatatttttatgtaaaatctccagattttaaaatttgacttgcatttaaaacaaatgatgtgggccgaaccaacacatatgaatataaatgtggcccttggtttgccagtttgaaactcccaggcaagctgcaggcctcctgctccctgggatgccctgtccactgagaaggatgagcagagacagacgagagcaggggttttcttctctctgtcaattcccagaacagggaattccaatggggagcctgggctatatagcttcatggggcaggcattcagggccagttgtaccaaggcccaggtggggtcagggcaggtaggcaccagagggaccagagtcccagcaaggtctgatgaagggcaacctcaggtggggactggtttctagaggaagcagcgggtcagggagcagaagtgggggttggacctggtttttcccggttctcctccccttatgtctagaaaggtgataaaattagccaggcatggcggttcatgcctgttatcccagcactttgggaggcagaggcaggtggatcacctgaggtcaggagtttgagaccagcctgggaaacatgacaaaacctcatctctactaaaaatacaaaaattagccaggcatggtggcaggcacctgtaatctcagctacttgggaggctgaggcaggagaattgcttgaacccaggaaatggaggctgcagtgagccgagatctcgccactgcactccagcctgggtgacagagcaagactccacctcaaaataaataaataaataaataagaaagaaagaaagaaagaaagaaaagtgacaaaatctgtgaggggtaaggaatcacagtagagtctcaggccatgcaccaagggcgttacctccagggtctcgcttcccagtgtagaggttgtgggttgagctatgccagtcctcacaaagaactctatgctgaagttctaacccccagtgtctcagaatgtgaccttctttggaaacagggtcattgcagatgtagttaagatgagatcattacggtgggccttataaaaggggtgatttggacacagacacacacgtgtgaagatggaaggagagatgggagcaatgcctctccaagccaaggatggtcaagagcagctggcagcccccagcagctcaggggagggctggaaggactgcccctcaatgtcctcagaaggaaccaaccctgccaacaccttgctctcagacttctggcctccagagctgcgagacaatacatttctgttgttcaaccacccactttgtgacagtttgttacagcagcctagaaaacctgtaacaaggcctgaatcagctaatcagtttcatctgggatcaagaccgccaccaaaggagagggaatccaaccagaagaggggacaaccgagggaggcatccgaggagccgtggagccaggagtctgcccctcatcctatgctgaggacgcggcagaaaccaggctctttcagtcagcacagccttgccacccagcccgcaggggcaggccacacagatggccccggggggacaggcattcaaataggacaggcattcaaataggtccgttcctagcccactgctgcccatctgcagccaggggcggccttgttccccttctttagggcctgagaggtcacttcgcagttttcgctacatggaaacgctgcgcgtggagcagtgaagcaaacgccgccctctttagtgcaaaccttgttctattctgcacttcccccaccccccacgtggcagctggaacagccctgccatctccaccacaagcaccttcaccgaggcgcacatgtggcggcgtctcactggggcggacacaactctccctgagagactggcaggaggcattccacacacgggggaaactgaggcacaggcggcccgaatgacttattcaagatctctcaagtgattgctggacgggcggggggagcacacagcagcccactccgagggctgttcccgggaaggttcctcacagtagcctcctttctcccctcgtggaggactctctgggaggtccccaagcccccagcttcctccagggtcccagaccctgtcctccctagagagggtttgcttggacggcgcacgggggagagaacagagaagaacaacagaaagtctgcgctctgcaccacaaacaaacaagtccaccatagaggccgcgtgaaaggaggcagtgtgcggcgggcgggggctgggggcgggggcgccggcataaaggcatgttgttcgggaaagctggggctgggcaccgcgggacggacagatggccttttatcccatagcctggattttgcctgaaaaccctttttctgaaagggaatggttgcctcgggccttgggtccagctgcccccaccccatggaggcccagggggaaggtggggggtccaggtgtcgcagcgcccctgggtggcacatggcccctggcagctaggaaggggcaggccccagagggagatgatggtgccaaggctgttccaagccgttatctgtatctgcagcaagagcctttcttggggaggagccttttgcattaacaagcccacctctgcggcccccagggagcagtccccttcgagctggttgtttttggtaaaagctttcggctgaaatgaaggcagcggatccgcttgcttccatctttaataagctgccctctgcctttctagatccaatccaggagtcaggaccggccaggagctgagctctggatgcctgtggtggcctaagaaaccatatctggcaagtgagaagcctcagaacccccgaagcccacccacccctcgccctccccgcagtcattgcaaggcgatgggccctgcaggccaccgtcctggtattcacgggagcaagaggaaaggaggaaagaaaaccagcaggaaacctgtgcctgagctgtgaccaactctccagctcaggtgtgtggagaacaaaaagacagtcttgggccctggggcgttgactctattcaccacggacccagcattgcttctgctcgtgaagtgaactccctctgatgccattgccagcaacctcgacaccggaagcctaagccagcacaggtgggcaggcaacccaggacgtaggaaaaggggccagtggtttgaaaaaatgaaattaccactcgctaggataccccctgtgggttttcaagccactaactccattctttaccaaatgttgccactgactgttggcagccaccgggatccttagccctccagcctctaacctcggattagggcaaagtttccaagaatgcactgagtcagggagacacgtgggtttttccagtgaatgctggacttggggatctggagaggcccccagggaaagtctccgtgctgggagcacagctggaagggacgcggccagagcttgtcagggtaaacaagaggggcttttggaggcttcccttctgggtctttccttacaaaatcctgcctcttgctgcacgggtaaaatgggaggatctgagtttcaactccaatgagcagcatcaacagctcacaggacatgagttccttaaaacatgtccttttgcagacttgctgagaccacttctggaccgtagtctctcaagactgagacctcaagccacctcaagtaggtttacaggatgtgcattccacaaggaaaatacacgtacgacacctaaaatatattatctcctcactgacccaactagtataataaaacaaatttcagatctattgcacaacactccaatctaagaattatcctgtattttgctatttttaaaaggagaatcaagactattgatttacaaacaacctcatatgccattattccagaaacaatattttgaaatgcgtcttttattatctaataatttaagaaagaaaaatattgttcttgccactgtttacaaaatggcaaatgattatactacgaaaaacaataatagtcactgaactgttttatttaaaaaacccaaacaacaagagcagcaacaacaacaacaccctccctcatacctcctacttctttttgctgattcaagcaattccctctccccatgcctggccatgcaatctcctccctgtgcagttaaggatgtttatgcttagaaagattggctgacttgtctcaggtggcatggtgtgttctagaagacaagtccattggattcaggcctatgtcctcttttttttcactgtgtgtgtgtgtgtgtgtgtgtgtgtgtttaagagacagggtctcgctctgtcagcaggctggagtgcagtggtgcaatcatggctcactgcaacctcagcctcgagttcctgggctcaagcaatccttctacctcagcctcctgagtagttaggactataggcacatgccacaatggccggctaatctgtttatttttttttagagatgaggtcatgctatcttgcccaggctggtctcaaactcctggcctcaggggatccttctacctcagcctcccaaacttctgggattacaggcatgagctactgtgcctggtcccactgtacatttctttttgtttgttttttgagacagagtctcgctctgtcacccaggccagagtgtagtggctcaatctcggctcactgcaacctctgcctcccgggttcaagcgatcctcctgcctcagcctcccgagtagctgggattataggcatgcaccaccatgcctgactaattttttgtatttttagtagagatgggatttcactatgttgcccaggctggtcttgaactcctgacctcaggcgacccacccgccttggcctcccaaagtgctgggtttataactttgagccactgcgcctggccccatcacacatttcttcaattagcaaagtctacgcagtgagtcctagaattcatgacaactggtgacgcctggtgggtatagcctccattctatgtgttacactcgtcaccataatgatgcttcagccccaggaagtgacttccttaaatgaccacagggtaaattgtctttctgggaggtcagtgcctgcctgacatggccacaggtaagggacagcactgaatacacattctggtgtgatcaagcagagagggcaagaaagagccatttgcaaatgacacacggacagcagcttcgtagacagcaccatcagattgggtgccattatcccagagagaaatgcctatggtgctgggctgggacacagctctagaccagtgccacccggcaggattttgtccagtgatggaaatgttctatatgtgtgctgtctaatatggctggtggttcccaccttggacagctcagctctggactcacatattcaatcagtattcaaaatctctactgatgtttccctggcatctcaaacctggccccggtgagctttgatagtcctatcccaaacatggacacccaccccagtattaatcatttccataaatcaaatcgcccagttgctcaagccaaaaccttggtgtcatcctcaacttcttcctttccctcgctgctgacatccaatgcatcagcaagttctaatggttccatgtccacgacaatttcaaattctctccatcctcacagtcaccaatccaggccacccccatctgccacctggacaatagcaatggcctcttaactctcttgctgcttccactcttgactccccccaagcccaatctgccctccacatggcagccagagctaactgatcaaatgtagagaaaatctgtcagtcttctgcttaaaatcctccagtggccgcccttggttctcagcataaaatctaaatccctggccatgacccatgagccccaccaagtagggctcttgcccacctccttccacttcagcccccaccagactccatccctccccatgctccagcaatgccagagtctcctctcggtcctgtcatgcctcagggcctttgcacctgctgttccctctgcctggaatgtttctgacccagggtattggtccatacagaatgtttctattctattgcatcacttgctgccacctgtaattatcatgtctgtctcactcctctgaggtaatccccatgagtgtctcagccaggtgtctttttgtccccagcaccaagcagggtgcctggcacagaggaaatattagcatatttgcggctgaatggaggaagggatggtggggagcaggaggcagccccgtgagcccccaagacaaactggggccttggccagcctcacctttggggactgtccttccctgaccagggtaagtgtcctgggtatagtgctgcacctgtccaggtgaagatggagtgaaggcgggaggccatcgcagatctccctggccaggcctggagggatgactcagagagaccagaatgtcacattctccggctcctccaggggtgcacagtcctgcccaggagggtccaagcacacagcagctcaggttctgaaaacacccgtccctcaccacctagcagagacccacccctggttagcagaagctggagctgaagggactccttgccctcctgtgtgggtgtgatccctgcgtcctgttccacagctctcatattatctcactgtagccacacagaatcctgcaggggaggcagggcgtgaggaacacactgctcagagaggttgattaacttgcccaaagtcacaccgccagttagatacagagccagaactagagcacagtcttaggctccagatcctagactccctcctctgtctcagagggcaagagcatgggctgcccggtcagtgtccacagctcaactgctccgcaccaaacgctacgcaccacgacaagagcttgaggatgtggcttctttaataaccccacgaacagcagggcgaggtggctcatgcctcccagcactttgggagtccgaggcggatggatcatgaggtcaggagtttaagaccagcctggccaacatagtgaaccccgtctctactaaaaatagctgggtgtggtggcacgcacctgtaataattccagctacttgggaggctgaggtgggagaatcgcttgaacccaggagttggaggttgcagtgagctaagattgcacctctgtactccagcctgggtgacagagcgagactccagctcaaaataaataaataaccccataagcactgcctgccaagccacacccagcacctccaatttccccatctccatttttcttctgtccttatccttctaggacaatgggttacaacaaacttcatggtgctccggagtcacaaagggtatttacaaaaaatacagatttctgaggtcttgactccagagatttacattttgtaggtttggagggtggccttataatcttttaaaaatataatctacgcacattaattctttagttacacacggatttttttcactcaagtgaagcatcaaacttttcacatgagtcttcgacattgaactctctgtcttggagtcatttttcttcaatagaccatagttctccaatgagcattcatattcactttcatctaggttgtttgagtggcagaagttgtttaataataactgtattggggccaggcacagtggctcacgcctgtaattgcagcactttgggaggccaaggtgagtggatcacttgaggtcgggagttcaagaccagactggccaatatggcaaaaccctgtctctactaaaaatacaaaaattagccaggtgtggtggcacgtgcctgtagtcccagctatgtgggaggctgaggcaggagaactacttgagcctgggaggtggaggttgcagtgagccaagattgggccactgcactccagcctaggtgacagagcaagactccatctcaagaacaaaaaacaaaaaacaaaaaacaaaaaaaatttactgggaggaatagtgttcctcctccaattccccctgccaactcatgtccgcccagagcttgtgaatgtgactttatttggaaacaggatttttatttatttatttatttttgagacagggtctggctctgtcacacaggctggaatgcattgacgtgatctcagctcactgagacctctgactcctgggctcaagtgatcctcccaccttagcctcctgagtagctgagactacaggtgcacgccaccacatccgggtaatttttgtattttttatagagacagggtctccctatgttgcccaggttggtctcaaacttctgggctcaagtgaccctcctgcctcggcctcccaaagtgctgggattacatgcctgagccaccacccctggtcagaaataggatctttgatgtaatcaatgtaagatgaggtcatgctagattagggtgggttctaacttcagtatgactagcatcctcctaagaggggactgaggagacattgacatagagccacccgtatgggaagaacacccataaagatggaggcagagatggaagcgatacaactacaagccaagaaacaccaaaggacagcagcccccctagaagcccggagaggggcttgaagtggattcttcctcgcagcctctagagggaaccaaccctgttgaaatcttgatgtccgctgtccagcctctagaagtgtgagagaatacatttgtgtttttttttttggcagggctggggggtgttggtgggtggggatggagtcttgctctgtcacccaggctggaatgcagtgatgccatctcggctcactgcaacctccacctcacagatttaagtgattctcccacttcagcctccagagtagctgggactacacgcatgtgctaccacacccagctaatttttgtatttttagtagagacggggtttcgccatgttggtcagactggtctcaaactcccgacctcaggtgatccacccgcctcggcctcccaaagtgcatttctgttgttttaagccatcctgtgtacggtgctttgtgatggccaacataatatcactggaaatgtgatcctttgctgcatataaccattcatgtgctgttattttatttttctactcattctttaagaacacgtctgtgaatgatttccacagggtaactacttagtattttgtccaacattttgttaggaaaatttcaaacatacagcaaactgggagaatctcaccaggagcacctgcatcccctctaacctggatttcaccattcacattctactttttctttccaaagcagtctttataaggcttgtgtataccagcactaactcttgcaaatgtgaggtcacctgcttaggagtgactataaagctggtgttaaatttatttggctctcttttccccctactaagcgtaattttcatatagttaaaaaaaaatcaaccgtaagggtatagtctgacaacgatatgcctccttacagccaatgcccaaatcaagatacagaccagttccatctccccagaaagtcccaggaatctattttaatatgctcctcatgcaattctgatgaaaggaacgaggaggagatgcggaatacatgtccagttccctcggccagagggagagtaaagtttgagattcaagtggctttccagtagaggtgccatgttccccctagcaatcatggctgcccctctgccgtcctagccttggtcatccacgcacacgtggaatctggcctgcaggcctcccctctaaccacaggctgtgaacacaaagcaggaagaataagcaggacccacctgaatgctgagttccaggacaagctgcagctacctgctccttccacacccctccccatgcccgcatcccctggctgaaatcactactattccatcactgcttggacggacaaccactgtgggccacacacatgctgctgggggctgccgcttgcaagggtttctccaaagtggcttcttatctgctccagccacatgacctcagggcccagggcaagcccggcagccctagcctttgaaagtcaaacttgactgtgttcgccaaggctggtgacaggctccagaatcactcccacctcctgttccttttctttctctagcggagcagagtcttggctgcaagggaatgcaaggaggaaaaacgcaaatggctaaaacctaataaaacagtagtgatttcattggtatagaatatagtccaaaaacagacctaaataactatatatgtaaatgactgatatgtgaaaagagtaggttttttaaaaaaaatcagtggaaaaagatagatcattcaataaatctactgggaaaactggttagtaatttggaaaaatataaacctaaaataatacctatttttttccttacaccccatccctccaaaaaaaattccagggaagcaaaatatttaagcaaaaacaaacacaagaaaaacactaagcatacaattattagtaggaaactgaaatattttgtttttatgtataaaatcttaaagtaggggcagaaccttctaagaataaaaccggtgtcttttactacaaggaaatttaaaggttttgcgttgaaaaaaaaaacattaagcaaggcaaaaggcaaatgaaaagtggaagaaaaatagtaacacagatgccaaaaaacaggctaataccctttacctctaaggagagattataaatcagtaagaaaaagacaactatcaatagaaagatggataaaggacatgaaaaggcagtttactaaaaacgtgcaaaaagttcagaaacatggaaagactcagaacctcccttatccttcatataaataagaatttaaacagggagcaattttttcatccattgacaatgattgaaaagactgctaacacacagaattggtgaaagtgtggagaaacaggcattctcacacgtttttggagggagttaaaattggtacaactgttttgggggcaatttggcactatctattaaaatataagatgtgtattatttggatccagaaattccaaatccaggactctgtattatggttgatttgcatatatatgcaaagggattgtgtaagaatgcttcttgtgacactgacgtaatagataaaagcatcaataggaacagctgttaaaaagaatggagtaaaattatattgctgatatggaaagaggtacaaaatatgtcattgggtgaaaaagacagcaagttgtcaagcagtctgcctcatatgattcctttatgtgagaaataaaaagataatactatatgtgtggctgggcgtcgtggcacatgcctgtaatcctggcactttgggaggctgaggtgggtggattgtttcagcccaggagtttgagaccagcctgggcaacatggcaaaaccctgtctctacaaaaaaaatacaaagactagctgggagtggtggcttgtgcctgtagtcccagctatttgggaggctaaggtgggaggatcacctgagccggggaggtcaaggctgcagtgagctgagatagcaccactatactccagtctgggtgatagagtgagagcctgtctttaaatatatatatacgcatgtatatgggtagaatctctgtgagattacacaaaaaatgatggtatttatagagggactagagtgagagggaaacaattctttttttttttttttttttttgagacggagtctcggactgtcgcccgggctggagtgcaatggtgtgatcttggctcattgcaacctccgcctcctgggttcaagcaattctcctgcctcagcctcctgagtagctgggattataggcgcacaccaccacacccggctaattttttgtatttttagtagagtcagggtttcactatgttggccagactggtctcgaactcctgacctcgtgatccgcctgcctcggcctcctaaaatgctgggattacagtcatgagccaccgtgcccggctggaaacaattcttttttgcacgttcgtcttaactatttaaatttttatgaactatattaatatgtaattattatgatagaaaaaatctactctaattttattcaactatcctatccattccctgaacaaacagaatactgcagaatgtgataaaactttgacatcaatcctaacgaaatgccattagagagtattaattaatgtcgattagaatgagagtttctaggccaggacggtggctcacacctgtaatcccagcactttgggaggctgaggtgtgcagatcacttgaggccaggagctcgagactagcctgggccacagagcaagaaccccatctctacaaaatattaaaaaataatttaaaaaaatgcaagtgtctaggacacagtggatttgaaacagtccaggaaaaatctccttcccagccctttcagcaggtaccgcttcctgtatctagaacattccaggggaatcctcctgaaggccttgggatcttggctgcatgcaaggctcaaagccaggtagctgcctacaaactatgctctcatcatggctgcctggctctgcactaaagttcatgagtcaccttggtcccctgccttatcaggtcacgtcccactctgttgcacctggcaggttctcccttaacacgggtctagactcatgacatctagtctgggacattctttatactcttatcctgaaggagaagatacttaggtgggaccagcaattagaactccaggattcatttatttctataagggaacttcgatgtcagtcttcaatgtctttaaatgtgcaccaacatactacacacgtttcattcatgacacatctatcttcctccattttcccaagtcagaccagccactgccgtagagaaggtctgatgtggaaggccctaggtcttactgctgagatgggcttttcctggctatgaggtagcaacatgccatcggctgattggctgggatcagctccaacccactcagggtgcaaggtgaactcacctttgtgggtgagatcaagagtggtggaggaagtaagagtttcccactcctttttccattcttcccactaaagacccttcttaaacctgtttgttgagcacacctgtgtcacccacatgtacttccttgttttctaaacaagagaaacctagatagaaggagcatttaaaattcccttactttccccgggaaggtcacctctgctagcaagacactccagaggtaacagcaatcctggatcaggctgcttagggagtcacagccatgctggctggaaggcgaggtgctggcctgaggctctgtctgcctatgggatactgtctggcagtgcagccagggcctcgcctgccctatttcacctggacaggacttgcatcttggacaggagaagcagcagccacctcctaggggtcccctcttcctctcctggtgtctgctggagcactgatggacatggcacattgcaaccccatggcaagtttttttaggaaggaggtgaggatctacaaagttaccttgtcctggacagcccctccttaggcatgcaaggacaaagggacaagaaccttagcttagcagctgcctttcctgacctagcaactcctcttccatgtgtgatggtacagatgaaatccctctacagggatcatcgttatccaagtgttctttatctgagttcctgaagaaagttgcaaatgacaggagaattgcttgtccactcccctggacacccactacgctgccgctgcagctgagccacacaccagtgacctccgggcaagtcagaccagcctccaggacaccaggcccccgagggagcatgctgggagccacaaatcattattatttcaggtttcccatgtatttggggtgttttgcaggccctaatgctcataaaggaagtattctctagactggctaaactaaaattgtctaaattaaagactttgggatacaactgcagcaaccaggcatttcctaagcgcctgtgatggcaggtaaagcttttcaagccaacacatcatcccagcttacactctgacccacactccctcaccccatgaaagggcagctgccaggaagctggagtgatccgctgattgatcagtaactgagcgtgcagggagtcaatgacacgtcagaggaaggcatgcctgctccccccaggaaatccccatcacatgagtatactcattgcctcacgtcatcctagaagacaagtttatgaagtctagaaagcaaacagcttccgcctaaggatccttctccttctgtcttcagaggcctgacttcagcccagtcagaaggatcagaggtgaccttggatggtacctcatccctcctagatctgaaagaaatgtatttggtacccctcggcttaatctcatgtctaagatttgtccctaatgagtatgcattgaaaatactgggcacttggagacccatattgcaggatctctctgaaatacaggttcctacatctactccacccactttaagagttcaagtagaaatctatggggcggggtgggaggagggagagcatcaggaaagacagagaatggatgctgggcttaacatctaggtgatgggatgacctgggcagcaaaccaccatggcacacgtttacctgtgtaacaaacctgcacatcctgcacgtgtacccctaaagttaaaataaaagttggaagggaaaaaaagtctatggaaaaatactttgaaaaatgtagatagggtcgggcgcggtggttcatgcctgtaatcccagcactttgggaagccaaggcgagcagatcaccctgaggtcaggagttcgagaccagcctggccaacatggtaaaaccctgtctctactaaaaatacaaaaattagccgggcatggcggcatacacctgtaatcccagctactcgggaggctgagactggagaatcgcttggatcagggaggcagaggttgtagtgacctgagatcacgccactgcactccagcctaggcaacagagcaagactctgtctcaaaaaaaaagaaagaaagaaagaaagaaagaaagaaaaacgtagatcactatatacacttaaggtgtgttactattagctctacagggatcatcgttatccaactgttctttatctgcgttcctgaagattcaagttgcaaaagacagcaaaaatcatgtagatatttatgagtcagttgtttaataaatttggcccttgctcaaatactgaccacctcctaccccaactttgccctgcccatctaggcaaagtgttctctctttgatggttagagggtgctatcatccaacaatatgcaatgtatcaaaatgcaaagtaagataaacatccatgcagaaaaaaaatagaaaacttcatgaagtcactgaaagcagtggagaactgtttgactcacaactccattgccaaataaggaggccagtattgaaaaaggggcaatgaatgaaggaagaagcctttcaaaagagatagacctgttaaaggatgaagagagacccttagcccttaaatacacttgttaataagatgactcatttaggagtaagctgtgaatgttcaaattggagtttatggcatgtcacattgtgcttccacacaattttttttttgagacagggtctcactgtcacccaggctggagtgcagtggcgtgatctcggctcactgcaacctccacctcccaggttcaagtgattctcctgcctcagccgcctgagtaggtgggactgcaggtgcccaccatcaagtctggctaatttttttggatttttagtagagacggggtttcaccgtattagccagggtggtctcgatttcctgacctcgtgatccacccgcctcggcctcccaaagtgttgggattacaggcgtgagccaccgtgcccggcccatacaatttttttggaaaaaccacacatgtgcacaaaaccaacacgacttgactcattatttgctcaactaaaaatcagtgcaacactgcgaactttaagtccttttcagtttcttttttaaagataatcaatttccctctcccaaccccttgtcctatgtctatgaaatattggtcttcatttagaatagagtaactttttttcaagatggagtctcactctgtcacctaggctggagtgcagtggcacgatcttggctcactgcaacctccgcctccctggttcaagaattttcctgcttcagcctcccgattaactgggactacaggtgcatgccatcacacccagctaatttttgtatttttagtagagatggggtttcaccatattggtcaggctggtcttgaactcctgaccttgtgatccacccacctcagcatcccaaagttctgggattacaggcatgagccactgcacccggcctagagtagaaaaacttaaaaaagtggccttttattaggattcaaggactcttctacttgggtctaaggaacaactgaattttttatggcaccttgtctccaaccagcagaagtcattatggttgtttccagaagaccttgcctggcacaagagaaagcaaccatgaaaccaagctgatctgtccttttccctgtttgggggcaacacaggatcatggaagctggatttattcagtccagcgaggtgctccttattcctccacaacagggtcccaaagtgtaggccttgatcaaactgactttaaaatttgaggtctttctttgatctttgtgagtaaacgatgccatttcatagatttctgttattacctaagactaggggctatgtacaagtacctaagtgggttattataagttattaacgtttggaatttttttttgttttttttgagacagagtctcattctgttacccaggctggagtgcagtggcgtgatttccattcactgcaacctcagcctcccaggttcaagcaattctcgtatctcagccttccgagtaactgggattacaggcacgcaccaccacacccggctagtttttgtatttttagtagagacgaggtctcaccatgttggccaggctgttcttgaactcctggcctcaagcgatccgccttcctcagcttcccaaagtgccgggattacaggcgtgcgccaccgtgcccggcctggaatttataaactaaaaccagccatttctagagatccctaaaaactctaattccatttctcattaggtaatctgaacatcattcaatgctaagcaacactggaaaggtcctactgggcacaagagaacacagagaactagaattctactccccctcttaaaggagaaattacaactaatttacttaggtaattttcaagcaagtttattgcaggttgcatggttcactctaagtatataatgacatactttcatgaatgaaattggtggctactagttttactgtaacaggattttaaaaatactttctatgcatcagacttcaaatatgttaaagcaaatcccaccaccttcaaatttgcttgcctggtattgctgtttaaatactttgcaatataccatcaaggtaagaaactgaagttatttggataatagtgttttggaggcagtgtttcacaatataaagtactgagttggaagttcatatttctcagttataagctttatgagtgttgctagcatcaagtttgttgttctcgaattttgttgttgtggctgagctctttttccatcagagagaaagagcaggtggggaaagtggtcattagagtcttctgcccaccttacaataccatgtcacccagcaatccagttactgggtatatacccagaggaatataaatcattccatcacaaagacacatgtacatgtatgttcattgcagcactgttcacaacagcaaagacatgaaatcaacccaaacgcccatcaatggtagactggataaagaaaatgtggtacatatacaccatggaatactatacagccacaaaaaagaacgagatcatgtcccttgagggaatatggatggagctggaagccattatccttagcaaactaagtcaggaacagaaaccaaataccacatgttctcacttataagtgggagctaaatgatgagaatttatggacacaaagatggaaacaacagatacctgaggcctccacccgagggtgcaggataggaggagggagaggagcaggaaacataactaatgggtactagacttaacacctgggtgacaaaataatctgtactacaaacccccatgacatgagtttacctatttaacaaacctgcacatgtattgctgaacttagaagtttaaaaaaaaaaaaagaataggagcaattagagaagattgagaaccactgttctgagtctatgtgctttagagaattttgcatgaaaagacaccagaaagagtaaacaggactagaaacccaggcaacctgggacatacctatgagtgtcacccaggtacttatagctacatgaggactgggggggtcttaaccctgagagcaatgtgggtcttgattgagattttctatggttaacttcacttctaacccctgaaggagactcatgggacgggtagactgtaagagcctgctaagggagaggttttgctaactctctccggctgcaaagaaccgaggacaaaggcagaaatgagtgacttgcttgatggttctccatcctttccatcaactcccaaccttttaacaagacacagaaaagagatttttcttaatcttttttttttttttgatacaaagtctcgctcttgtcccccaggctggagtgcaatggcgcgatcttggctcactgcaacctccgcctcctgggttcaagcgactctcctgcctcagcctcccaagtagctgggattataggcatgcgccaccacacctggctaatttttgtatttttagtagagacgaggtttcaccatgttggccaggctggtctcggactcctgacctcaggtaatccgcctgccttggcctcccaaagtgctgggattacaggcatgagccaccgtgcccggctatgtttcattcttaaagtatcttgcatatgctaatatttccttttcaattatgcacgtacctcagttttccaagcaactcattcatccacttattcaaacatttatttattcattcattcatttttttgagacagggtctcactctgctgcccagactggagtacaaatggtgcagtcacggctcactgcagccttgacctcctgggctcaagcaatctcccaaatagctgggactacagacacatgaccacgcctggctatgttggaaaatttttttgtagacctaaggtctcactatgctgcccaggctggccttgaactcctggtctcaagctctctttctgccttggcctcccaaagtgctgtgattacaggtatgagcccatacccagagcattcaaatatttattagtacctattggtatgtaccagtggtgcctgtgtgtgctagagaaatccaggtgaactagacaagtccagtccttggggagtttacagattagtagacaaaacaatagggaagacaagagccacagtggaaatatgttaaataagaaagaatgttatctgctgggtgtggtggctcacacctgtgatcccagcactttgggaggccgaggcaggtgaggtcaggagttcaagatcagcctggcaaacatggtgaaaccctgtctctagtaaaaatacaaaaattagctgggcatagtggtgggcacctgtaatcccagctactcgggatgctgaggcaggagaatcacttgaacctgggaggcagaggttacagtgagctgagatcgtgccactgcactctagcctggggccgggggaacacagcaagactctgtctcaataaaaaaaaaaaaaagttatgaatgctgtaagataggttcaggtaaagagctatgagagtctgagtgaaggggaaaaaagcagatataggtgaggaggtaaggagaatctctgtggaagaaagaggattcaagctggacttaagggatatggcaatagggagccattgaatacttaggagccctgccataacatgatcaagttctcttcagaaaggttcagagacaatggggaacagaggaagacctgcccaagagactgcgacaatagtgagtgtagcgaggctctagccaaactagggcagaagtgaggggaatgttccagaaggaaaactaagggggggggctcctgaagatcaacaggtggtccaagccattggctcttcttgctccagttactccccattttctccctctgcctatggattctctaggacagagtagccaatggaaacgattactgtgaagagtaagaaaaacatcaataataccccagacataatactgagtgaaagcagccatcaacagagtgcatgatgcccatataaacatgagggattcacaaaactatcctatggggatagagattagaacagtggctgcctctgggaggcgctgttgcctgggaggaggcaggagcctgtgctaggtgctggaagagttctaggtctcgatctgggtggtggcaacagagatgtttacctaggttaaaaaaaaaaaattggccgggcatggtggctcacgcctgtaatcccaacactttgggaggctgaggcaggcaaatcgcgaggttaagagatcaagatcatcctggccaacatagtgaaaccccgtctctactaaaaatacaaaaattagctgggcgtggtggtgtgtgcctgtaatcccagctacttgggaggccgaggcaggagaattgcttgaacctgggaggcggaggttgcagtgagccgagattgtgccattgcactctagcctggtgacagagggagactcataaaaaaaaaaatcactgagctgtatgtttaaactttgtgcacctttctgggaaatgagaagtgagagaaactaacaatggagactgagaagtcacaaccggggtctggatggtgtgtgagccacaatctgtgaatatgctacctgacttttcaaaagggactctgcagatgtcattaagtgaaagatcttgagatgagattatcctggatcatctaggtgggtccagtgtgaccccgagtgtacttctaagtggaagatggatgtaggagcatcagtcgtaggaggagacgcagcaacagaggcagaggctggcatgatgagattgctggctgggccaagagccaaggaatgcaggcagcctccagtagctggaaaaggcaggaaaaaagaatctcccctagagcatccagaaggaatgcttccctgcagattcattttttactttggaactgtaagagagtaaatgtgtgttgctttaagccaccgagtttgtgataatttgccagagaagcaatcaaaaatgaattcaggtggaaaactaaaagggtatggcatccagcagccaggtgaagaaagtgtactggaggggaggaagggtgatcaatggtgtcaccagttgctgccaggccatgcaaggtaaggtgagcactgaccaccgggtggaggaaggcgaaggtcctggtaacgccagcaagggctgtttctgtgatgtggtgggtttcagagcgcatgggatgcttatcacctgtctaaataaatgaagactacatacagaccaatgaggagcatgtgtcataagaaaaaaaataagcgaagatgatgaatgctgttgccgaagcatcagtctgggttatttcccgggaatacttccaaagacaattactctcatgtatttctaggaatcctgtttgtttctttttatttcctccagagaatcctaatttttgaccctcttcccaattctgggtctcaaagcctctttattcactgaattgtggggtgacaccagagagcactcctggagcttgtgctgaccctggggtggccatggaactgcagtgacctgggccctggatgccccaccagctggccctagcttcgtcctccaggtgagactcgactggcaccacagcaggccagagtgtagaagcccctgcaggtggtagagggcagtgactgttgattgctcaggcaggctcccctgggatgcccccttagaggccaagtgatctcaacccctccagtaagtcgacttctcggctctactctgctcagaaggtggcggcagttcagcaaattccccaagcatcagtttttatcagaccggctttccaagatgggctgagctcaagatgttcccggtcctgggtagggtggaaactccaagtctttctgcacttagatctcctccttattgtccctccccatttaattattcaagcccttaagctctgaatggccagagcccaaagtcttacagacccatgtgtggctgaatctgtggacttctcagccatgctgagacagacaagccctgtggaattaaaacatggcatcgagaccttcacacatcaaggttaccccaacactagtggctgacgagtcaggcttgccttctccctaaagtcttctcaagcagagggcatggtcagctggcatagtcagatatctgccaacggtaggacctctccaggattggtggggcatgggggagtatgagccaccctctggcagttatcatcgctctgggtggcaggcttggggctcaggaaaaaccccagttccatattcactttatttatttattgagacggggtctcctctgtcactcaggctgcagtgcagtggcatgatcacagcttattgcaggctcaacttcccaggctcaggtgatcctcccacctcagcctcccaagtagctgggaccacaggtgcatgccaccatgcctggctaatttttgtaattttttcttgtagagatagtttttcaccatgttgcccaggctggtctcaaactcctgggctctagcgacctgcccacctcagcctcccaaagtgcctggattacaggcatgagccaccgtgcctggcccccattccctttaaagtgcacgtaaaagctttgattttactgttattatcgccaagcatgagtacatggaaaaataaagtgggtcaatttaaagataaatattacattatgacagttcaagtggtacaccaaattggtaaaaggcgaaagacttatacaatctgaagagtaaccagagtatagtacaccaaactggggggaaaaaaacctggggtggtgattcatggatgcccagagtctgggaaacacagtaatatagcctgggaaggaggtttagacctaaagtcctttccttgtctatttcttttgtgaaaaatgccggtcgcagctcaataagtggacttcatactctgctaacatgtggctgcagctggcagagcactgctctcgcctgagcttggggtgaggctcttgaccccaccgccctgagctccttccctgctcagccacggctctgtcactcgctcaaggtgggcagcttggcttcaccatgtccaaggccgtggcaggcagcatgttggctcaaacaagttggacttgttttgtgaatgtgccttcgtgtgagtgtgaatgtgtgtacctacagagggtgcagcaaagtggggtgcagggggaacaaacgggtccaggccttctccctgggggaagggccaggatgctcccatccaagggctaaaccagcaggacagggccctaggaggggcaccattcagaaacgagccccaaacaacagagctggttcatggcactccccttccccagcaaaagcctcctgctcctccagagacagggggctctaaccacaagggtgtcagcatccctggtccagcaggagaggagggaagtgcaaaaggcagcttgaggcttgctagaagggcttagctagggagaagaacagaaattgtctccagccaggcatctctttgaaaggatatcccacccccagatttctcctttgacaacctctcccacaagttttttgtttgtttgtttgtttttgagacagggtcttgctctgtcacccaggctggagagtacagtggtgtgatctggctcactgcaacttccgcctcctgggctccagtgatcctctcacctcagcctcctgagtagctgggactgcaggcacgagccaccacacccagctaattttttgtagagacggggtttcaccatgttgcccaggctggtctcgaactcctgggctcaagtgatccacccaccttggcctcccaaagtgctggaattataagcatgagccactgtgcccagccttcctctctctcaatttaaagacaaccctgtactagttcttaggttagaactctgaaggcagaagctggcagcccagtggagggctgggctagtgtgaccattgtcaagtttgggctatgcgtctgcagatgcattgttttgagttttgttccacatgctcaggttggggcccagaagtaaggatgtctgcagcatggcccgccctcgggctcttaggcaacagatgagcatacaggtcagaagcacatgtgagactgggtccctgggtccctctctaagcatcagacaaggcaaaccatggtgctaggtggttagcagagctgggaggtgggaccatccagggcagctggccaggggtggctgtaagcatactcaggatggtgttgcgaggacgagccacaccctaaggctcctttctagaggatacagtgacaacacagggcgggcccatgagccaccgcaaacctgtcagtctcaacctctcttatttcctgcactcagtttttcttttcttttctttttccttttctatttttttgtgacaaaatcttacctgtcacccagactggaatgcagtggtgcgatctcagctcactgcaacttctgcctcctgggttcaaacgattctcttacctcagcctcccgagcagctgggattacaggcatgcaccaccacgcccagctaatttttgtatttttagcagagataagattttaccgtgttgcccaggctgatgtcgaactcctgacctcaagtgatcagcctgcctcagcctcccaagcagctgggagggcaccaccacacccagtgcacaaccacacccggctaattttttgtatttttagtagggacagcgtttcaccatgttggccagactggtctcaaacccctgacctcaagtgatccacccgccttaccctcccaaattcctgggattacaggtatgagccaccgtgcctggcctcctgcactcagtttttcttatatcttcttctaaacccttcagcatgagccgacaccaaacaccaacctctcagattaaactgggccctcaccacacaatgctgagtcccagcatattgtctagagactctcccgaattcatcccccttccccccatggtcacagccactgcagtggcagccatgcagcagcatcctgcctgatctcctcacacccacttaggctgtctctgttcctccttgaaactgcagccagcgtcctcttctaaagatgcaaatctgaccatgaaccctgcctgaacctcttccctggcttccttttttttttttttttaagatggagtcttgctctattgcccaggctgaagtgcagtggcgtgatcttggctcactgcaacctccacctcccgggctcacctggcttcccatttttgttagagtcaagtcccaaatcctgaccacagcctacgaagccccgtgtgatgtggccccggccgacttttggcctccccccacatccctgtctttgcccatcagcctctggccacgttggttttatttgcagtcttttactatgtcaagctcttcctgccagagccttcacacgtgctgttccctttgcccaaaatattcttcctgctacatgccacctggctaagcccagcctatcaatcagctctcagtgtcaatgtcgctttctcaagaaggctctctatgctcctcccctctagatccgtactctgatacaccattaattaagcaactatcatgtgatctgtgtgttccctctccttccccattatcccattagctccatgaagacaggaaccgaattcgttttgttcattgatatctccccacacccagcacagtgctgtcaacccattaaggaaccagttccatgactgaataaatgatggagaaattaggcaggatgacccaatgaaaagccacctgaaacagtgggtgctaagtcctttcaaccaaagatctaagagtagttgctgggctcatcttgaaagcaagagttagaagcaggggacaattgttggttttcaggagtcccccttatccacggtttcactttccatggtttcagtaacccacggtcaacctgggtccaaaaacataattaaatggaaaattccagaaataatttataagttttaaattacttttcaatagtagccaatgccacatcaccacacctgtcattcacctcactccaacccatcatgtaggcatcttattatctttttttttttgaggtgagctctcactctgttgctcaggctggagtgcagtggcatgatcatggctcactgcagcctccacctctcaggtgatcctcccaccttagcctcccaagtagctagaattatagccacatgccaccacacccggctaattttggtattttttgtagacacaaggtctccctatgttgcccaggctggtcttgaactcctgggctcgagcgatcctcttacctcggcctcccaaagtgctaggattacagatgtcagccactttgcctggcctcatgttatcatcttacattatcacaagaagagtgagtacagtactataagatgttttgagagaaagggaccacatacaaatagctcttattacagtatattgttgtaactattctattattgttgttgttaatctcttcctattgttcttaatttataaatttaactttatcatagatatgcatatatgggaaaaaacatagcatatataggattcggtactatctgtggttttaaggatccactgagggtcttgaaatgtatccccttggacaagggggaactactgtatatctaagcatgatggccccataccagtcccagagccaggcctggggaacatcaagagagtcgctttgcctctggcctgagcctacctggaatcctgtggactaggtctgtctcctccacccgaagacttttgggatggagccagcattgattttggagtcagatacatgtggctttcccactatttagctatttgaccttaggcgcattaatcagagcctccctgagcctcagattccatatcctgaaatgggaataacaaaacctgccccaggttgagttaaggacttaaataccatcgggagctggtactgcacagaagcgtgcagctcagcacacagtctggtccaaagtgctggtcccttttccttggcaaaactggctcatgcctttcatttcactcttttggagtcccaagccagcgtgtaggacaagaatataagggaaggtctgagaggttggaggacacagtccaccccagacatggcccaggcaaggccagggcggcaccaggaaacccaagctagtgagaagagttactgatctgtgcctctttgaagcagaagtgaggtgggatggggaggtgggaacaggttgagcccattatccaaacagaaacggagagtggttgcaaagagggagaggccgataagtgaagaggaaggaaagccgaggcgtatggggggctggggacagaaacgggaatccaggttgtcggagggcaggggctgcagaaggaacacgctggaaggaggggtgctggggaaatgggagagctggcacggaggcgggccaggcggtaagggtggaaaggaagagcaagttcctggagagaggaaggaggggttggaggggacgacagtgacctgttgcctggagagaagagagggaaagcgagggaagggagggcagaagctgtcaccttgggtcctgctagagggcaagtgaacggggctcgcccgggagtggaaggctgacggaggcctgggttggggtggggggccccggcccggctgtacctgctgctccccgcggagctctcccacgtagtactgctccagccagcggcgcgcgttggccgagtgcctgtgcggcggcccgtccaggtcggcgctgatgtcctggcccgccctggcccgcagcagctgctcgccccccgggtggtgccgcacgaagctggagaggtcgtagaggcgggccccgcggcggacccagcacgcgccggccgccaggcgccgctggacctcggagggcgagaaggaggcggcggggggcggagcgggggccatggccggagaccgcagctcccagcgcgcagcccggcgtctgctctgctgccaccctgagcgcctctaacatcccggg

SEQ ID NO: 1457 - DNA, 18379 bp, Homo sapiens
atatctgttagagacattttatttagaggcaagaaatggttaataagatgagacccttgggtctaggagcgtttgctctttgttttcttccttagagtgacagattttttgctgttggtgaaggcccttgaagactgtagtttaaattcaactggaaagtggtcgctgacatccagggcctataaggagaaaggggaggtagacatggaaattaggagatgcctgggagatgctttcattttagcgatgagcaaatttaggaccagggaggggagaggaaatgcccgaagtcaccccacagaacacttactggtaagcgtcattccaagaccagctcgatcagaaattttggaggggcctcaaatcacagaatcataggcattgagggtcaaggtctagtgcccaatgttgtgtcttcagtggtgacctcaaagggtggcatcaacccatctttttttttttttttttttgagacaggatctcactctgttgcccagcctggagtgcagtggtgcgatcttggctcactgcaacctccgcttcctggactcaagtgatcctcccacctcagcctcccaagtagctgggaccataggcatgcatcaccatgcccagctaatttttttgaatttttcatagagatggagtctcatcatgttgcccaagctaactcatctttccaggacaatggcatagaaagacaagatggcaaccttacctcctcttcagtcagcttgtaagctttctggaagtcaaaaacactgtttgacttgggaacaacagaactgacgatttcttgtcctctaagcacaatcctggaacaaggggagggaaaacagttgtgttaatccaacctgtgattgctgagatcaaaccaaggtctgtgtttgctgtctggaattaaccgagcagtctggccctttcatgtggcgctcaaagtccagagctggttttagcctgtgaccccaaaggacagtgcctacaactgtgaaataggatcagtccctgccatggttctgtggacaccaggacactgtctcccagtgtgggcaatgttctggtggagtaggagaagattttatatgacacacgcacactatcccacacaacaatgacttgcgtactgagaacgctgttcctttttcaattatttttcactttccctgatttgattatggagaaattctcagggaggtgctggtttgtctttaatacctccctcagtcccgtgttgacagagagtaggctgccatctccgagcattctgcaggcaagagaattaaggcagaatttaacaaggcgtgattttcactggacttaatttttacgttaccttcaatttatggcaaatgctgctgctttcttactcatgctagtatcatgaaatttcttttaaaaatttatttcagcaagaaattaagcgatttaatggaaaatatcgagaaaaatcacagcatatgtgctttgcaataatgacaaaaagtaagaatgaggtagtcaaatgagttttggaaacaaactaacatatcccaagttgggtgatgcagttgtggtctacgtggtcctgagtgacttcccgaggaatggcaaggtgagtcaaactgccatttcatgagtgaccagtgggccttccccattctaatcaacagttttggtatctgcatttgctaacatcaccagcacaactaacttttttttttttttttttttttttgagacacagtcatgctctgtcacccaggttggagtgcagtgcgccatctcagctcactgcaacctccaccttccgggttgaagcgattctcctgcctcagcctcccaagtagctggaattataggtgtgtgccaccacgcctggctaatttttgtatttttagtagagacggggtttatccctgttggccaggctggtcttgaactcgtgaccttaggtgatccgcccacctcaacctcccaaagtgctgggattaccggtgtaagccaccgctccagggctacggcttttttttttctttttttgagacggagtctctctgtgtcacccaggctagagtgcagtggcgcaatctcggctcactgcaagctctgcctcctgggttcatgccattctcctgcctcagcctcccgagtagctgggactacaggtgcccggcaccacgcctggctaattttttttgtattttttagtagagacggggtttcactgtgttagccaggatggtctcgatctcctgacctcgtgatccaccggccgcagcctcccaaagtgctgggattacaggtgtgagccaccacgcccggcccgggctacggcttttaattcaacccaaatgtaaattcttcgcatcaagttagacatttgtgaaagctttctttaagactcagaaagcaaagaatgacatgttaaaggctcttccatttctgacttcttctagggatgtgcaggaccaggccagtgttcatgtgacgttttcagtccagggcaccagccagatcctgggcatctttgcatgttcccccagcactcagcacatgagaggtgtttgataaatatgtgaacatggaacaaagactggaactgagaccatcttgtctaattacatttttaaaacatcatttttatggcttttcattttctccgtttattttatttaattttactttttattttattgtattgagacaggtctcactatgttgtccaggctggagtgccgtggctattcacaggcatgtgatcatgttgctctaaagccttgaactcctgggctcaagtgatcctcctgcctcagcctcccaagtagctgggattacagcatatgccaccacaactggcctatgactttttaaaagccacaagaggccgggcatggtggctcacacctgtaatccaagcactttgggaggccaaagcaggcggatcacctgaggtcacgagttcaagaccagcctggccaacatggcgaaaccccatctctactaaaattacaaaaaaaaaaaaaaaaaaaaaaaaaagcggggcatgtttgtgtatgcctgtaatcccagctacttgggaggctgaggcaggaaaatcgcttgaacccgggaggcggaggttgcagtgagccaagatcctgccactgcactccagcctgggcgacagagcaggactctgtctcaaaaaaaagaaaaaaaagaggcacaagagttatacatgttgttatgagaaacaaaattcagagcatcaaaataagaaatgaatctttaaaatgtcacatgtaatcccaccatcctttgggatacatgtgtataaaatcaggatccttttagtaaacatctttttctaacctgttctacccctgacctgatctactgtggccatgttgccttctgattcttctgtatcattttcaatcacttcccactcatttgccaggggagaagaatggcgctggagaagggacttgacctacccacgggcacacaactgccatgtgtaactgagtgagtggccatcgtccaggctttgctggaagtccttcaaaatagggggtctgggcacttagacccctgtaactccccgccttgggttcccactttgcagagtgataacttctgcaaaggaaacaccagcctcaaaagctccaagaggaacaggccgggcatggtggctcacgcctgtaatcccagcactttgggaggccgaggcgggcggatcacgaggtcaagaaatcaagaccatcctgggtaacatggtgaaaccctgtctctactaaaaatacaaaaaaaaaaaaaaattagccaggcgtggtggcgggcgcctgtagtcccagctactcgggaggctgaggcaggagaatggcgtgaacccgggaggcggagcttgcagtgagccgagatcgcaccactgcactccagcctgggcaacagagcgagactctgtctaaaaaaaaaaaaaaaaaaaaaaaaaactccgagaggaagtgaaaacgagtggcctggtggctctcatgcagatggccatctcacacttcctcgtggcaggctgagctctgggaactgtggccaccacctgggaccaggctcctaggggtttccccacctgtggtctctgtgatggaagatcactaacattcacacgcctcaggcactcccccctctgtccccattgaaggagcaaagatgaaagctgtttgaaaatccctgaagggactttaaaaagcacgagggaatgctaggacttaaatgtatgcattgcatttaggaatatgtagctaaagctttaaaaatataaataccgttgcactaattggtctcatttttagggttgcttcctgaggaaatcataaatacttgcacaaaatgcacagaggatattgattttagcagtatttataacagcaaacccttggtaataacccaatgcctaatgatggggattgggcgcatcaattgcggtaagtctttgtgatggaacaatgatcagcccatgaatgtaatgagcacttgccgtatgccaggcattgtgctagcagcctgacatgttatttcatttactccacatcggatcttcatgagtgaggcactaggataacttccattttacaggggaggaaatgaaagacacagagagcttgtctcttggtcacagacatatgaagtgataatgtcaggatttaaatccaggcctatctgatagcgaagccagtgcttacctctgctaagctacagtgcccagggccaccgcatagggtcctgtggttcatacgctacatgtggtacccagtagaggggcctgacatttaattgactcagctctgcaagcagtgtgcttttcttatttttatttttattttttatttttgagacaaagtctcactctgttacccaggctggagtgcagtggtgcgatcctggctcactgcagcctccaccttctgggctcaagcgatcctcccacctcagcctcctgagtagctgggagtataggtgtgtgccaccatgcctggctaatttttgtattttttgtagagacggggtttcatcatgttgcccaggctggtctcaaactcctgtactcaagcgatccatccatcgaggcctcccaaagtgctaggactactggcgtgagccacagtgcccagccaccttgcgtctttcctagtgcacaccaagcactgtggtgagccagcagcaccctgcagggcctcctacctgtcatatgcacagttggtgctcttcttcaccgtggtgtcctcttggtccccgatcagccaaacaaacctggggtcagtcctcaagcggatgttcttccaggccttcttggggacgtagctgcagccggcattgaagtcacccatgaaaatgaaattctaaaagacaagatttggaactgtcacctggtgggtgctgctgcagaatgctttcacactggactctagcaaagactctgcgtcccaggcccagtaaacaacagggtctgttatgggctgaatcttgtctaccccctgctcccgccccggccaaattcctatgttgaagttctaacccccagcaccttagaatgcgactgtatttggagatagaacctttcaagagggaattaaggtaaaatgaggtcatatggatgggctctaatccaatatgactggcgttcttgtaaaaaggggaaattaggacacagaaaagtggagcaaagaccatgtaaagacactggaagaagatggccgtctacaaaccaaggagagaggcccccaaaagacaccagccctgctggcacaccttgttctgggactccagcctccagaacggtgacgaactcactttctattgtttaaacttcccagtcttcagtatggtactttgttatggcagctctagcaaatgaatataaggtctttaaaaatttctttttgttgtttaaaattgagtcacagttttgatgagtcgatgacaggcgagtgcgtaccagggaggatgttcttaacaggaaggagaatgtttgctgttcttagtcgccacatttccataattcagcatgcagagtcaggtgtggataaaaaaaatttcagtgaatctattccctcacatcttttgtccctggctcaaactactgtagggtgtaaatatacgaatgaatcaacgccttttgctttcaagcaggaaaagtgaatttgggtggtgtattgacaaccctggcatcactctttctctcctattgttttgaagttggaaacttatttctgtgaaaattcagtcccttgaggaggtgggaggcatcttcaggggaggggaccattgagtgagctgtccacccccacccaaggccaccaagagaaacttcctatcttggaaatatttttccctgcaaggctcttggaacagaattttcaacattccacaatccagaggaagtgccagatttccttgtttgtgctattgtttggtggggcattgctgacttcagagttttcttcaagaacattttattttgaccttggtgatcacaattttccccatgattgatgggttcagttgaggacagagtgtcatccttaacctcagtgatcaccagcttctgctaatatagacatgatttgctgaacattcactatgtgccaggcctagcactaggtgtttttaaatttacacctggcagcaataaacaataggaggtacaagagcccactaacttctatagaaacaggattgagagattaagtgacctgctctaggccacaggactgggaggttcaaatggtgaagtcaagaatcacatcccagccaggcgccgtggctcacgcctgtaatcccagcactttgggaagccgaggcgggtggatcacctgaggtcaggcattcaagaccagcctggccaacatggtgaaaccccatttctattaaaaatataaaaattagccaggcgtggtggcacatgcctgtaatcccagctactcgggaggcaggagaatcacttgaacccgggaggtggaggttgcagtgagccgagattgcaccattgcactccagcctggggacaagagcgagatttcatctcaagaaaaaaaaaaaaaaagaatcacatcccagtctgcttcactgaagcagtttcccctcttgttcacttttaggccactgatgcctccccacagcccaacactcaatagatgctcaatacattcttgtttaataagtgaatgatttcataatttttggaaagaatgaatctttcttttgacctatttattaataagcaatgaaatacacccctggtcttttccatgccccagctctgatggactatgttcacactttatttgattcattttgcatttgagcagcagaactcaagaggaggaagggggatcacaggagtcacattccgaaacgagaaaagagaaatacagaagaagaacccttgggtgcacttccatatttaccaagagctttcacagcccctcacagccacaagtggtctcttccaaaagtggaaagaactgagcctatagggatggcaaatatgtgcccccttctgtgaaaacagcaccccaagttcctttgggagaccacccatccctcctccacctcaaactgagtttggggtggagctggggtggacacagatttagtcaatcagagtagctcaacaccctgatcacaatgattggttcagggatggacacctgacccagtcagagccaatgagactcagtcccacactatttgttgccttgtgggaaagaaaatttattttggtctggaggctgctggtggctgtcctgccatcccagggatggaaccaacctgagaatggagccacacagaggaaagggcaaccaggagatagaaaggaagagacaaatcaagctctgattaccttgtctgagccctggatccagctatgcctgaagtactcctggacatttcagttacacaaaccaatcaattgctcctttttttcatgagccatgttaagattctgtcccttgcaactgaaacaatcctgactgctctatgccttacacttctcaattgcaaagtgggaatgagaaaggtactgtagctacctcaagggattattgggaggattaaataaacttgtccatgtcaagtctcagcacagtgcctggcactagctattcactcagtaaatgttggcatctgttattaatgggaaagtgtggcaattcccaaggcccacatgcagggtacccaggcagatttagcaaaagggatacttagggctgaagaaaggccttaaagaatgctgtaagtggtggtagcctgcacatgcccttcctcctccccctccctggagaggtactcatcccactcagggaccagagcctgcccctgctagatgggaattcgtctgacacagcagtcctcacctccgccttccagcggtgtttcacgtccgtgtagacctcaaccaactcatcgatctccttaacggatgtctctggggtggtgtgcagggggataatcacgaagtctttgacagctgagaaacaggaaagaggcgggggtcacacacttcccctgtcaaggtctcataaacactgctggagggaaaccagctgtcccctccagaaggcacaggctgcattatctgggtccccagttcccagagggtccagccagtggccgagattttaatgatcttggggtcattaggctgcctatttttagtacacgaaagactcatttctcccagttgcccttcatggctaagagaaagctggtagactgttgtagaaagtaaaaaagtttcctcttcaaagtttcccttcttattaaagaataaatcataagtgttagaaataatagtttcctttaaagactaacttccttcaagtctccttgctttgtgctaataactctttgttaagctctatcctatgtagctgttagacatgctcacaggcacatagtacattctatgtccttgtaccttaaccaagatatttgtgctggacattccagctcgcaggcacattccagctcacagcctttgccccttccctatttggcataagcaacttcctcttttcctttgttctcccttgcctttacctatttaagaaaggtttaaattattagccagtcgggttagcttagattgtgtggtctggctccagccaatagagagacaggacacagtagcagggacaagctgagtaaaggataaaaattgcttccctcctttattcaggtgtgctctcgccattgttccatctgcaaggagcaccctttctgcagaaagtaaaattggcttgctgagaaaactttttatctgaatgttgatttttccttgcagtaccagggaacaagcattctgtttctaaataaacattttacttataacaactgtgttccatgctggcattgtgagtgcttttattttcccctttttgtgtgtgtggcaaatctgtattttcttttgtttctgatgtattttatccctcttctttctttttttaattgacaggaaaaattgcatatatttatggttgtattttcttcttttttttaaaggtttcctttttttttttttgagacggagtttcgttcttgttgcccaggctggagtgcaatggcacaatttcggctcactgcaacctctgcctcccaggttcaagtgattctcctgcctcagcctcccaagtaactgggattacaggcatgcaccatcatgcctggctagctttgtttttttttttttttttttttttttggtagagacaggatttctccatgttggtcaggctgctctcaaactcccaacctcaggtgatccacccatctcagcctcccaaagtgctgggattacaggtgtgagccaccacacccagctgggagttacaaaaagagtataaactgacccatctcagcctcccaaagtgctgggattacaggcatgagccaccgagcccagtcgcacattttctagttaaaaaaaaattggccaggcgtgttggcttacttctgtaatcccaccactttgggaggctgaggctgatggatcacctgaggtcgggagttccagatcagcctgaccatcatggagaaaacctgtctctactaaaaatacaaaattagctgggggtggtggcgcatgcctgtaatcccagctacttgggagactgaggcaggagaatcgtttgaacttgggaggcagaggttgtggtgagcctagatcacgccactgcactccagcctgggcaagaagagtgaaactctgtctaaaaaaaaaaaaatgaggcttgtcagtttatactcctttgtaattaagaacaaaagttccaaaaagctatttaaaaattagcatggtcttcacgaaagacttttgtgaagtgtctgaaaaccttcccccaccgttggaggactgagagcctgagtgtggcaatgtgcgcgagcctcagaagccgttcctggcccacctgctaacagcagctgtcgccttctgagcagctcctcctgggacttcccctcattctcagcctggattcccactcttacctcaacagacacgggctgtggggcggtcactgctcaagtcacacagagaggagccagaactcagcccagcaggctgcatccagggccccacgtgtcctcattgccagctctcctcctcaggcctccactgcactcctccatcctctttttggtccccctaaatattccagcttccttcccacttctgagcttttgtgctcactgtgccctccatgtggaatgccctttctccagccctctgtatggctgacttcttcaggtcacagcccaatgtcacctcctctgtcttgtccagtgccctcaacagagcctggtacatagtaggtactgaaaaaatatttgattcttgactccatcgagcattgcataacactgcatgttaaccactggctgggcacagtggcttacacctgtaatcccagcactttgggaagccaaggcaggcagatggcttgagctcaggggttcaagaacagcctaggcaacatagcgagacctatctcgctatttaaaaattttaaaattagctgagtgtggtggtgcatgcctatagtctgagctacttgcgaggctgaggtgcgaagattgcttgagcccaggaggtggaggttgcagtgagccaagatcatgccactgcattccagactggatgacagagcaaggccctatctcaaaaacagaagaaaaaaaaaagaacatgagctcctgaggtggtggcctgggttacaaccctggcctgtccatttcagtagctgggtgactccatgcctttttaaacctcagtttcctgaaatgtaaagtggagataatcctactccctaccttgtagtcattgcaaggattacaggaggctggcacttaatcaggggccagtacaagtactgttgttagagttcagggagcaatccatttggatttcctcacccgctgcggcctgtggaggagtctgcgatgcagtgactggagggagagtgagcctctaggctaggggttcacctaagccattgcttaggattttttttttttttttgagacaagagtctcactctatcgcccaagctggagtgcagtggtacgatctcggctcactgcaacctctgcctccctggttcaagtgattctcctacctcagcctcccgagtagctgggattacaggtgcgcaccaccatgcccagctaatttttgtatttttagtagagacggggtttcaccatgttggccagtctggtctcaagttcctgacctcaggtgatccacctgcctcagcctcccaaagtgctgggattacagccatgcgccaccgcacccagccaggatttttaaaaaggaaggaagagttgtacttgacaggtaccaaggaattgcagaaaacaatttccatgagcctaaactctccaaagagagtggactaccattgcttccagaaagtgggttctgggctggggaagtcttgagtcatggcattctgagaagcaagcctggtgccatcacactgaactgcatcgtctacattgaagtattagaagcaatgcactgtcacatccagcctaatgcctccttaatgggctcatgctcaaggctgctgcgcattcatgggccgttggggaggtcccagacagaaaggcctgtgtgggtcttaccagtgtggggagattggaaccagaccacaaagggctccctggaaaacacatctgcgtctccatcctgatagtcatggtagtgataactcctcttcacagacaccagcttttccctataagaaggaaaaggaagtcctcccagctgagtcagcccttttcttactactttcatgaagcagagatgtaggttcccatggctttctcagaagccagagcaggctcaagcacaggatcgttttcctgagaacaaggctaagtcaactcttctcaacagccagggagctgttgcgaatctgggagctgaagatctgagccatactagttatctgtggcacccaaaagttaatgttcagacttaagaaattactagcaggaagaggaaaagaatacgaagttcaggaatcagctgtgctgagaacctcagctttccagccctgggccaggacttgactatgaggagtaaagaacacctggcctgccaaccatggagccaaccaacaaattaggtgtttggagaccccttgtgttttcagcttgaagagtcaatactttgcataggcccctagttttgacagcaattattttgatgaacactgagaattggttagaaatcaaaatttggttttgaagaaaagacatgcattttgattcaattcacgatttattggtggccatgttccagggagcataggtgatacttacttgtagagaaaggcatattgttctttatatgtgtttcttccaagccgagagctaatcacatagttgtacgttatgcctctccttgaatttctagaaaacaaagatttaacactgcatcttgaagagtaaacattcccctactgtacatgttcctttctttccaatctgcctccatacgcccaatggcatcatgtggaagggccactgttcatcataacctttgagtccaatgagaggagccaccattgattggctggaatgtggcatctgccacgatctttacagccattatttcttgccttatgaggagagtgttatcattaccccctttctatggtttgcaagcccaaagctgggatttgaacctagatccaactcaccccaaaacccgcatgctttggcctgtacctgtgggaggccactgagaccctagaagacaatcttggccagaatcagcccctgaccccgctcatgcccatggctgcagctgcagctcatgctttctggtggaataaatgtcatcaggccacctgtccgtgtccacgaaccactcctgagcatttatgataagcaggaatattctctcctctgaaagccatcaggcatttttttacaagctttgggaccacgatttcaattcactgttgtttatatcctgggtgctggggatacagccatgaagtcccattgaccttgcccctcacctgcaccagggaaagcggactctttctgtgtgtttaccaaacctgctgataactccactctgggcagagcctaacataatttcactctatctgctcacaaaaagatctagggcatgtctaaagctgcagcatattctcagattcagttggaaaaaaagcagaaggggtatttaggggccaacttagaccttacagaaattcctgggacttcagatgcagtatgctaaggcagacttagcccctggggccccaggagtgtgaacagtaggttctgccgggcttccactttggggagactggccctattttgaacatagcctgccaagtcctgagttagcaaactgcttgtggtgactcagttgcaaagtgactaaggcccatcctggcttgtgggggataaagagacaaacaggcttggctctgcttggagtccgcgacagtctagataggttggggtgtgccaagaccactggtggtgaaaagactcgccccagactgactgtggaggagatgactggagcctacctgtcccctcagtcccccacaaacctgtcccctcagtctcccataaacctgactggggacactccaaggaaggctgagatgacaaagaatagagcactggctatgagatcagatgtgacgcaagttcaaaggtaggcttggccacttcctggctgggtaactcaggcaggtcccccactcagttcccttactataagggaagcccttaggcagactgacatggattcttgcctgtccctacaattgtcctacacatgccttccctatgatggataagcccagagcctgggggatgatggcaccaggatctaccatctcatcttgctcctgcccaagacccagacatggcttttgttcaaaagtccctattaagtgtttcttgctgagatggccaggtgcagcggctcacacctgtaatcccagcactttgggaggctgagaggggcagatcacttgaggtcaggaatttaaggccagcctgggcaacatagcaaaaccccgactccactaaaaatacaaaaattagctaggcatagtgggtgtgtgactgtaatcccagctacttgggaggctgaggcaggagaatcacttgaacccaggaggcaaaggttgcagtgagccgagatcttgctgctgcataccagcctgggcaacagagtctcagatttaaaaagtactaaaataagaagcaagtgcccctcactccttcactaacccctttcaccacagctctctgatcacaccccccccccccccaccagaagtaaccactattaatagtttggagagcatccttccagtctttcatctctatgcacatggaaacacaaacacacccttattcatgtaacatgatgactcaaatgggctattttacctgcaattctcaacttgctttttttcaatatattgtggccattattccgtgctggaatatttagctctaacttattctgtagcaagcatgattttttttttaagagatagggtcttgctctgtggcccaggctggagtgcagtggtgtgatcatggctcactatagcctaaacctcatgggctcaagcgatcctcccacctcagcctcccaggtaggtgagactataggcacgtgccaccacacctggccaccagcatgacttttaacagctgcataatattcctgtgtgtgagcatgttgtaattttattatctttcttctactattggtttctaatcttttctcttttctccaacattttcttcataactgtactttttagctcagcctcatctgcttttttcatttctttctgtgtccagacccctcatctatttcccctattctattttatcacagtaaaatcaactggttgaaagttctcaggaccgtggctaagggagctggactcctgggcaacactggctgtgtgaactggtggtcaagtgcgggatctcacattactttcagttcccaggggttttcagatgcccttgcacttgaccttgagccctagagggcccacccttccccatgttacctgttcagcttctccatcagtatggggcagatcctgttgttgctgtccttgatttccatcacgagtatgatgtcacagcgtttgatgacctgcaagaaagagaattcccaggggtttgaggtcatttaccacagataaataaaaccttttattggacacttactgtttttaagtattgcactgagtgcttattaaaataatttcttctctgaactaaatgaaggactccctgaggtaggtaggtgcttttgttatgtacattttaaagaggagcgtgagactcagagaaagttgagtaaattacactcccaatcaccctactagaaaatggcggaggcagaatttgaacctatgtaattcaagcccagagccccttgctcatgacctccccacaatatcctgcctcttggctttgcttgaataattacaataataataataaatatttattaagcccttagtaagcaaagataacagactggattagaaataaagaggtataattataatgataataattataaaagctgacatttactgcaaacctactccgagccttacaacaaccctgtggggtaactatgcttattagcccattaaacataggcagaaaccaagctcagagtggttgagtgactagcttaaagtcatacagccaggataggtggtagagtcaggatttgaacttaggtctgcgtgactacaaagcccaccatgttgaactgttaaaatacagtcccagccgggcacggtggcttacgcctgtaataccagcactttgggaggccaagatgggcagatcacctgaggtcaggagttcgagaccagcctggccaacatggtgaaacccgcctctactaaaaatacaaaaattagcacctataggaggtgcttggtcaatgggcgctagggataatcctattctgaatgcctggcattctcgggtgactgtgagtgccctgtagggtagctcttgcagtgttttggggatggcctcttggtaggatggggagggtgaggcagccttgacaaggacttcggacatgctctgcaggacacagctgctcaggggagatgcagagttcaagcccccatgatggactcaccaaggaacaaaaagacagccgggtttcatcagtgaggaaggagatgggaactcagtggctacccaggctccacgggccatgtgtgaagtggggaaaatcattgccttgcatgtcagggtttcccattgaacaatcttgtcatggctcccacaggcttggcattgctatcctggctaaacaacaccatctagaaggccttggttacctcccaaagggcagggccacctgggtctgagaggctcgtccaaggaagaacagagcctgccagtcctcactccaatcctccttcccagtgacagcaacagcagcggctctggctcatgaatacccaccttgctgcaggctctgctgggtgcctcaggcaccctgagttctcttcaccagccagtgctacaggtggtatttggatgtggtcgccattttactaggggagctggtggttcagggaggggcagggcctcccaagctcacaagtctggtaggtggaatctggacccagggctcctggcccccctaccacaccatggtgtctcaggtttcctaaggtaataagtacctttccagagtcctgggaaagggttaagttgccagcatcaaaaattaattaacctgtaggataaagggagtcaattgactccagagaaagcaagcagtgtccccggacattgggtatatcacccaaggaaagcgtaagcgaaagtggaaggagtggggaagtagaggagagggagagaggaaggaaggaggagaagaagaaagaaagacaaagagagggagggatgatgaggatgggagagagaaggaaggaaggaaaaaagtaaggaagggaaaggaagaaagaaacaaagaaaaagagaaaggaagaagaaagaaaagacagaaagaagaaagaaaaaggaagaaagaaaaaggaagaaagaaaaagaaagaaagaaagagagaaagaaagaaaagaaagaaagaagaaaaggaaagagagagaaaggagctgggctttgctggtgaaaaggagtagctgtataaggttacttcatctttctttgttcatcacctctacatggggagtaatagtccctcttcataaagattatgaagtgaaaccatgtgcttatagtgcctgatacaggcattcaataaatagcaataaaaatcataatggctaacccttatctggaacgtataatgagccagatactacattaagagctttccatttgccaactcctgtagtccccccagcaaccctggagggaaccattgttatcacccctgttttaagatgacggcaggaggtacagagagttgaagtggttattgttccaagccagcttctacattccccctaagggccaactttaagttccttgagtctcttaaagtctgcagacaggagagagggtgtgaggggtgtctgggatcctcctcccaggaaaggggctcaccttcacaatgacatccatggcattcttgtcttcctgcttgctttccccaaaggacctgacgttgaaggagcagatcctcatggccagggcgctgtggatggagaggaggagaagcagcagtggggccagctcccgtgacatcctggcgctgctctggcttcaagactctgtgagaagacagcagtgcttggagtgctggattctggccacttccgcaggctccactgacttataaagc

SEQ ID NO: 1458 - DNA, 18379 bp, Homo sapiens; identical to SEQ ID NO: 1457

SEQ ID NO: 1459 - DNA, 64426 bp, Homo sapiens
gagttgcttggaggagcttggagaaaccagaagtgagatccaggagaagtaaggccctggagtgccaggagcccttctcccaaagatggagaaataaatgaagaaatacaggtgagggtgagcatcacaagggttgacaggggtggtgagagggtgtcggggaggccagatactaagctctggactgagtgagaagatcgagggagcttggggtgtgaagtgtccactccctacatgccgagcattgggctaaatgctggggtgccagtagacaaggaagtcatggagccggtctaggagacaggccatgacaactccatatgaccaagtgaaggggcagcgacaggaggacttccacaggaggagtggtttcctccctggggacagcaaatgggattcaggaaagactcctattattattattattattttcacccaataatcaaggttccctctctcccttggaccaaaatgccatctgccatggcctggttgttcttttcctctcctgcaatcacctcccagggtaattcagctcacctttgcctaaactctggacctgctctgagtgcatttattcaacaaatgttttttgagcagctactgtgttctaaactctattttatgcaaaaatgtcctagctgtgaacattactaagtcccggcccaaatggatctacttctagtatgtttatgtaggaggggtgcgcgggggttcagacagtaaataactaaatatatagaaaatttaaaacaagtagataagcaaatatatagaatgtatttactgttaagtaaataagtgaatatatatagtgaaacatgctgtggggaaagacaaagccaggtggaggaggtgctgtttgagttaaggtactcacagaagacctctctaataagatttcatttgagcaaaggcctgagggaaagggctgcgtcctgttcatgtctatctccccagcacccgttctctctggcacgcagtgagtgctctataaatgttcatgaaacacatgattgtttttgtgtcatatgctgaagtgcttgaagatgcagcccatattttatggtattctacatttgtatagtacttcatatttcacaaagcagttctactttctcaatttcatttgatcctcttgataacagcattgaagtaggcaggtcagttactgttatccccattccattctaaagatgaagaaaccaaaggttcagcacttttttgtttgttcgtttgtttgagacagagtctcactccaacacccaggctggagtgcagcgatgcgatcacagctcaccgcagcctcaaactcctgggctcaagtgacctgcccaccccatcctccctagtagctgggactacaggtgcgcactgccatgcccagctaatttttgtattttttttttttttatatagagacggggtctcgttatgttggctaggctactctcaaactcctggctcaagcaatctccctgcctcagcctcccaatgtgctgggattgcaggcatgagccattgcacccggccccgtgctttttctggagcactattttgttttgtttattttatgcagttcaaccccttctccatcagcctgcaccagtcaccccagaatctagccatgcagtcctctgaattcattaagagctgttaatcactggctggaaagagggaagtgagacactatggggcggccagtgttcatgaggcatttctatttcaacagtctctgccattagagtctcccaggaaagcttgctgaagtaaagccagttttttttttttttttaaagcattgccacattatcctggtgcttcccagaaaacaaagcatcctctgaataaaagattaaagacttgaaagagaaaagcaagttgccaaaccattattaggctgtttaatttaatgatttcacaagaacacacactctaagttgcaactttattcagagtctctcacttgctgtgtcttagctggtatttttttggttgcaaataacagaaagctaaaggagctagctgaagcaaaaaaaaaaggtagagaattctaagaaacagggtatctcatggaacccaagaacagaaaggtctcacacgtgcctgggatatataattagaaattcaagaaccaaggcaggttgggcgtggtggctcaacacctgtaatcccagcactttgggaggccaaggcaagtggatcacctgaggtcaagagtttgagaccggcctggccaacatggtgaaaccccgtctctacaaaaaatacaaaaattagctgggcatggtggtgggcgcctcttaatcccagctatgtgggaggctaaggcaggagaatcacttgaacctgggaggtggagattgcagtgagccaagatcatgccactgcactccagcctgggtgacaagagcaagactccgtctcaaaaaaaaaaaaaaaaaaccaagggagtctttcaacctcctgccccttcaccttcccttctcaaaatatttatcgagtgtctgccagtccctgctcttacataacttacagtgtaaggggacagacacacaaattttaaaaaatccctctaatgaatgtatcgttccaaattaagatacctgccctaaaagagcatggttctatgaaagtctgtataaaacaaaggaaactgaaatataatgggatgctggagatttcctgaaggaagtgatattcaagctgaaatgtcaagatgattagggtaggggagaagaagaacgttccagagcaaagacagcagcacatgaaaagtccctgtggttaaaggaactatagagaattccagaaactggaaagggaggcccttgtggaacacagaggagagcagtggtgaagtgggaaatctagaggggtaggtgggagcagccagaccttgagagtcctcagatgccatctgaaggatctcagtcttcatcctagaaatagagaaggctttgatcagttttaagcaggagggagaaaagggggtgtaacattggatttgggtgtggatttttgtttattttttagaaacagaatctccctctattgcccaggattgagtgcagtggcatgatcatagctcactgcagccttgaactcctgggctcaagcgatcctcctgcctcagcctcccaagtagatgggactacaggcacataccaccacacctggctaatttatctttattatgtttatagagatggggtctcgctggtttgccaaggctggtcttgaactcctggcctcaagtgacctcctgcctcagcctgcctcccaaagtgctgggattataggtgtgagctaccatgcctggccccttgattactttctattatccttttagttctttccacactttccacaatttgtaattattttatttagttttttaatatcagtctccccctctagaatataagcgctgggaggacaaggacaaagtctatcttagtggtttacaactagggacaattctgctgtccatgagacattaagcaatgtctagagacatttctggttgtcacattgggaaaaagtgaggagggatgctactgatatctaataggtagaggccaggatgctgctaaacatcctgcaatgcataggacggcccccacagcaaagaatgatccggtccaagagtcaaagtgttgaagttgagaaagctttatcttgttcaccattgtatcctcagcaccaagcacaatgcctgatacctggcaggtgttcaataagtatttactgaatgaattaattaaagaagagttggctgagcacagtggctcactcttataatcccatgacttagggaggctgaggaggatctcttgaggccaggagttcgaggctgccataagttatgttagcaccacattacttcagctttggtgacagagcaagaccttgtcaataaaattttaaaaatggccgggcgtggtgactcacatctctaatcccagcctaggtgggaggatcacttgagccctagagttcgagaccatccaaagcaacatagtgagaccccgtctctacagtaaacagaaagattagctgggcatagtggcttgtgcctgtagtcccagctacttgggagattgaggtgggaggattgcttgagcctgggaggtcaaggctacagtgagccatgattgggccactgtactccagcctgggcaactaagtgagaccctatctcaaaaaaaaattaaacatgtagaaaaagaagcattgtgctgaatatagataccccccaaaactattgtctgtatgccacatttatcctgttttctggtattcttttcttctttaggaaaataagcattgggtgttttgcaatggctacacaaactagtcatgtcttccatggtcaagaaaatatgtttctggaaaaccattggtaagcatagttctctgattttttttttttttttttttgaggcagattctcgcactgtctcccaggctggagtgcagtggcacaatctaggctcactgcaagctctgccctccgggttcatgccattcccctgcctcagcctcccgagtagctgggactacaggtgcccaccatcatacccagctgattttgtgtatttttagtagagacagggtttcaccgtgttaaccaggatggtctcgatcccctgacctcatgatccgcccgtctcggcctcccaaagtgctgggattacaagcgtgagccaccgtgcctgggctagttctctgattttgcaaacgaaaacagcaacagcattttgctcatgggagctgagggtgagactgggtaaatggtcattgaatcttcttatagccacctgagggctttagttatctaaataataaaatatctcatggaactggagtccacattttatcaggactctgcaggaatccttctcagttactgcacagaaaaatgtttctagaatccttgtagggactagggcaaagagaggaggcactgggggtatcaaacctatgcccagtgctggggcattgatcaaattactttatgttttgtagcattaggagaaacactggcagagattcaaagaagccactaaagcagaagaatatgaatggacttgggcaaaattcggacaatggattattggttacacatgttaaccagacacaggacttactggtaaagaccatggcactttaactgggtcgtgatactacaaatcattcagagaatgcacagtgtgttaaattctggggatttcttccttctcataggattctaggactgaaaaaggagtaattaagcatttatctctaatcctctgccttcagaaatgactgaagaatctctatactgtttatatagaaattgtttagcctatttggccatgtcactaaatattcaggagcatgtgaagactctgatcatgttatcaaggcctgaagtcttaagcatttgattctaaaattccccttcctgagatttgctttgcttttgagattccctgaaatcgagattcagaaatccatttcaggaagtgctgttggacaaatggggtatgataggagaataaacctctgaccagactacgattttaggctgaccttcaatgtgccttcccaagagggtgagtggattgtctagaactcagaattcattctaccagggacacagtggcaatcagtggttgccatgttcaagcaaggctagtgcacaaccatgtacctaacccacactagagtttaaatatgatacctttgaaatgatagtcaaaaacaatacaggtataatgctggcaattaaacaatcagaaaaatactcatgatttacttaggttctggcacttacaggaaagcaagcttaattaaaggagacgaggaaaggttgatagagttttgagattctgaagaagtcttgtaatgggttcagatgttgatgacatgcatctttcctctaattttatatgaaaatgcatgacttcccaggtgtagacaggatcattcttatatttatcagccacagctggggcctcctttgccttgcagatgaacctgaaggaaagagggaaaggattgctccaacacgaagatcttaccattctctatgcaaatgaactagtagagttacataattagcatggcctaaagtcaaaatccataatgtgtttaatagtgtatcttcaagtatgaataatacaaaatctgtgtcctaaaacatgacatcatttgaaaagcaacacagatggaagaaaggtgaattattaagtccaccatgctcaccaggcacggtcgttcacatctgtaatctcagcactttgggaggcctagatgagaggatcgcttgagtcccgaagtttgaggccagcctgggcaacatggtgaaaccctgtttccacaaaaaaaaaaaaaaaaaaaaaaaaaaatacacaaattagtgaggtgtggtggcacgtgcctatagtcccagctaattgggaggtctaggaaggaggatcacttgagcctgggaagctgaggctgcagtaagctgagattgtggcactgcactccagcatgggcaataaaatgagaccctgtctcaaaagaaaaaaaaaaaagtaccatgctcggtgtttccaaccagggggagggttgagtctgaaaggtgagaagagtgacatctagtgtccatgtgatagagagctgtatttccctagatatgcgacagggacctatgattttaggtgcctttcaagggcaggacatttgttagcacagaatcacataatgagaaagtaatcttgcccgtcagtcctctcactccttcatggaggtggtcacagtttggtgctagtttagagggacaacatagtgccatggttagaagcatgacttgagctttacagcctgggtttgaattccacatctgccactttctagctggatgaccttggactgattacctaaattatctgtacctcagttccctggtcagcaagatggggttatcataatggaacccactttgtaaaattaaatgagttaacgtacggaaagtgcttaacatgtaataagtgctatctaagtatttgcagtaattatgagagtgtttttcacacttcttcaacacttgctaatttccctttgagacagacagcccagcaggcctcaggcacagaacttaagtcaaggtcgcttgagcccagaacttcgaagctgcagtgagctatgatcacaccgctgcactccagcctgggtgacagagtgaggccctgtctctaacacggacaaaccagggggctgggtacagcagcccatgcctgtaatcccagcactttgggaggccaaggctggtggatcacttgaggtcaggagtttgagaccagcctggccaaaatgccaaaaccctgtctctactaaaaatacaaaaattagccaagcgtggtggtgcatgcctgtaatcccagctactcgggaggcagaggcaggagaatcacttgaacctgggaggcagaggttgcagtgagccaagatcattccactgcactctagccttggtgacaagagcgaaactccgtctcaaaaaaaaaaaaagatagggtcagtctgagttggcgcccgttgggtatctgtgtgaagggaacctcttccttccctctctttccacttcacggtttgactctggcttttgtcttgcagaggctgcaggggagtgagacccagtcttcagattgggaggactctgaagactggctttcggctcacagtttaaaatgtcagaaactcaccttggctgacctgataagccagggcacagaagtgctgtaagtctgaagctgttccccgcaccccccacagctgcagtgacacatgcaaccccctgggcccgagagatcccctcataaggctttgcttcttcagggaggagggcaccaatgtcgtgcagaaaatatgtttctccacccagatcatccgccattttgagtcaaagctttctgagtaagtatgtttctcactgtcctcccaacaccacagaactcaagaattatgtcatttcagtccgggcatggtggcttatacctgtaatcccagtactttgggaggccgaggcaggtggatcacttgaggtcaagagtttgaaaccaggctggccaacatggtgaaatcctgtctctactaaaaatatttttttaaaaaattagccagtcctggtggtgcatgcctgtatcccagctaccctgtagtctgaggcaggagaatcgcttgaactcgggaggtggaggttccagtgagctaagaacacaccattgcactccagcctgggcaacaagagcataactctgtctcaaaaaaaaaaaaaagaaaggaaaaagaaaaagaaagaattatgtcatttcagtagcctggaagtaactttgttcaaacagcaatctctgtgggaccttgggcaatagagtgggaccctgtctcaaaaaaaaaaaaaaaaaaaaggaaaaactaccactcagggagatgagcatgtctcttcccacttctagccccaatttccccttttctcaaatagaaaggttggaccagatcagtgtctctcagccttttcaaatccatagtctagggccaggcatggtggtccatgcctataatcctagcgctttgagagaccaaggtgggaggatcacttgagcccagaagttcgaggctgcagtgagctatgatcacaccactgcactctagcctgggcaacaaaataagaccctatctctaaaaaaatataaaatgaaatccatagtcccttggatgacacagcttcatctggtgtttaatggttaagagtaatgactttcaatgtcaaattgattgcgttcataactttgcaaatatatgccaaaaacatgcatgcatccccactcctaaaccagattttgatagcacatgtgtattagtccattttcatgctgctgataaagacatacccgagactgggcaatttacagaagaaagaggtttaatggactcacagttccacatggctggggaggcctcacattcatggcagaagatgaaggaagagcaaagggacatcttacaaggcagccaggaaagagagaatgagaatcaagagaaaggggtttccccttataaaaccatcactctcaagccagttaaccaaaagtcaattgctgaatggccattcatggaatgaccagttgctcaaatttctcaaaaccatttaactgtagaatttatagtaacttttattaggttggaagcttaaacaggttttaaagaattctgcaatgtcttggtttatcagttttaattgtgaatccagtattttaaggaatgttcaagtctatttagctaactggtcatttggcaaattgattttcagaggactggctttcagtaaattgacttttagcaaattgacttggatagaatcctgttgttaccttcatgttggagatggtgaaactggggctcagaaaggttaccacacctgtccaaggtcacacagctagtagatggcagagctgtatctcaaacacaaacatattttattataaagctcatcttcagctgggcacaagtggctcacacctgtaatcactttgggaggtcaaggcaggaggatcgcttgagttcaggagttcaagaccagcctgggaaaaatgatgaaaccccaactctacaaaaaatataaaaattagccaggtgtggtggtgtgcatctatagttccagctacttaaaggctgaggtgagaggatcacctgagccaagggaggttgaagctgcagtgagccatgatcgtaccactgcactccagcctgggcaacagagtgagaccctgtctcaaataaaaagaagaagaagataaaaataaagctcatcttcttagctctattcataactcatgtatcccttatgactctatctaccacccactgccccatgatctcatttccaaagaccttttttgtccctctctaggcccccaaatctcacctgcccccagtaagaacaagtcaattaaattaaagtgacctagtccttaccttgtgcatatgatatatgctagtcttcaaccagtcattgcaagccaggcatgcaataaggcaagttcaagaaggtcccccagctacttttcagaaactaggttttttgttaatcaatccagtagaaacgattgcttaactgcctctgttgtgcctttatgatcagtttccaggagactaggaacaattccttctgagaagacacagatttgagcaagtgcaagggtggtcttccaactttctcgtaagaacaccctcccccaccctccacagacctgccctcaccgggcagagtgagcacagagtgagtgagctatgtggagaaaggagacgaggttacatgagcaggttgaagtctgggagggcctgattccaccccttgatccaccaaaccgttgtcatttatcctgtgcactgtgtcaccaatagagcagcacctatacactcgatccctttcacaatctccttatacctagtgccctggcaaacaagtatcttcagttttgtctttcctcgattgtgcccaggcttgagtgcagtggaacaatcataactccatgcagccttgaactcctgggctcaagtgatcctcccacctcagcctcctgagtagctgggactacaggcatgcaccaccatacccagcaaatttttttattttttgtagagacagggtttcactaggttgcttaagctggtcttgaactcctggcctcaagtgatcctcccacgtcaggctcctgagtagccacgactacaggcgtgcactacagtgcacctaaaaggttcaccaccttcttccaagaacctatgcacattaaaaaaaaaaacaattattcatacctgccttttgtgtatgtaagtggctgttgctcagtgatgacgctggccttgggtgatgagtctttctgatgtcttgacagcactattgaagtctatcaagagagaattcagtggctcacagaaaacagcaagaaggtaacgggcatagatttcattctttgccccctttcactcattccatttgtatttgttagaaccctttcagttgcaaatgtagacctccaatataaattgcttaagctaaaaaaaggcatttactaacctaagtaaatgaaaaccccagccacagctggatccaggtgctcagatgatgtcacctctatgcctgtgggctctgctttcctgagttggttttattctcaggacatctctcttcaggcataggaaggtggtgatcagcagctccagtaaaaaggaacttcacttcctgttccctgcacaacttccaaatcctgggactgactctcattgaccaatttacaccaatcatcatagccaaggagatgaaatatactatcactatttgactaggcctggaactagtgctgacttctggggcaaaaataaaataaaataaaagacaggggggaaggggaaagagactggattagccccccagccctcatggactgaaaaagagagacagatggttgcatgtggaaggccagagcactgttaccagaagggggaatgggtgctgggcaggtgagaatgcagatgtgcactgggcatttgactttagacccgcaatgagatttagaagactaaggctgatcatctggatatcacttttcttaaaagtttgattaagggctgggcatggtggctcaggcctgtaatcccagcacattgagaggcctaggtaggtggatcacctgaggttgggagttcaagagcagcctggccaacatggtgaaacctcatctctactaaaaatacaaaaaattacctgggcgtggtcgtgcaagcctgcaatcccagctatgcaggaggctgaggcaggaaaatcgcttgaactcaggaggtggagtttgcagtgagccgagatcacgccattgcactctagcctgggagacacagtgagactccctctcaaaacaaacaaacgaaaagaaaacccacaaaagtttgattaagggctaggcatagtggtgcacacctgtagtcccagctacttgagaggctgaggcagaaggatttcttgagcccaggagcctcaaggctgcagtgagctatgattttgccactgcactccagcctgggcaacagagcaagacttgtcttttaaaaaaaaaaaattttttttaattaaatgtttttctcagaacccaagggtagaagagtgaccatgggcaaatgaacactttgatttgctttcttgtttgttttagcttaattgccatcaactggcacttttctggcttcccgtttgcttccaccttaggcacaatcttcagctcttgccttaaaccctgggaaaagcagatgctaaaagtcatgctccctactcccagtccccacctctacccagatgcagatgctaaaagtcatgctccctactcccaatccccacctctacccaagactagtgggtaacaacatagtgctaagcctgcctgtcccgccaattccaggctgtggtcttcacctcagatccagaacctccttcacttgcttggacgagttgagtcaacagatgcttgtctgcagctatagctggacccctctggttgcccatggtaacaggcagagagaccccacgggaatgaaatcctcccatactccataggcatccacgtagggcatgctgctctcaccccccgacctccactaccccatcctcgcacctttgtcaaagtgggcggggattgatagccccttcatcctgccacccctttctgacggagctacagagaaaccatggaagagcccagggaaacgatcacctgtaaatcagcttaccaggtccctgggtgttgaggcaggcagcctgaggtgatggccagataatcgctggtccctgttcctgttctgctctgtcactaaggccctagaaagtggcctcgcttctctggatctgtgtctgcagaggataaaaggagaagttataaactagtggcatgcaggccaaatctggcccacagccattctgtttaggctccctaattttaactatttttcaaattagttgccaagattttttaaatcctggtatttcacttttatgtctgctatcagacttctcttgaaaaatgagaatatctggtattaccaggctccaattgcctcttatgtacttgtccagttatttctatggaataaatgtctagaacttcaatggctaggtttagggaatgaatgttttcaattccaaaagctgtaaagccctcatggcagcttgtttttaatttaaaaaaatagaactggctctagatttcaacttcttgcctccagattggcaataccctagaatatttgggtcatgaattcaacaaacatgtattgagtgattattgtatatcaggcactgttctaggattgagactaccaacatgaccagtacttgctgaaggaatggttcgctgtcgggggaaaaaacatgaccaatactaaggtcctgccttcatggagcttacgtgctgtaaaaagaaacaaagctgagtaagggaacagagggtggaacaggactatttaaatggaatggttgaggccgggcgtggtggtgcacacctgtaatcccagcactttgggaggccgaggcagatggatcacttgaggtcagtagtttgagaccagcctggccaaaatgctgaaaccccgtctctactaaaaacacaaaaattagccaggcgtggtgatgggcgcctgtaatcccagctactagagaggctgaagcagaagaattgcttgaacccaggaggcagaggttgcagtgagccgagatcgtgccactgcactccagtctgggagacagagtgagactccctctcaaaaataaaataaaaaataaataaatggaatggttgaagatactcactctgaagaggaggcatttgaacaggcacctaaagaaagtgtgggggtaagccctaccaatatcttggggagaatgttccaagcagaggagacagcaagtccaaaagtcttgaggcaggaacgagcttggtatgttccagaagcagcacatgggccagtgcagcaagcacagagtgagctatgtggagaaaggagatgagcttagatgagcaggttgaagtccgggagggcctgattccaaagctgagggctttaataaagcaggggagtgacctgatccaacaagtttcaaaagaatcacgctggctgctgcataacttgactgcacagggggtaaaagtggaaacaggacaaccgctctgggcgagaacgatggaggcttggactcaagctctagggtcgacagaatgagatatggtagattcaatgcatggctggaaggtaggaccagcagaacttgctgatggattggataggtctggggccagagtgcctgggccagtgttgaatggcatttactaagatggggaaggctgagggagaaacagtcttgaagaaaactgagaggtcttgttttggacatgtgaggcctgagggacttagcagacatccagacagagaagcggagcaggatgttgggtgcacaggtctgaagttccaagagaaatctgtttgaagatggacctcagataatcatttagcattcagatggtattcaaagtcatgacactcagatcacttagagagtgatcaaagaacagtggttctccaccaggggtgattttgccccacgggaacatttagcaatgtctggagacattttaggttgtcattgctgaaggagaggggttgttacctacatctagtttatcagcagccagggatgctgctcaccatcctgaaatgcacaggacagctccctacaacagataattatccagcccaaatgtcaatagtgccaaatgccaatagtgccaaatgtcaatagtgccaaagttggcaaaccctggggtagataaagaagagagtggccaggcacgatggctcatggctgcaatctcagcactttgggaggctgaggctgaaggatctcttgaggccaggagttcaagaccagcctgggcaatgcagtaagaccctatctctacaaaaaattttaaaaaaaaatagccaggtgtggtggcacacacctatagtcccagctacttaggagattgaggcaggaggatcacttgagcccaggagttccaggctgcagtgagctatgattgtgccactgtgcacatggaagctcttgttaaaataaagactctaattaggtaagcctggagtgggacctgagactctgcatttctaacaagctgggggatggtgatgctgtcagcccatgacccacaccttcagaagcaagttcctagggcacgccagtattgtgactttggaacaaggaggaggggctctctaggaaaggaaattaagaaaatatggccagtgaagagaggggaaagtgggagaatatagtgtcctggaagacatgtgtactaagtgttttaatttgttaaattcttgacacagtcaaactgtgctatatgctactcagagttcgggaaagtcaagaatttggatttaacccttgggcttggcaagacaaaggtcattgatcaccttgacatgtgtggtttcagaggaataggaaggtgagaacctaacttgaatgggtccccgggaggtaaggatgtgtggctaagatggagagcagaaaaattaaacagcaggaggaagaggtagcatactgagagatctatatcttttttaagatgggcaatattataacctgtttgtatggtgatggaaattgtacaatcaataggaatggatgatccaggagaagggatgattacagaagcagagttcctatttagcaagagaagatccagtaatgcaagtcaaatgttagcctagaccattgctggttggccttagatgcattttaactggaaaaaggtgaagtatgtagggctatgggctggtaggtcagtagactctgcatggaaagattttttttaattctctccaatttgtttttgttttctcagcaaaattggaggcaaaatcacttgctgggagagtacagaaagggagtgctggaggtgtgagaggagatgtaaaatactctctgagagcagaagagtgaattcaacaggaaaattagatatccagtaaagtaggatttaaggaaaaacaccgaatggaacctactgcccctagagaactatcaatttcatgtgaatgaaagttccaatccacaatgcagctataacaagatgaacatttatgtgcagagtcaaacagcattgacaagtaatacagacagtccttgacttagaatggttcaacttaggatttttccacttatgatgggtttatcaggacgtggccccatcataagtcaaggagtaataactgtagagtaataccgtttagaaacataattagaaatttggatgtggtggcacatggttgcttgagcccaggagttcgagatcaacctggacaatatagcaatatgccatctcaaaaagaagaaacaagaaacataattagcaactcagagataccattgcagctggcgaacctaacacatctgtctttgattgatagagtaggcaaaaaataaataaggatatagagaaattaaatcagataagctaatataaatagccatcaaattttatatcttcaaacaaagggtgcttttctatagtctccagattttctacaatgaccatgtattacttcataagattagacaataaatataaggggaaaaaacttataaagaagaggctgccacaaaataagagcagatcatgcccagagctgaagtcatgacattgggttttgcttttcccttataaaatgaggtttccatctgctgctgcttgttaggggtgaggaaagtgtttgcatcactgcgtggcacagagcagctcagtgtaggagacacacagacttgcactggctgtttccaaatgccctctttggttttaggcatttggcctcatcaaaggggccagagtcagcatcctcatagatgtgtcagccatcagcagtggccctcagaaagaagagttccaaaaggacctcatggtaagtctgtctggcacagagaaacacctggaaccacccactacccccagcctttccttcctgagcttgctgacgagcttgtttatagcaaatgcaagatagggtgtcttataaagaacagttcacacttaattagcacctgtggttagagaactatgttgaattctacaaaacccaaccacagagtcattttcagttgtagtgtgaacttccagtattctcaccacgacagtacctgccaactagtctttgactcaagagctcccacgtttccctggaaggaagatgtgaagtctcctgcatagcatagcacagggcttctggccttttctggatggaagagctattctggtttctttggagttatggttcccattggatactcaccagctctagtttgagagaagtgaacaggctggtgttgctcattgctccatccccaactcacatccatagcagagaagctaagaactagagtcagatggctggagtcaaatcccagccacctccaccaattccaggccatgtgactgcgttaactaatctctctgtgccttacttacctcctctgtaaaatggggatgataaccctaagtggctacctagggttgccataagggtaaaaggagcttgtgcaagtgaagtgcttagtgagaagtctggcctagagaaaaagcctctgcagcgtgatgtgatgtggacaggctattttcttacgggtaccatggcagcaatagccagttgtattttgtacaggtcctgcagagccgttatgaggctcagtgtggggctgtcctccagacttgtcccctgttcctggtctcagtggatgtcaggggacaggtgtcagagcaggctcccccttcatgacaagtcctcaggacggagtttccaaagatcccccaggtggagtggtctactattagccagggcagagctcatgggggtggcatacaggtggaatttctagctggccaggaagaagagggagaagttatggatactctccagctcacatgccttagagagaaacctctgtcctccctctctgggtgccacaggtaagtgccaagggtccagcaatagcacattctgagatggcagcccagatgctcatcccacccacaggaggcccggcaggcaggaagcaaatgtcggcttggggctggctgctaagcccagcctcgagcagccctattcagtacagctcacacccagcccagaggggccagcaaaggccagagaggcaaagccaggctcccgattcccctggctgtgggagccagtgatgtccttttgtccaacagagcctcatcgatgagcagctgagccacaaggagaagctgtttgtcctgtcctttggcaccaatgccgggtccctctggccagaccccatggaagtcagcgcctccacgtgagtggctttcctacctgacggtgatgttcacttgttcattttcctccctaaccagcagagtctttattgaataattcaactgcaaaccccaggaccctactagataagtgagtacaaagagacaactcacaaaagcagaaacaatttttggaaagatgtctaccctcgtgagcggttcataaactgacagataaggtgaccacaagacactatttttatccagcaaagtagcaaagatagttttattattgtgaaaataacacatgcatgttttttaaaaattccaacagtatgaaaggatgataaataatagcaaatgagtctccctcttttttttttcaagacaggatctcattgtgtctcccagcttagagtgcagtggcacaatcatagctcattgcagctttgacatcctgggcttaagcaatcctcccacctcagcctcctgagtagttggggctacaggcatgtgccaccacaccctgctaagtttttatttatttatttagacagggtctctgttgcctaggctggagtacagtggtatgatctcggctcaatgcaacctccaccccacgggttcaggtgattctcatgcctcagcctcctgagtagctgagattataggcatgcactaccacgcccagctaatttttgtattttttggtagagacagggtttcaccatgttggccaagctggtctcgaactcctgacctcaagtgatccacccacctcagcctcccaaagtgttgggattacaggcacgagccaccacacccagtcagtttgtttatttttgtaaagatgggatctcgctatgttgtccaggctggtcctgaccttctggcctcaagtgctcttccagtcttggcctcccaaagtgctgggactacgggtatgagacactgtgcctggcccaaaacagttccttatatccacttccacaaataatctttgcacacacatgcatctgtgtgtttaccttctaattttcacataaataggacctacataacactgctctgtaccttggctttctagctggtcttgaatttctttctctgtcagtgcatacaaatctacctcatttgttttaatggctacatagaattctactgcagggatgtcttttagctgggggtttctagcctggggtttttttgagggacaggagggaggtatgtaagaatttctacttatccagtgagtagaaatttattttccgtgaagggaatgtcctcgattgcccaccatgtattggttaccatactaggtactttgcatagatgattgtatttagtatataatagccacctcatggaataggattattatcctcattttgctgatgaggaaatgcagactcaggttagggaagatgcccaaagtggtagagccacgatgggattccagatcccaggaaaaggcacatgctttggccagggccagttgctcatgcctgtaatcccaggacttcgggaggccaaggtgggaggatcgcttgagcccagaagtttgagaccagcctgggcaacccagtgagaccccatctctacaaaaaatttaaaaattagcccagtgtgatggcatgtgcctatagtcccagctactcgggaggctaaggtgggaggtttgattgaacctgagagggaggtcaaggctgcagtgagctatggttgtgctactgtacttcagcctgggtgacagagagagaccctgtctccaaaagtaaaaagttaaaaaaaaaagcatgtgcttagatttctaggacggaggccccctcaccagcactagctgtaaagaggggcccttccagatagagaaatgcccacttctggcagctctggctttgaatcccaaccccaacagtcactactgggtggtcttgacaagtcccttataactctctcatttgcagaacaaggccaatcctacccactcttcacaggactgttatgaagatgaaatgaaaacaaagtacctggctagtgccaggtactcaatgaacaagaacgttttttactctgatttccactttaggtggagcagtgacacctgggttgttatggatggcagccaaaagttctgcatcttcaggaactcctggaattctcttgtcataaccctatgtcatatctttaccatgtgtactattgtttattttattttttatttatttggtttttttgtctttttgtttgtttgtttttgagatggagtcttactctgtcacccaggctggagtgcagtggtgtgatcttggctcaccacaacatctgcttcctgggttcaagcaatcctcctgcctcagcctcccaaatagctgagattacaggtgtgctccacaatgcctggctaattttctttttttttttttttttttttttttttttttttgtatttttagtagagacaaggtttcaccatgttgaccaggctggtcttggactcctgacctcaagtgatccgccctccttggcctcccaaagtgctgggattacaggcatgagccactgtgcccagcctaccatgtgtactattgttgatttttctttacttcaattctatttattattgaaagaaacttttttgtttgtttgttgttttttgtttttttgagacaaggtcttgctctgtcacccaggccggagttcagtggtacaatcatagcttactgccatcttaatctcctgagctcaaatgatcctccagcctcagcctccccagtagcagggactacaagggtgtgcccagctgatttttttaatttttccttttttgtggagatggggtctggctatgttgaccagactggttttgaattcctggcctcaagtggtcctcccgcctcagcctcccaaagtgctgggattgccggcatgagccactgctcctggcctgaaggaaactttctatcaataccataactgagaagctcatatcacttgcatgattatacttctataatcatgcaattatatttctataattagaaagcaaccatatatctttctttaatggctttgagaaaaaaaaaaaagaaagcagccatataaataaatacgatgagagcaaaacagtggttttaaattccagcttaaatctattggctagagaaggtgctagacctgggacttattctcgctgttcaaaagggagacttgacagttatgatcatgaaagatgaacttattagcaccacactgagattttctctttcagatttttgattttttgaagtagaaagaacagacctctttcactagtgctatgcaaaattttagccaagaaagaatcaagttatttttcttctcaccagttgtgtgtaccccaacccatgtgggacatagccacacagccataaagctttctcttagagccttcttagggtcgcggaattaactccatgcctcctgttgagggctggctcccaagagagtgggtatgggtaagaaggaactcagccccagaccctcacatagcacaatttctaaaagctcagatcttagagtcagacctggtttgaaatctcagttttaacagttgcttacagtatcaccctgggcaagtcctaactcagtttcctcatctacaaaatgggaataaaggtaccacctcaacaagttatcattaggtttaaatgagctaatatttgtcctgggcctggtacctaatactacaggccagctgcaggggctcacacctgtaatcccagctgtctgggaggctagggagggggacctcttgaggccaagagttcaagaccaacctgggcaacacagtgagacccctatctctctatttttttttttttttttgagatagagtctcactctgttgcccaggctggagtgcagtggcagtggcacaatctcagctcactgcaaccttccgcctctggagttcaagcagttctcctgctcagcctcccaagtagctgggattacaggcatgtaccaccatacctggctaatttttttgtatttttagtagagatggggttcaccattttggccaggctggtcttgaattcctgacctcaagtgatccacccacctcggcccccaaaagtgctgggattacaggcatgaaccaccatgcccggccctctacagaaaatataaaaattagccgggcaggatgccacatacctgcagtctcagctacgtgggaggctgaggcagcaggatcgcttgggcccaggagttcgaggttacagtgagctatgattgcaccactgcacttcagcctgggtaacacagcaagcccttatctctaaaaagaaattaaaatgaaattcaatacaaacagtcttataattaggttgctgttgttgtctcctcccagcctccaggaacttaagctctgggtaaagacgctgcagcctgatggaggcagcaacctgctacaagctctgaagaagatcttcactctcaagggactggattccctggtggccatcatgagaagctggtaggtcttctttcctaagcaggtgacatactacatgaaaaggactgaaaaaccaaaccactttttgagaaaagattggcttgtcacagtggctcatgcctgtaatcccagcactttgggaggccgagacaggaggattgctcgaagccaggagtttgtgaccagtctgggcaacacagtgagaccctatctcttaaaaaaaaaaaagacaaaaattagctggtcatggttgtgtgcacctgtagtcccagctacttgggaggctgaggcaggaggattgattaagcccaggagtttaaggctgcagtaagctatgattgttccactgccctgtaacctgggcaacagagtgagacccagggaaggaaggaaggaaggaaggaaggaaggaaggaaggaaggaaggaaggaaggaaggaaggaaggaaggaaggaaggaaggaaggaaggaaaggaaaggaaaggaagggaggagggggtggggagggagggagggagggagagagagagagagagaggagagagagagagagataagaaagaagaaagagaaaagatcatcaaccatggctcttcacacatacatgagggagggatggcagtcacaggcagaaagaaagagagaaagaaagaaagaaacaagaaaaaaagaaaggaaggaaagaaaggagagagaaataaaaaggaagaaagaaagaaacaaagaatgaaagaaggaaagaaaagagaaaggaaagaaggaagagaaggaaggaaagagaaaggaaagaaggaaagatggaagagagagaaagaaaaagaaaagaagaaggaaggaaagaaggaagagagaaaaaagagaaaggaaggaaagatggaagagagagaaagaaaaaagaaaaggaaggaaagaaggaagagagaaaaaagaggaaggaaagaaggaagagagagaaaaacaaaggaaaaaggaaagagagaggaagagagagagaggagaaggaaggaaagaaggaagagagagaaagaaaagaaagagaaggaaagagagaaaagatcatcaacaatgactcttcacacacacacgagggaaggactacagtcacaggccacccacccatctgcagaggaggcagagggcagacaggcctgcagtccacctagccctgcatgccacataggtgacctgtgacacaggtggccagttaagaatgggtagatgttccttgggaattaccgttttgctctggaatgttctcaaagtggtctgacctgggatttccacttctcttctgccttctccacagcccagatcagccttctgaaatcctgtctgactacatccagcagtccaccatgggaagagacctcatcatccacttcatcacctacagatgcgatgatcagatgccccctgtgagtgcccgagattctctgaggtgccccttggctttggtggtagtgagctgggctggcctttgaggcctcatgcttggacaggcccccgagctgtggaccagaatgcacctgtccctgtgcctggttctccctttggtaaaatgggaagctttggataattgggaggttcagtcaaggagaaggcttactggagtattggtgttgccctagtgaggcctgaccctggcctcatccctgcaggctgtcctgaagaaccttgcagaagctgttaggggctactaccactgctacagcccaaagatggaggtaagcccttctgtcaacacatggcccctcttcttctctccttgtctgcctccaaggttgtacccaggagatctgggccaggaccatactatatacttgtttctccttttctccttgtccccacctgtattcaatgaggttacacaggtaaaatcaggttagaatgaatatgtgggaagaccagggacaacctgaagtcacaagagatgctttgatcagcctgtatgatgcattgattgaatgcgtgggagcccagaggccttttaaagccctgcctgcagaatcctcagtctcactccagttgccgttaatataggccccagcctagctctgctcccaccaaagcactaagtctgaattgcctcgattttctctcctagatcaactcctgctactgcagggaacccactgcagagcgaaatgagcaatccattctgtaccgatccatccattactgtccttgtcccagttaataactagacatcagccaccctgtgttcacaagggaggcaacgattagcaaacatgtgtgtagatccatttggaagattaagaatgcaatcatctggttgctcccaggctgtgtcttgcctaccattaataaccatgagtaaatgagtgtttgcatctcacaagtgaattcaaaggtcacaaggtccctgcttttcatagcagggagccaagctcaggcagcactctatcttgatacctcatcatctagactctctctgcaggtgactcagactacagaggttagaaaggtaaagtaaatgactgaaactgactggtttaagaaatattttatcttaaaacctgtggcttgaccaggcatggtggctcatgcctgtaatcctagtgctttggaaggccgagacaggaagatcatttgaggccacgagtttgagactagcctaggcaatatagtgacagcccatctctacaaaaaatttaaaaattagtctggtgtggtagcacatggctatagtcacagctactcaggaggctgacacaggaggatcacttgagctcaggagtttgaggctgcagtgaccaatgattgcaccactgcactctagcctgagtgacagagcaagaccctttctctaaaaataataacaaaataaataaattattattattattatagccatcctagtgcgtgtaaagtgtttctttacacttttacagttagaaaactcttcaattgttttaaaacacagcaggtcaggatgggtgcagtggctcacacctgtaatcccagcactttgggaggccgaggcgggcagatcacaaggtcaggagattgagaccatcctggctaacacggtgaaaccccgtctctactaaaaataacaaaaaattagccgggcgtggtggcgggcgcctgtagtcccagctactggggaggctgaggcaggagaatggcgtgaacccaggaggcggagcttgccgtgagccgatattgtgccactgcactccagcctgggtgacagagcgagactccatcaaaacaaacaaacaaacaaaacacaacaggccaattgcacaaacggagcacagcatgtctgcaggctctgtctggcacatgggtcccagtgtataaggcctggtggagagagtctgaccctctgcctgggcattggcctggctgcttgccccttcctgggttgacccctgcaggtagtcaagtgattccggatgtctgattgctcttgccaccctcagcactacaccagccgggacatggatgagctcctggcagaaattcagaaggcccagagcctcctcagccacgtgcaagccctgcagcacagcagcccctgtgaggcgctcacctgcaccatggaggaggtaggtggtgcgagtgtcaattctggggccttctcccagcagcactcagctggcctcgttcccctttctcacctgttcatagggggcacagctgccagtgcctgtcacttcctaaaatcgaaacaaggcaaggcccaccctccattgcaccccagagctctgagttgggtgggctgggtgggcccaccatggtaccggaaagattctggtggatttactaactgtaaaatttatttcagagaaagaccagcaggctcctgccaccctctctatcctgtcactgtcccctcccttacccccagtttggagaatgatgaaaacctcaaccacccagaataggctgcctttaagagagtcattctcacctcagccatggcttacacctgaaatcccagtgctttgggaggccaaggccagagaatcgcttgagtccaggcattcaagaccagcctgagcaacatggcaaaacaccgtctctacaaaagattaaaaaattagccaggcacgatggcatgtgcctgtagttccagctactcaggaggctgaggtgggaggatgattgaacctgggagattgaggctgcagtgagccatgatggcactgctgtgctccagcctgggcaacagagcgaggccctgtctcaaaaaagaattttaaaaatatacaaatacaataataacaattagtattagaattataatagttcttggccaggtgtgatggctcatgcctgtaatcccaacactttgtgaggctgaggcaggtggatcgcttgaggtgaggagttcaagaccagcctggccaacatggtgaaacctcgtctctactaaaaatacaaaacttagcgaggcatggtggcaggcacctgtaatcccagctacatgggaggctgattcaggagaatctcttgaacccaggaggcagaggttgcagtgagcctagatagtcccactgcactccatcttgggtaacagaacaagactcccaaaaaaaaaaaaaaattataatagttctcatttattaagtcctcattatgagataggcacaatgttcaattatttaaatgctttatcttaacactctgaggtaagtatgttattactttttatagatgaggaaaccaaagttaagaggttacataacttgcctgagattgcaaagatagaaatagattgagtttggattgaacccaggtctaaggcccaaaaccttgccaagagtttcccaaaatgaagtgcatgtactacttgtagtttgcaagatgattttaggtggtgcatggattaaattattttttaaatggtatctatttaaaactagctcattatggtcatcatagatcttctttctaaaattgtgaaagggattgaatttttaaaattaaagaaaattaataactaaaaagcattaatgttacatattgattcttaaaatattaataataatacagtagcactcagatatagcaaaattcatgaaggcagtgctcaaatctctgaagtttgggacttgctgttctatttttacttacacattcgctatgtaatttaatctctcagcgcctcagttctttactttgtcaatgtggccacagggtggccaggtgggagctcactaagtgatttgctgcaggagtttttaggggtgacctgtcaccttggagtccatggtgctgatcttcatggtaaggttagggaaggagccaggagcatgggccactgtgagagcgagttgctgggtactccttcctcttcccctggaaattccagaaatctgcagagaaggggaggggatgatggaagggaaaggcaaaactgcctttaatctaccagggagtgtttaagaagctccacttgcattgactgggtggagggtgaagactgaggacttttcagctctaaaatatgattatgtaatgagggctttctcatttaacttagatttccacagagattacaaatgggccactcataagcctcttgcctaaacccccaaagcatgacgctcctctcaccattgagtttccaaacttggacaagacttctgcagagtggcttaaggtcaatggtctgaaaggtaaatctccaaagagggcagaacccaggaaacaggtgactgactaaaaggcttgaatccggccgggcacagtggctcacacctgcaatcccagcactttgggaggccaagaaggaaggatcagttgaggccagggatatgagaccaacctaggcaacatagcaagaccccatctctataaaaaataaaattagctgggtgtggtggcatgcacctgcagtcccagctactcaggtaggctgaggcaggagaataccttgagcccaggagtttgaggatgcagtgagttatgattgtgccactgcactctagcctgggtgacagagcaaaaccctgtctcaaaaaaataaaaggcttgaaccctttggagcttctcaggcagtgcctccaacctcacacttttttttcagccaagaaattaagtctatatcaggtcctggcacccaatgcattctctcctgtggaggaatttgtacctattctccagaaaacagtatcatcgaccatccatgaggtaattcagattcataattctctccagtcctccacaggagagctcccttgtggcttttcctaccttcataaatgttctggcagtaagaatcaccagggattcaggcttcccacccaggaccctagaatgcacatcaaatccactgtagctgttggttttcaaagatctgaaaattgaacttgggagatgaggcaagagggataaatcaggtaccacggtcacctcctccatgaaggttttctcctcccaactcagacaggacagacttgctttctttatgtcctcgctgtacctaatgcagacttctgcaattgctcccataaaggattaatgcatgaatttttacatatttaaatccccatcaagtatgaagtataaagagggcaaactcttctctaactctctatcctccatgtttagtataagtaggaaatcaatgcatgtttactggatggctgagaaggtagttggaagaaaggatggcaagaagaaggaaaagaatgatggatggatggatggatggatggatggatggataggtaaatggatgaatggatggatgagtggatggatagatagatggatggatagatggatgggtgggggggtgggtgggtggatgaatggatggatggatggatgagtggatggatggatggatgggtggatggatggatggatggatggatggatgcatggatggatggatgcatggatgggtgaatggatagaaatctgaacaggtggaagggtaaaagggaaaatggaaggatagatgacaaaatggaataaaggacaagtgaaagaatgaaagtagaaattaaagtaaggatggatggatggaggagtgaaaggatggagaaatggaaggaaggaataataggtgaatagaaagatggcagaaagatggaagactgaaaggaagagagaagagtaagggacatgtaggtctagcagtgcatggatgaatgactagatggatggagtgatagatggatatgttcacttggtggaggatgaaaaaacaggatgaacaagttggattttcaaagcatctgtaaaggcctgtctaggttcccaaacctaagaagctatggccagtatattttaaggtctccaactgtgctctctattactaaaaccctccaaccatatcttcatgactctgatgttcagaaaagcctctcgggaaaacagcctgagaggcttgctgtcaggtatcgtccattcaggggatcactctctctaaggctctctacttccagttccagacaaggcaatgacctggtggtggtggtggtattggggtgtgtgtgtggtggagatgtgggagggagttcgatccgacctcaaatgtgttcagagtccacttcactctcctgcacctgatttggagaaccagtgcccaaattaaactacatgtacttctgttcgcctgctcaccctcctgcccatgcctgagtatagaaggcaatgatacaatttgaatggcacgacgggacagtgaagaacattcatgtggacccacccttcctctataagtaccaggtcagtgatgggttcaatcagtcagaaaatggggtgcagaaagtggggacgggaggaaggttccctgggctatgaagtcaccaagccattgactcaactccctcttgtaaagagggactgtgtgctccacctacaggcctcctgaagctttggccatctcctccccaagcagggacctcaatgcctttaaaaaaaaaaaaggcttctaatcctctggggaaagatctgcttccttccccatttgatgcaatgaaataccgtgtgactcttcccttcctgttcttgtggtgaatttgttcatgatttagtggaatgattatactgcctggattcccagggacttgacacaccattccctgaagcccacccaggtacacgtacttcccctcaggccccttggttgctcagcctttgagcagccgctcactgtggcccacacttctgcagcaacagctcagcagagctatgcggatgtatgagaggcggattgagtggctctccctggccagcagaagaatctggggcacagtctgtgaaaaaaggtacctttcttaagcagggttcttatccttcatgggtctggtgtgtgacgtgacatttatccgcctcatgaattccctgttggtagcatcagaagccatcacttagattagggattaggaatctctcagcagaacccccagaggaggaaaaagtcaccaacaccatcactgatgtcaataatgtcatcattgtgtcactgagcatttttgcaatcccagcacttggggaggccaaagcgggaggatcgcttgaggccaaaagtttgagaccagactgggcaacatagtgagaccctgtctctacaaaaaataaaataattagctgggcatggtggtgtacacctgtagtcccagccacttaggaggctgaggcaggggcaggcgggtcgcttgagtccaggggctcaaggctgcagtgggctatgatcgtgccactgtactcaagcgtgggcaacagagcaagtccctgtgtctaccacaaaaaaaaaaaaaaaaaaaaaaaaatcacacctcctccctggccagagcaaatgggtcatggatgaatagatcctcccacccagccagaggtgtgatgttctgattggccagggtcaaatgcccatccctggagcttggagtaggctcagcttcacacaactcaaattgactgatagaggcagaggtgtttcccaaaggaaaatcaggatgctgttgccagatgaggtaatggatgctgagttgggagaaacaatagttatctattatggccattattatgattccataccttgtttgatgaattaacatttacaaagtattatattttgtaatactatacatctattattattattattattattattattattattattattattattagagacagagtcttgctatgttgcccaggctggtctcaaactcttggcctcaagcgattctgctgcctcagcctcccatcatgttaggattgcaggcatgagccaccgcacctggccactatacatctattatgtaattttgttcttgaagcaaccctatgatgagtcttacaagtagtttatggttaaactacttaaacaaagatcagagaggttttgtgacttgcctaaggccacacagctggtaggaagcggaacttgaaccaaggtcttctgactgtaaatcccatagattttcttttgctatccatagctgtctcaaaatgagaatggggcagaaggtgggaatataagtttgaagttctaaaattagagaaagaacaaataaggctagagatcttaaaacagaaagagagcaaacaaaaagataaaaatattttccaagaggcccagatacacctaattccttatgttacttgctcacctggttttcgttttccctacgaagaccccaacctatggcgggcatagtggctcattcctgtatttccagtactttgagaggccaaggcaggaggatcacttgaggccaggagttcaaaaccagcctgagcaacatgggcagacctggtctctacaaaaaaaaaaaaaaaatttaaattagccaggcatggtgatgtgtgcctgtggtcccagcaacttgggaagctgaggcaggaggatctcttgagcccaggaggttgaggcttcagtgagccacgatcgcaccattgcactccagcctgggcaacagagagagaccgtctaaatatatatatatttgttgtgtgtgttttgttttgttttgttttgttttgttttgtttgagacggaatctcgctctgtcacccaggctagagtgcagtggcgcgatcttggctcactgcaagctctgcctcccgggttcatgccattctcctgcctcagcctcccaagtagctgggactacagtcgcccgccaccacgctcggctaattttttttatttttagtagagacagggtttcaccatgttagccaggatggtcccaatctcctgaccttgtgatccgcccgcctcggcctcccagagtgctgggattacaggcgtgagccaccgcgcccggccttatatatttgttcttgaagcaaccttatgatgagtcttacaagtagtttatagttaaactacttaaacaaagatcagagaggatttgtgacttgcctaaggcaatatacatatatattttttcatattctgacctataaaaatattgaatgctaattctttaaaataaatctgtgaaaatcattatatgaagcgcctaccacttaaaccatctccaccatgaggctttattccattaaagcacctcctgggagagaaggggggcttccatgacccccttaatctaccattgtaagcccacatccgttggcctcaaaccacagagaagattttggccagctatgaatttggcatgcaaaattcccctggaaaaaaactttaaatagtaaaatggaacaaaataaacattatctcagagattcggttctcctcttaaagctcgtgtttccttttagggtggttgtactgctcgatatctctgcgaccaattccatgtacattattcatatccagcactccctgcggctgctgctggaggagcagttatccaacaaggactgtttcaacctcatcgcgtatgtgtctcctggctcctgggggcaagggtgggtcgtgtgtgtttggatgccgtcattgggctgaggctttggacgttgctggacgatagatattgacgtcatggtcacccggcttcctaggatagccatcggtttatctgatttggatgatcttgtttggggcattgaataattaaatagttgcaggactgtcctactggggcgaaggtggtaagtgaccccataacacactgcttgatcaaccaggataaagtaattcagcccattggcccatttggcttccaagatgaaataggaagaagaggaaaggaaggaccccagccatgccctagtgtcagtcctcagcctgtctccagcaagccataccttttcaaacatttaggattccaattctgaatttaaattaaaactgtatatataaatttggccaggtgcagtggctcacgcctgtaatcccagcaccttgggaggccgagacaggaggatcgcttgcatccaggagtttgagaccagcctgggcaacatagtgagaccccatctgtgttttaataaataaataaaattatatgtatacatttaattatgtgtatatatatataaatggtatgcaatttttaaaactgtataatttagaattaaatacaacaaagatcagagaggttttgaagatttgaacttacttcaaaattatatatagttttaaaattatatatagtatatatagttttaaaatgttaatatagttttaaaattatattttatatataattaaatatagtacatatctagcatttttaatttaaaaactatatatatagtttgtttttggttttgtttttgttttgagatggagtctcgctctgttgccctgactggagtgcagtggcttgatctaagttcactgcagcctcctcctcccagattcaagcaattcttctgcctcagcctcccaagtagctgggtctacaggcacacaccaccacacctggctaatctttgtatttctagtagagatggggttcaccatgttggccaggctgatcttgaactcctaacctcaagtaatccgcctgcctcagcctcctaaagtgctgggattacaggcttgagccactgagctcagccataaaaactatatatatagttttttaaattgcatactattttaactaataagggaagacagagagaaaaggaacccacttaaagtgtaggtttttatacaacctcataccaaatagggcattttctaaacctattaagtcaacagttagtattagatattattctgtaccagagcccagtcattccttaataaactctatataaaaatatttatggtaacattatagataaggaattttatttatttatttacccattcattcattcagcaatgtttcattgacaatctgcatgaaccagtccctgtgccaggcactggggagatggacatgaagacacacaaaactcatcctcgaggaactcatggcctaacagtgggagacagggatgttaaggagtgctgttaagcgttttctatagaaatgagtagatagctaggtatgggactgcaaggtatcagtggcaggatcagtccattccacttgggtggagtaggctcaggacatcttcatggagcaagtgccccttttgctgagtcttgatgaataagtagatgtttgcctagcacctgggaatgatggggtcctagggagaaagggtgttccaggtagaggcaacagcatgagcagaggtgtgacgtatgctagaaccttagggaccatcaggtagttcagcatggatatggggctgagagggagagattgtgcatgacagaaataccaggtgatggaggattgatataggccatgctcacgagtttcctgtgctataggatataaaggcactggaggattgcaagcaaggtacaaatacaatcgggtttgcgtcttcaaatgctcaagcaatgctgtgaaggaggaactgaagggatgtaatactggagggaagagaccagtttgactattgcaattgcctgccctagtgttgagtgggcttgagccaaggcaatgtgaatggaagaaagagtgcgtggccagtaagaatgccatattaaagtcaaaaaataacaggtgctggcgaggtagcagagaaaaaggagcacttacacacttggtgggagtgtaaattagttcaaccattgtggaaagcagtgtgatgattcctcaaagacctaaaaacagaactaccattcaaagtagcaatcccatccctgggtacatacccaaaggaatataagtcattctgtcataaagacaaatgcatgtatatgtgcattgcagcactattcacaatagcaacagatggaatcaatgtaaatgcccagcagtggtagactggataaagaaaatgtggtatgcatataccacggaatactatgcagccataaaaaagaatgagatcatgttctttgcaggaacatggatggagctggaggccataatccttagcaaactaacacaggaatagaaaatcaaatacagcatgttctcacttataagtgggagctaaatgatgagaacacatggacacataaaggggaacaacacacactggagcctattggagggtgagggtgagagaaaggaaatcaggaaaaataactgatgggtactaggcttaatacctgggtgatgaaataatctatataacaaacccccatggcaggagtttacctatataacaaacctgcacacgtacccctgagcccaaaataaaagttaatcaagaaagaggtgcatggaggctgggtacagtggctcacgcttgtaatcccagcactttgagaggccgaggcgggcggatcacgaggtcaggagattgagaccatcctggctaacacggtgaaaccccatctctactaaaaatacaaaaaattagccaggcgtggtggtgggcacctgtagtcccagctattcgggaggctgaggtaggagaatggcatgaacctgggaggtggagcttgcagtgagccgagattgcgccactgcactccagcctgggcgacacagcgagactccatctcaaaaaaaaaaaaaaaaagaaagaaagaaagaaagaaagaggtgcatggaagagattttggggagttagaatctacagaatgtcatcactggctgtagggggtgaaagaatggtgaagagaagatgatgtcccaagaagaacagatctctgaagggaaagatggttttaaacatcccgagtctgagacactcaagagtttggagacattaagaggaggaggagctccagtgaggagacctagccaagaaataaggggttttgagccatcagcattttgattctatgaatgaaataaatggtagtgcagggatcgcacctgtggagatgcgaagaggagagagaagacaatcaaaggcagcacttggaagacaccagcattcgaagggtgggcagaagaagggaaccaccaaaagaacacaagaaagaagaacccagagaggtgggaggaaaacaagagagaaaggtgttgggatgctgtgttagtccattcctgcactgctctaaaggagtacctgaaggtcgggcgcggtggctcacccctgtaatcccagcactttgagaggatgaggcatgtggatcacttgaggccaggagtttgagaccagcctggccgacgtggtgaaaccccgtctctactaaaaatacaaaaatcagtgggtctcagcggtgcaggcctgtaatcccagctactcaggtggctgaggcataagaatcacttgacccagatttattatccaacgataatagggatatatttccactggtgggggaatggagggcattctttatctctaccagggaatgcccccagggtggaagtttgactgcaataggttgaggaggtgaggaagtggtggtatactgtgtttccagggagcttgtccacaaggggaaagagaaaagagcgaagtcactcatagagtagcttcccaggggaaggaggatgttcttgttaagtatagagagtctgaaacaggtagagaggcgcggggcagagggaagtggagagaagttgggaatgtgtggatgtgagggaggaactgtggggcaaagtctcagaagagatgggtgatgaggtcaaaggccaggtggaggaattaatctcaaactagagaggggacaacttttccttcataaagggtataaatcctcttctcaaagatcttaaattctgtcttacaggacaaatgagacaatgtgggttttctggatttgaggatttgtttgttttttgagatgggatctcactccattgcccagactggagtgcagtggcacaatcatagctcactacagcctcagcctcctggactcaagtgatcctcccacctcagcctcctaagtagctaggttgacagacatgtgccactatacccagctaattttttttattttgtagaaatggggtcttgctatactgcccaggctagaggtatattttttttctttgccaaatcctgttgattacatagatgtgtatttaaaaaaaaaaaacaaactatagtatggatagggaggggaaatgtgcagtgagagaagccatgctaggggaggttaaagagggggccacacgccatagctcaatgcttcagaaaggaagctgaccaaagctggctcacactgtgtcttggctgaagtatgttgggacatatgacccacaaggaaatctcatggctggcccaggccagtgacatcctcacattttaggggatctcatcagaattttgtccccactaaaagcctgcaaagcccaaagaggtgggccaccaagtggacctcccccagcctaagaacgaactctctttgcttcttaaaggtttggaagcacaattgaaagctggaggcctgagatggttcccgtgagtcacaacaatttacaaagtgcctggcggtaggttatgggcagagacttcgtggggctgtgtctgagggaaggtttgcaggcattgttttctctgtccccctctccaccaagaagtagctctctagagtccctgaccccaaacagccatgggcagaaatcagaaaacagcttccttctgtctgctgctctccccacctggccatcttcactttatgagagtgatgacatcgactccatcacgtctgagatggaaaaggctctcagctactcccaaaaggtatgccctgggcatgggccaatgaccctcagcatggccatctctgcctccgcaggtgggccctgaacctgcggtgtcggggcagcaggaacgttctcagcgccctgcggaaggctgtggaagtagacttcaaggacaaagacaaacaccaatcgcagggaatctacctcttcactgggggcatccccgaccaggacatggtgggtaggccacgtcctgggtgtccattatcctttgcgacctcatccgtcttcccccaggtggataccttgccaaggtttctgcagcatgatttctaaaccagtgcttctcaaactttaatgtatagacaagcacctaaggatgctgttaaaatgcaggccctggagaccagcctgggcaatatagtgagaccacatttctgtaaaaatttttaaaataacctgccatggtggcacatgcctgtactcccagctactcaggaggctggggtgggaggatctcttgagcccaggtgctcgagaccagcctggacaacatagcaacaagaccccatctctacaaaaataaaatttaaaaaattaaccagatgtagccaggcacagtggctcatgcatgtaatcccagcactttgggaggctgaggcaggcagatcacctgaggtcgggagtttgaggccaccttgaccaacatggagaaactccatctctactaaaaatacaaaattagctgggcgtggtggcacattcctgtaatcccagctactcgggaggctgaggcaggagaatcgcttgaacctggagggggaggttgcggtgagctgagatcacaccattgcactccagcctgggcgacaaaagcgaaactccatctcaaaaaaaaaaaaaaaattaaccaggtgtggtgacatgtgcctgtagtcacagctacttaggaggctgaggcagaaggattgcttgagcccagcaggtcaaagctgcagcaagctatgtttatgaccctgcactccagcctaggcaacagagcgagaccctgtctctttaaaatacatacatacatacatacatacctacatagtgcagatcctggttcagtaggtctggggtggagcctgggagtctgcatttctggcaggcttccaggggatgtggatgctactggtctagaacatgcctggtatcaggaggctctcaggtccagctccccaaccacactctgttaaaatattgagagaaactgcaacccagcctcatctctttccatccttgtgccaaggactggaccaggcacagagaaggccctggagaaacatggccaggctgggctgcccagagccccacagcttcaaggccctcagctgctggcccctcctaccttctcttccccaccagcctacactcagtgcctacatggctgaggcctgtggcggctgcgacctccagctgaacgtgtgtctcttctacgtgggcgagccaaagatggacaccacaccccctgcccgctatgccagtcacactgacacagccgccgcctacaaggaggtcacccgggctgcaggtggccgcttccactggtttggagacacaggtacatgactgtttcctcatcccttcagctcattccaaacagttgtctcagcaccagcatagctcccttagaccacagatgtattccagaaaagcagcttgtgaaaatcacattttaaaatgtaaaactgttcctctgaagatagatagcagtgatggttgaacaacaatgtgaatgcacttaatgccactgaattgtacaattttaagtgattgaaatagtaagtttgatgttatgtatattttactgcaatttttttaacttaaaagaagtaggccaggaacagtggctcatacccacaatcccagcagtttgagaggccaacgtggtcagatcgcttgagatcaggactttgagaacagcctggccaacatggtgaaactctattaaaaatacaaaaaaattagccgggtgtgatggcacatacctgtagtcccagctactcgggaggctgaggtacaagaaaatcgcttgaacccaggaagcggaggttgcagtgagcagagatcacaccactacactccagcctgggtgacagagcaaaactctgtctcaaaaaaaaaaaaaaaaaaagaagaagaagaagtaaaactctaaaagtatattatgagtcaggtggtggctcacacctgtaatctcagcactttggaaagttgaggcgagcggattgcttgaatccagttcaagaccatcctgggcaacatagcaagattctgcctttacaaaaaaattaaaaattaaaaaatatataatttagaatgtcatagaatgtcagagctagaaggcaccctgaacatcccttagattgtttttcaaagggtggtgtgttcacagcacatggttggcaagatagttgtacatggtacaaaaagcaacattttttttagagacggggtctccctctgtcacccaggctggagtgcagtggtgccatcatacttcactgcagcctcaacctcctggattcaagcaatcctcccaccccagcctcctgagcagctgggactacaggtgtccaccaccacgcccagttaattttttaaatttttttttatagagaaggggtctcactatattgcccaggctggtgttgaactcccaacctcaagcaatcctccctcctcagcctcccaaatgctgggattacaggagtaagccaccattcccagccctcaagtcacctccaggtggctttctagtatccagatgatggggacgcttgccaggatccacaccctgtctcaccttgctcacgatgtgctttgtttccaggcatttatgagagcgatgacatcaactccatcatgtctgagatggaaaaggctctcaactactcccaaaaggtatgccctgggcatgggccaatgactgcactgccttttgtattcatttcctggggctaccataactgccacaaactgggtggcttaaaataacaaccattgattctctcacttccagaggctggaagtctgaaatcaaggtgtcagcagggccaggctccctctgaaggctttgggtagaatctttccttgcccctccctggcttctggtggcaattggtgtttgtttgtttgtttgtttgtttgtttgtttttaattgcactggttgctcttttaaaatggcaaggaagactttacttaagactattgcaataggggagagagactgaactcaactctaaataatagcaaagatagctggagatttatagccaatgagcagtcagtggatggaaaaattactaagagaactggatagataggatagataaaaggattcttgttaaacagggctcttgctaaaggcagaccaaaggcttagatgtcaaaaatagaactgggcacagtggatcccacctgtaatcccagcactttgggaggccaaggtgggctgatcgctggagcccaggagtttgagaccagcctcagcaacacggtgaaaccctatctctgttaaagaatttttttaaaataatttttttaaaaaaggtatctcagatgggagatgaagaacttgcttggatatcaaggatgggacaggtctcactaaactgacttagcaaaattctttgccaaaactgagttcggcaggccaaggtcaaggcctcattgagaagatggcttagaggagccggctaaagttcggtcaaggaggcagtccttgtcaccagcaatctctggcattccttggcttgaggagcataactccagtctctgcctctgtctttacatggctgttttccctccaggtgcatcccttctcctcttacatggacaacaatcagattagattaaggacctgcgctactccaatatgcctcaccgtaatttgtatcttaattacatctgcaaagaccctatttctatgtaaggccacatgcacaggtcctgagggttcagacttcaacatatccttttgggggacacacctcatcccatgtcagcttccctcttcatgtcctaatccactgagacccaaggcttcagaagaaatgagtgtctcctagaagccattggttttaggtctgtgtgctgcacattctggcctcctttgagttccttaaacacgtcaaggttattgctaaacccattcctaagctcagggcctttgcacctgctgtttcctctgtccttcccatcccagacctttcatggcttgctccttatcattagttagggttttgttttttgttttttgggggtttttttgagacagagtctcactctgtcgcccaggctggagtgccattgtgcaatctcagctcactgcaacctctgcctcctgagttcaagcaattctcctgtctcagcctcccaagtagctggggctacaggcacccgccaccacgcctgactgatttttgtgttttttagtagagatggggtttcaccatgttggccaggctggtctcaaactcctgatctcagctgatctgcctgcctcagcctcccaaagtgctgggatcacaggcgggagccaccacacctagcctattagttagtttagacacactaaaatgttacttcctcagaggagttgagcaggacaagatacaatgagagaggtagctaggagccagatcccgtgaggagcaatgactatctaaggaagaattccccggacttgcaagtgattgaacgggcagtgtgaaagagaaaacatacaaactgacccccacgctcctcactggagcacccagtagacagtgaggccattgaccaagatgtagaaaacaggaggaagagcccatggaaggacggagaggtgcagggaaggcgggtctgggacaagggtgagtttgtggagcctgtgagataacaagtgagggtaccctacaggcaggtgggaaaagacatggctggagatggagatttagggcagttcaagccacagtgacggacagagggcacttagcaaggctgtggtcgaggcagtggagtggaggagcctgtgaaggagactcctggactccaccacttgcagaaggactcacttcccagactggattgtggactcctgggagggcagggccacgtctccatcttctattcctctgtggccactggatctgcagatctgtggctccccctgcgtgcctgtgctgtcttccccaaaagggacccttttggtgcttttaaaatatctcttcccagctgggcgtagtggctcatgcctgtaatcccagcattttgggaggctgaggcaggcagatcacaaggtcaggagatcgagaccatcctggctaacatggtgaaaccccgtctctactaaaaatacacacacacacacacacacgcacacacacacacacacacacacgcaaaattagctgggtgtggtggtgcgcacctgtaatcccagctatttgggaggctgaggcaggagaatccttgaacccgggaggcagagattgcagtgagccaagatcatgccactgcactccagcctggcaacagagtaagactctgtctctaaataaataaataaataaataaataaataagtaagtaaataaataaatatcccttaccctcaggtgcacatagtcccattccctcatcagataaactgatacatatggtgttaatgggcaatgaccgcataattcacctttccagaggatgcttatttacatttgaatggtgtcttctggagctttgattgagaataattgctggggaaccagtcaggctgttgagaaaatcgtaggcaaaaggcattgagtattacaccattagtctgccagcatctggaatcagccctggcatgcggcaagctgactggcccacaagtggaggccacagtgtctcataatggaagggtgctggctttggaaacagacccacctggtttgaattgaagtttctctacacactgataaggtggtcttagatgagaaccttaagctcacagagctgtaactgtaatagatctgtggccagatatgcatggcaagtcaatgcacagagacactgggttgcagcagagaaaagaagtttaattataggactgccaaacaaggagatgggagggaacctcaaatttggtgttaaggtttttaagggttttgcagtgggctgaagtatggagatcactgactagttgagtgcaggctggagtcatgggcaggggagatgaagaagctgtgttctcatgctgttcctgttcctctgggggtcttcaaactgttggcatcagctgctttgctggaattcgggtctgaaaaacatcttaagcaattcttaaacaaaagccttgtgattctgaagtcagaaatcctatctagaggaacaacggggatgcaaacagccaggatctggtgctatgtgactttaggttacaaagaagtggggctatgtgcagcctgatcagggcttcatgataactagatttttgtccagaattcttgttaactctgtgatgacagcttcagagctttggtttcctcatctgtaaaatggggagacgacacacctaccctatcggcatagctgatgtgacttgttggcatgagggttggagacccccaagtattcactagcccagagcctgtgcctcccaggcccccatacctggtcttactgttgttcataggattggtccatagcactttcagccccaggtggctttctagggacaaaaagaggagtccaggggacatcagaggttccagtggatacagtccctcctgctgtgtgtgtgtgtgtgtgtgtgtccacagtggctgggggtgccactgaccctcccaatcccactgcagtgtgccttcctcatggcctccctgaagaaccattcaggaaaagtactgggaagttcagccctcccgaaagaaaaaccaaagacacttcagctaagaagtcagcccaagaagctctgccctcccaggcccaccgtccccctgggggccagaatggtttgactcccctcctaataacacgcagaagatttggtttcctgtttgtcttctggtctttcctgggtcttaaaatggctggggccagcagggatgggggtgggtgcttcagtggtgagtgtcctgtgggtgcctcttgcccaggcctccagggggaaaatctcccgcggggggccggctcctcagctctcggggtcctctgtcctcccccaacccacccttggctctgtcagcctatcccagccttttccctaccctggtactgaggatgccacagaattgacacccacctgtttcatctgatggcttatcctggagagtctctcgggggcaaaggaattatggtctctaagggctcttcccgctgccacccaagactttgcagaggctgataggagcctgagggtgggctgagcctgctaggggcttatcctcattcacagcctatcaattctgtcctccataaaatacccacccaccttggcaatcagaagggctctagaggacagaccccagaggcacctgtgcttgtgagcagactgggagggacacctgtgagtccctcagcattgcatgactcagaccctgtgagcacagcccatgttcagaatgtggaaatccatcccagacagtaggtagcagatttccagccaaagggctgcctttccaggagagcctgtgcagccgggttctgccctcgttcggggaactctgccaggtttcaggagccagctcaggcacttcgccccctcctcagaggctgcctcttgagccttcagtgcttcctgagtgcctcctgaaaccaggccgggtgctccccagacagtgactgtttaatgaccgccacactccagtcgtggctgagaatgaaggaactcttcccttaaaactgaggtgtctgggccaggtgcagtggctcacacctgtaatcccagcactttgggaggccaaggcaggcggatcatgaggtcaagagatcaagaccatcctggccaacatggtgaaaccccctctctattaaaaatacagaaattagccgggtgtggtggcgggtgcctgtaatcccagctactcgggaagctgagacagggagaattgcttgaacctgggaggcagagtttgcagtgagtcgagatcacgccgctgcactccagcctgggtgacagagccagactccatctcaaaaaagaaaacaaacaaacaaaaaaaaactgaggtgcctgataaggcacagaagttacctaaatttctgttgtcatgctggaggcccagacatcccagtccattaggaagaggggcaggtgactgatgaaaaaaattctggcaaacccccatagctctctcactagcagctctctcactctcatctcacacacacacacatgcatacatacacatatgcacatgcacacacatacatatacactcctacacacatgtacacacccatactttttcacctcaaaacccagagtcccttctgaatctgctgcaggagaggggccaaacctgtctgaggagtcccctcccttaggctcctccctacaaaagttcctgattgacaaattgaggtcagggtaactgggatcctgcgtgacacagggaacactcctctgatgggaaagattgcctgttttctagagcattaaagatgaccctgacagagagaagagccccccgctgaaatctctgaaatggcgtccactcagtagcagagttggcatctcaccaggtaaggcaccatcacggtcaggcagggtggagggatgtcacggtcacggctgaggcatgggttaataatgatagtaactagagccacgtgtggaagctcgtgcctataatcccagcacttttggaggctgaggtggaaggatcacttgaggtcaggagttcaagacaagccttgacaacatagcaagactccatctctaccaaacaaaaaaggagccagatgtggtggtgcatgcctgaagtcccccaagtactcagaggctgagttgggaggattgcttgagcccagaagttcgaagctgcagtgagctatcattgcaccactgcactctaacctcagtgacagagcaagaccctgtctctacttttttttttttttttttttgagacagagtctcgctctgtcacccaggctggagtgcagtcgtgtcatctcagctcactgcaacctccacctcctgggttcaagcgattcttgtgcctcagcctcctgaatagctgggactacaggtgtgtgccaccacgcctggctaactttttgtatttttagtagagacggggtttcaccatgttgcccaggctggtctacaactcctgagctcaggcaattcatctgcctcggcctcccaaagtgctgagattacaggcgtgagccaccacgcctggccacatctcttaaaataataatcataatagcaataatgatagtaactaaaacgatcaatgatcctgagtcttgatcatgtgccagcccatctgctaagattgtcccatttaaagcctataatgatcaatcctttgcatctgtattctatcagcttcctattgtactgacaaaggaactgaggctcaggggggtaaggatcatgtgccactagtggtaacaggccttcacaatcttaatgaaagtactcagctcgtagaacctaagaccatgtattttatttctaatgtcaaaggtatggcagagtggctcagagcagagttctggagtcagcaggaccaggtagaatcatgccctgcctcttactggtggattcccacttaccttatctgtaaactgggggactgtgaggatgaagcaaggcagcatactcaaagcacttagcacaatgccagggaaagatctggactcagtaaatggtagctatagctatttctgatccaagcaaagccagagacctggcgggggaggacacagggtgccttgaagccatcttggagccccatttcctggggtggagtatagctgaacttgagtgtctctaagccaagctggacagctgtattgcaagaatgcatgcagctgctccagccaacaagccaaatgttcctcagctgcggcccagccaacgaaagaagggatgatggaactgaggaggaagaccaagtcaagggaagcagagacatctcttttactgttctacacagagaaagggaatgacgtgggtaagttagaggctatacaggtgtctggacagccccctggccctgggggagctgtaagggcagcaggtaccgtgggaaggagacccctcctgctgtcccaggacctaggcactggtgcctctggagcaagccgtactcaactcagttctcccagccctgggaaatggacatgcaaagttttgacaacaaccagggaatgagagaagtcaatattgaagatgagacctcctgagattcttgggcactccagctctgtccactaggggcagtttccttagctctaaggcagatggcaagggatggagatgattcccctaggccagcctgattcactgctgtgaaatggtgcagatcccaagaacaattcattgctaggcaggaggtcccaaacagcctttccccatccacccaacagctccctttctacctctcagcaaattgcactaaggacttttacaactgacttgattgacagagaaattgacatgaaaaagggagcagtgggagattcagggggagggaagagaggtacacagggtgaccatcttagttcatttgtgcttggaatacccaaggctaggtgatttatgaagaaaataggtttttttagctcaggcttatgctggctggaagtttgggcatctggtgagagcttcaggctgcttccactcatggtggaaggcgctggggagctggcatgtgcagagatcacatggagagagaggaaacaagaaaatggggaggtgccaggcttttatttaacagccagcccttgcggcaagtaatagagggagaacttactcgctccccaccctctcaccagagagagcattgatctattcatgagggatccgttcccatgacccaaacacctcccattaagccccatctccaacactggggatcacatttcatgaggtttgcaggggctcaaccatccaaactatagcaatgacctcactctgcttcttctaggctcagtgtacaagaagtaccctcaaggaaggggcttgagaaggactagctcttctattgacttacccagaaaggatacagtttgctcaagccaagaggtattaagtcacccatactagcacatgcccattaagcaatagagtagttctgtccaccaaccattacttctaggatgggggggcataatcagaaatgagaacaagccaggcacagtgactcacacctgtaatcccagcactttgggaggctgaggtgggtggatcacttgaggtcaggagttcgagaccacctggccaacatggtgaaaccccatctctactaaaagtacaaaaattagccaggtgcagtggcacgcacctgtactcccagctacttgggaggctacatcatgagaatcacttgaaactgggaggtggaggttgcagtgagccaagattgtgccgctgcactccagcctgggtgacagagcaagactctgtctcaaaaaaaaaaaaaaaaaggacaaacctgataagaacaattgcttactgtggcagatgggataagggttaaatagacctaaattcaaaatctaggtctgccacttcctgcctgggtgaccttgggcaaatcacctagctatactcaatctcactgcctttgtaaaataaggacaattgtgccagtcaaataagattgatgtgaagattctttaaagtgaaatcaacagaaatcccacttcttgtgcataaggggatagttgtcccacagctattcaataaaagcctgagcatggttctgattgtgccgatggcagatgccatccctggctgctttgagcctgcccattcttgtgtccctcattgtgacaaggagactgagattatcctaattggcttagagtctaagctttagaccaatcagggctttccactcaaatattgtaggtggggtgctcacttcagcagcacatatactaaaaaatgttgtaggtggggttgaaatggatgttagggaagtaacagtgtccactagactagggtctgggaggtgcgcgatagattttgttcttcacccccactatttctttctttctttctttctttttttttttttttgagacagagtttcactcttgttgcccaggctggagtgcagtagcactatcactgcaacctccgcctcctgggttcaaacgattctcctgcctcagcctcccaagtagctgggattacaggcatgcaccaccactcctggctaattttttgtatttagtagagatggggtttcaccatgttggccaggctgttctcaaactcctgacctcaggagtttgagaaccaccgctgtcagcctcccaaagtgctaggattacaggcatgagccaccgcgtccagcctgcacccccatatttcttgtgcatttctcccccaaagccagggaaggaatctgcatgggatggatgctctgtgaggacctgggaatcccacatttcaaacatcatacaggtttcaaacatgaggttctcatagaccagtcagatgatcattcagttgagtctgaattgcctaagataatagttctttcctttattctaaagtgggtggcaaaatatgggctcaaaaaattgaagctggagatttccagatgcatgggtcccaactgcactcatcaaaagtcaggacagaggtcagcatccgccaaacactgcagcatcttccccagcgttgagatccatgtaagtcacaattttcatcatcgtcttttttttctcccccaactcagctgcaaatggcagagagcagtgtagggcactgtggcctctatttctgcttgtaggaactgccctcctccccaaagtgggactcccctcaccaaataggagatgcaaaatcctgttggaagaaaagccaacttcccagagggcctaagatcccattccagggttagatgagctcattggaataagaattataaacaattgccgaggccaggtgcggtgactcctgcctgtaataccaagtgctttaggaggctgaggtgggaggattgcttgagcccaagagtttgagaccagcctgggcaacatagcaagaccccatctctgaaaaaaaattagattagccaggtgcagctgtgtgcctgtagtccgagctacttgggaggctgaggcgggaggattagttgagtcatggagttcaaggctgcagtgagccgtgatcacgccactgcactccagcctgggccatggggcaggagcctgactcttaaaacataaaaaggaaaagataggaaaaatagcaattgctgagaagattgggccgtggctgaagtgttcacccataagaatgctgtaccccaatactgatgatggttctgttatggcagcaaataggggttgtgataggaagtgaagggttctcttttctattttctaattttggggtgattttttattgctttgacactggaacaagtaaatttagtacagaatgaaaatctgatcatttctctccttgccctcttatcctacattgtcaagattaggggaaactaaaaatagccacaaaattcaaaattattcactagaggaatatagggtcattctagcatgttgcccctctccacctgaagtcatctttcagttcaaaatttatgaacttcttaccccaccatttagagttttctattttaaaatttagagattattggccagacgcagtggctcatgcctgtagtcccagaactttgggaggccaaggcgggcggatcacctgaggtcaggagttcgagaccaccctggccaacacagtgaaaccccgtctctactgtaaatacaaaaattagccaggcatggtgctgtgcacctgtaatcccagctactcaggaggctgaggcaggaaaatcgcttgaacccgggaggcagaggctgaagtgagccgagatcgcaccactgcactacacagcctgggcaaccgactgagactctgtctcaaaaaaaaaaaaaaatcagaaattattatgatttttattaatatagcaactgcatttaccaaaaaaaaaatcttaattccctactcctttgtagaaccataaatccactagtttaatagaagaaaaaaaggctttaaacaaaaaaaaaaaatacacttaacagatggttgttttttgtgggtttttgtttgtttgttgagacaggatcttgctctgtcatccaggcaggagtgcagtggtgcaatcacagctcactgcagcctctacctccctgggctcaggcaatcctcccacctcagcctcccccaagcagctgggaccacagacacatgccaccacaccagctaaattttctgtttttggtagagatgaggtctccctatgttacccaggctggtcttgatctcttgggctcaagcgatcctcctgcctcggcctcccaaagcgctgggattacaggcatgagccaccgtgcccagccaacaaatattttgagaattgttaaccacaatggaataaacaattttagggggtgatggggatatgaagaaatgactgatggggtgggtgcttgcctctgcttgccttaacccagggagtggtgagacacatccagtggacgcccagggagatggaggtgtacatcaggcacttggagaaggtgttaaggcgctatgtccagaggctgcagtggctgctgtccggtgagcctgcccactgccctgaagggtggaggagcatgaggggatgtagaaggctagccccagggaccccagtgtcagtccttccaaagccaggccttcaagaactgcagatcagaggattaggccaggaacatcatccacatacaacatgacactgggaggccgggcgtggtggctcatgcctgtaatctctgcactttgggaggccaaggtgggtggatcaccagtcagtagttcgaaaccagcctggccaacatgatgaaacccgtctctactaaaaatacaaaaaattagccaggcatggtggcgggcacctgtaatcccagctactcaggaggctgaggcaggaaaatcgcagaggttgcagtgagctgagatcgcgccactgcactccatcctgggcaacaagagtgaaactctatccaaaaaaaaaaaaaatgacagtgggttcagaggacaggcaaggggctggataacagggaggtggaacatgggccaaagagccccagcgggagctcacacgcatcccagcctgctctgcaaggccacctgccacaccttgccttcctgcaagtgacaaggggctcactgtcaaaaggtttgctttaatattgactgcgccccagcaaaacagcccctggagatgcagatggtaaggggaactgacagagcagaaaccctctgttttgttttgttttagaaacagggtctttctctgtcacctagtctggagtccagtggtgcagtcatggcttactgcagccttgaactgggcacaagcaatcctcccacctcaaccttgcaaggacctgagactacaggcacgtgccaccatgcccagcttactttatttattttttttagatacagagtctttctatgttgcacaggctggccccgaactcctaggctcaagctatcctcctgcctcagcctcccaaagtcctggggttataggtgtgagctactgtgtacctctttacagagagcaccaagtcccctccaggagaggtgaatggacagggttgggctgtggattaagagacggtctggaagcatcaagcccaagaagacaggcagacagctagaactggacaggaggggattcgggctatggggcctggagggtttctggggcatcaggaggagggaggaagggagtcctatatagagatcctacaggtggctttgtacgtgccactcagggtcctgtgtaaattcattaggtccagtcctctgcagtaggacctggtatagacagtccatggacaggggcgtcatgatgactgctgcttcaggtacagttgtcaggtcagaggctgagctgggacagagaaggcgtgagcctctctccaccctcggttcacattacccctgggaacggtgacataaaaccagagatccagcgatttcttttgtagtatgaatcccccagctcacataccagtacacacccaaacaccatctaatattttaaaacaatgtcatggtactatttaatccaatcacttaactttaaggataaggaaattcaagcccaggaggttataaccgcttgtgcaactcatcacagacaaagccagagctgaaatctcgatctcccaaagcccaaaccactgaccaggtctgtccttggacaatcgacccctcccacagcaccacaaaagccgtctctcagtggggtgacatccaatcaatgatcaggcaggcaacaggtgtcacaagactttatacttgatagatagagtgagggaaaccacccaggaggagggacccctcactccctccctgcctcttccccacctgtctcggagcagggagccgccgactgtttggcaccgttttggagagcaaagtatgcatattgctggacacgtcagggtccatgggcccctacctgcagcaggtgaagacagagctggttttgctgatttgggaacagctgcggaagtgctgtgacaggtaggaggcgagggctgatcaggaagatcaaaggggcagttcctggggcttccctggccaagcacgccccctcttctcagtgccaacaggcctggagtttctgagatgctcttctgagtaacgcgtttgagtaggaaagagcactgtattctgctctgctgtgaaggaaatcagtttttagaggccgggtatggtggctcatacctgtaatcccagcaattttgggggccaaggcaggaggatcacttgagctcaggaattcaagaccagtctcagcaacaaagtgtcatcccatctcttcaaaacatttaaaaattagctgggtatggtggtgtgcacctgtagccccaactacttgggaggctgagaagggaggatcacttgagcccaggaggttgaggctgcagtgagctatgattgcaccagtgcactcctgcctgggcaacagagtaagaccctgtctcaaaaaaaaaaggaacgcaatttttaaaaattaatttcaggcctagggacaattgcaagcacagcaaaggaactaccatgtggccttgaagtatggctttcagctgaacttgatttgttttaaattatttaatgatttaatttttttaatttttgtgaacttgatttttgagtggaggaagttgtttattttccccatccagaagggttgacccgaaggggaccccaggggactctcatcgtagactaggcctcgttcttgccttaatcagagtatacatttattgagcactttctgtgcaccagatgctttacacgcatcatttcatcaactctcacaatgagcccgtgaggtgttgctgttatcggcccccatttttcagaaaaggaagccaggacttcaagaggttaagacacttgctgaagatcgggtaaccagtcactggctgagataggattgtttgggttgtttgtttgcttgtttgttttgagacggggtctcactctgtctcccaggctggagtgcagtggtgtgatcatagctcgctgcagcctcaacgtcctgggctcaagtgatctcccacctcagcctcccaagtagcttggactacaggcgcacaccaccatgcctggctaattttttaaaaatctttttcgtagagatgggggtctcactatgttgcccaggctggtcttgaactcctggcctcaagcaatcctcccagcttggccttccaaagtactgggattacaggcacaggccactgtgtctggcttgggctgggatttaaatctatttctgtctgcattcaaattgtcagtgtgtaccctctcattctcaagaggccccacagccctctccctgaggggccacagggctcgttgtaggggtcttcagtgacgagcaagaatagtcctcatgagggtaacttatctgaattcaatctagacaggcctgttctaaccaatctctttctccccttctctgcccctcacctcctcttttcctcctccccagttttaacctgctcagctttgcagagagctttcagtcatggcaggacacgctggtggagaccacagatgcagcgtgtcatgaggctatgcaatgggtgacccacctgcaagctcagggcagcacctccatcttgcaagcattgctggcaagtcccaccacggagcccgaccttgacgcaaaacaaataccatcatcccctatgctgatgctgcacgatgctttaggatttacaaagggcgctttataatttacaaagcactacatcatttcatcttcccaacacccgagtgagaaaaggattctcaatgttctcacattatagatgaagacacaggctgggtgcggtggctcacacctgtaatcccagcactttgggagggcaaggcaggtggatcacctgaggtcaggagttcaagaccatcctgaccaacatggtgaaaccccgtctctactaaatacaaaagattagccgggcgtggtggcacatgcctgtaatcccaactacttgggaggatgaagcaggagaattgcttgaacctgggaggcagaggttgcagtgagccgagattgcaccattgcactccagcctgggcaacaagaacgaaactccatctcaaaaaaataaaaattaaaaaaaatagatgaagacacagaggctcagagaggttaagtgacttgcttgggattaaccagctaggcagtgaaccatgctatttctcctaaacctcagcagcttccttagtctgtctgaggctgaaagagaatctcagtctttttgaacaggtcagtggcatccaatcagatgcattttggcagaggcggcagcaggcactacctttaggcatttggttcttgtgttctgggtgagcctctcccctgagcctgacagccttcctgcgttctttcagaaagctttcagtttccatgatctggaaggattgtacctcctgaccgacggaaagccagacacaagctgcagccttgtcctaaatgaagtccaaaaactcagggagaaaagagatgtgaaagtgcacaccatttccttgaactgctcagacaggtgcgcaatatggagtctgactgagttttattctttttccacagccacacatctcagcagggagatccaagcccctcacctaatctagctgctcacttagacacgggtttctcctgggccctaatcctgtaaatcagaaattaggagaagcggccgggcatgctggctcacgcctgtaatcccagcattttgggaggttgaggcaggtggatcacttgaggtcaggagttcaagaccagtctggccaacatggtgaaaccctgtctctactaaaaatacaaaaattagacaggtgtggtggtaggcgcctgtaatcccagctactcaggagactgagacgtgagaatcacttgatccagggaggcagaggttgcagtcagcggaggttgcaccatggcactctagcctgggcaacagagtgagactgtcaaaaaaaaaaaaaaagaaagaaaagaaagaagttaggagaagcattgtttttctagacggcccaagccggtgtcacaccacagggtgaaaacccctctctttacccagatatttccctctgacttcctccagcctggaaacacatttgcaagggattcacacagtcattttacagtctccctcctactcttccctgggatcacatttgtgaatatttaggggacatttaggggaaaagccagagagaaaaatattaatgtagcattgtcatggttatttttttttataaacgatcactatagaccatgtgctatgaccgggcacaatggctcatgcctataatcccagtgctttgggagactgaggtgggaggatcacttgaggccaggagttcgagaccagcctggatatcatagcaagattccatctctacaaaacaaaataaaaatgtgaaaaagaacacatgtcagataagacatactcagctccttcaaaaaaaaaaaaactttattattagcaaaacagactgcatagggacacattttatctcttggtctaaaccatgagccccataagtgtaatatgtgtgtcctttacaggcctaacacatagtaggcactggataaatgtcccataaataaatgggggctaggctgagcacgacggctcatgactgtaatcccagcactttgggaggccaaggcaggcagatcacctgaggtcaggagttcgagaccagcctggccaacatggcgaaaccccgtctcaactaaaaacatacaaaaatgagccgggcgtggtggcaggtgcctgtagtcccagctactcaggaggctgaggcaggggaatcgcttgaacctgggaggctgaggttgcagtgagccaagattgtgccactgcactccagcctgggtgacagactgagactctgtctcagaaaagaaaagaaatgggggctggagtgtgtgggctgtgtggtttcagggggtccaggctaaatggtgacactcacacggggactcctcttccctcaagcagcagcagttgctatagctgtccagaagctggtggggaaagtgtcctctaatggtggtctccatgggacaagccacggcccattgccaggctgatttctcttaagccccacggacttaagttccccatggacgtggggagtcacacgaacttgcctggtcagtcagccttcccaccagccctctgtcccttccttccagagcggcggttgagttcctgagaaagctggcttccttcaccggcggacgctatcactgccctgtgggtgaggacacactctccaaaattcacagcctgctgaccaaaggcttcatcaatgaaaaggtaggttgcagagccactgagcatgaggtctgttgaaacggctcgataaaatatcaacaggcatggggttttccttcttgaactcctgggctcaagtgaacctcccacctcggcctcccaaaatgttgggattacaggcatgagccaccacgcccatcctgggttttccttctgacgaaaaagatctctgcttttcgttgagacaaaatattagctgaaaaggattgggtttccctgctgctgtccttttaggctgactctcctcaaggctgggaaagaagcaggatttgagggtgttatatttcctgatggtcaggccagtttgcctttgttggaaatttatgtggctttatgtagataacctcttttaatattatacccatttaacaggtgaacgagagggccagcaaggtttaagaatacacctaaagctgggcacggtggttcacacctgtaatcccatcactttgggaggccgaggtgggtggatcacttgaggtcaggagtttgagaccagcctggccaacatggtgaaatgacgtctgtactaaaaatacaaaaattagccaggcatggtggcatgcacgtgtaatcccagttactcgggaggctgaggcagaattgcttaagcctgggagacccaggttgcagtcagccgagattgcgccactgcacttcagcctgagtgtcagagcaagactccgtctcaaaacaaacaaacaacaacaataaaaactagtcagaggaagtggtatagctagagccccaagacacccatgatcttaaactttgtgctttaattcctgcatatttgtgtcttctggggttcaattcattgaaatacagacattcaagttatctgttaagcaatagatctggcaaagtcataggttatctattaagtaataagtctagtaaagtcatagatttcaatgatccacttctgacttaataggaaaattctgcacttatttataccttttaggaatgcaatgttgtcagtgataacattcccagcgcaacaaattatcaagtaagacaaccaatcagaattccagatttcttttcagaggttaaaggttactttcacaggacatggcataatttttttttttttttttttgagacagggtctcattctgttgcccaggctagagtgcagaggaacaatcacagctcaccacagcctccacctcctgggctcaggcaatctttccacctcagcctgcagagtagctgggatcacaggtgtgccaccacgcccagctaatttctttaattttttgtagaaacaggatctcaccatgttgcccaggctgatctcaaactcctaggattaagtaatcctcccgcctgagcttcccaaagtgttgggattacaggtgtgaaccgtcaggctcggctggcataatctttgaagcctgggtagccttacatgactcctttggttcaactagctcttctagggacaagtattataaataatacagagaactgaacaaattggtaaaagtaatgaatattcacccaagcgtccttattacacaggaaaacaagtgatgatatgtttaaggctctcagcttaattccttatccaatcagattctctgaattgtttttgcatgcagaatgggattgctgtgctactactgccaggcagaagggatggcttcctcttttttctttttcttttttttttttttttttttttttgagatgaagtcttgctgtgtcaccaggctggagtgcagtggcatgatctcagctcacttcagcctctgcctcctgggttcaagtgattctcatgtctcagcctcccgagtagctaggattacaggtgcctgccaccacacccagctaatttttatatttttagtagagatgaggtttcatcatgttggccaggctggtctcaaactcctgacttcaagtgatccacccgcctcagccacccaaagcgctgggattggtaagatgtatttttaaggataggtggcgaaattttattagttaacattttttttaaaaagcatgcctcagccgggcgcggtggctcacgcctgtaatcccagcactttgggacgccgaggcgggtggatcatgaggtcaggagatcgagaccatcctggctaacaaggtgaaaccccgtctctactaaaaatacaaaaaattagccgggcgcggtggcgggcgcctgtagtcccagctgctcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaagcatgcctcagccaggtgtggtggcacatgcctgtggtcctagctacttgggaggctgaagtgggaggatagcttgagcccaggaggtcgaggctacagtgagccgtgatcacgccactgccctgcagccaggacaacagagcaaggctctgtctctaaaatcaaccaaataaaaagcatacctgtaagtctacttcactagaagaaatgcaaaaaatggctgaacagattctactgaatagcgctgagataaggaaacggtgtcatttctgttccactggaccagagtggggccactttcactcagattctgacaccatcgtactttgccaccgtcccctccctacactgactctcagacaccatatttcaaagtttcccctttgcagaatgactgtcttgataggtagtgagcttcctgaccctggagatatacaagcagaggctcacaagatttcctgcactggatggaaaccagaacgtgattagctctaaaatgcttttcctgagattttggattttcagctcccatccagtcataaacttcacactcatttcctcttttcaaggatcccacattgccaccatttgaaggagatgatttaaggatcctggcccaggagatcaccaaggccagaagcttcctctggcaggcccaatccttcaggtatgcccttcacgcagcctctccggcctgccatgtggctacagcccatgcagaccccggaccccatcgagaagggccgcacccatgatggtacccttgctccaagggttcctgccctgcttctcccagccagcccagaaatctgggcaccagggagaccatctttcttcatctcctgcccaccagatcccaactccagaagaaaaatgatgcagaaccaaaggtcactctttcctagagaagtgttctcaggtaaggggaggggctagaccccatactacctgagtgtgcactaagcaccaagtggcatgctctattttgtggtcaataataactttggttaaaaaataatgattcctctaaacagaaaagtcatcctgcaaaggaccactcactgagcaaatctcagccccgagggcaggatgggatgaaatgctgtgacctgcaggaaacatgattcctggtaccaggactctctggaagctgaggaaggaaagactttgtcttttgtgtgaggggccattcccgggtcttaatctaactctccagccctgtcccgcagcgcactctactctccagccactagattgtccctctctgggaagccctaaaccaaccccctgcctaaatggtggtgcttcttgcaaaccaaccccctgcctgaacggtgcttcttgccccctctgcctggagactcctgctcatccatcaaggcacagctcaaatgacatcagctccctgggacctatctagagcgaggggcctccagtctttctcttgcagcatcctgaccacgcagacctctcgcactcagcactctatgtcacgccaccttgctcgctgatctaactcttctccttgatggtgagctccttcgggatgagactggtgtcccaggatctgcaggtccccagaagctgccacataggagacacatggtgaacagtgagcaggcggctgagctgtgagagcctagctctggaaagcagctgatggggtggtctccaccctggttcataagaggctaatgcagagtcacagtcagcccatcctgggggaagaagaaacaagtgagcctcagcaccaccctccatccctgcccaaccaaactgaagtgaaggctgctcatctgggttcattttctaaaattaaaaacaattaattttattctactaataggatcaacatgactttaactgtttgaagtgatcattggcgtgtgtgtgtgtgcataaatttttagtgacataaaactttattaaaagactcataccataataaagaatttcaataagaaaaaga

SEQ ID NO: 1460 - DNA, 4058 bp, Homo sapiens
cataaaaccagctgagtatttgtgccaggaagactgcgtgcagaaggtgactgtctcagtggagctgggtcatctcaggtggggagttggggtccccgaaggtgaggaccctctggggaggagggtgcttctctgagacactttcttttcctcacacctgttcctcgccagcaggccttggctccttgaacttttggccgccatgtgcttcccgaaggtgagtgagaggctgcgtgtgcttttgtgggcatgtctgaaaacagaccgtaagggtgcgggtgccctcagtatttcccgaggtgcctgtgtgtcagggctcagtcaggggcacccagcggcaggaggatagtgatggggtgagagtgtcagtggaggcgctggaggtcatatgtgtcgggggcgctggagaacggcaggggtgtggatgagagggagcacctgtcccaggagcccttcacagcccggaaagcccggggcaggggtggggcagggctctgctggaaacgactcggagaatgcttctctcagaggccggctcagctgggtgggcccaagagcaaggcctgtgtgggtcctggtgtctcttcctcctttcctgggttccctccgacctcccatcctctaccactgccccaccgcaaatgctaggcccaccacaccctccagggagctcttcggcctgtgacaataggggtttccatgatgtggcctggctcaggttcaggacagtgacccggaggacacatggctcccgcatgtcggcacggtgctgctttcaccctggttcctgggaaatcaggctagcgggatgggaccatcgctgcctgaaagtgtgcagacagctgccctgcccagaatatgtccccaggccctgcgcactctgtgggtgactgtcaccactctatagtgggggaaaccaggcatgtcacccccgagactaggcccttgacgtgggggctcagcggggattctgtggggtgcctctggcctctgtggatgcagccacgtgtctgcaggcaggaatggcccgggacctgtgggtctgcatgttggcagtcgggaagagtggcaggttgtagggtggacctacctggcaccccaaatattaatcagctcatcagagaggaatggctgctgttaccttctcaattgtcatgtccctaaacattttttccttggccaactctcacctgggaccatagtggttgtgggaaacccagctgagccagcctgctccaggacagtgtccatcctcccgtgtgtgtacatgggggggtgtgtgtgtgcagggaggacaccccggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccatgctggccctgctcttgggcctgcccagctgagccggctcctgagagaagcgctttctgagtcgtttcgaggacagccctggccggtctttccaggctgtgaggggctcctgggactgctgtctcctcttatcctgtacctctgccatgtgtctctgtgtgtgtgtgtgtgtgtgtgtgtgtgtgtgtgtgtgtataaattatcctggaggaaaggttaaggtgacacatggagactgagtgtcaccgttatttccgcaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgggtggatttcccctcaggcaccaggtcacatgtccccgcccccaggcactccaccctgtgtggggctcagggtgagaaggatgaagagggacccacaggctccctcaccccttaccgtgggcaaatgcttgcacctgggtggcagtgagtgggcgggtgggggatctggacgcccggggagactgagggaggcatccaagccccagggctccttgaggaaacaacaggggtgccagacgtggcccgggcccctggctgggcccagttcggggtgtgtgggagctgaggactcactgggcttgaggactgactgatgtggggtgcagaggaggcttgggcctggaaccgagtgctttgttcctaacaggtgatgtcgagcctggcagagctggaggtgagccgtggcctccccctccaccaagcttagtccctgggtcttaggctccacaggacactgggtctgggccccgggtccccttgggaatcacctggaccagtgggggccacagtgggaagggggcaggcaggagcagcatgaaccccctgtgccctcctctccccaggacgacttcaaagagggctacctggagacagtggcggcttattatgaggagcagcacccagtgagtatgacacacccatctgggcaccttgccttccttcacctctgccctgtcttttctttctttctttctttttgtttatttgagacagagtctcgctctgtcgcccaggctggagtgcagtggcatgatcttggctcactgcaacctccaaatctcgggtttaagtgattctcctgcctcagcctgacaagtagttgggactacaggcacccgccaccactccaggctgattttttttgtgtgtgtttttagtagagaccaggtttcaccatgtttgccaggctggtcttgaactcctaaccttgtgttccgtctgccttggcctcccaaagtgctgagattacaggcatgagccaccgggcccagccaacccctgccctgtcttgatgtggtgtgggcagggtgtgcccagcccctgagcttggggtggagggctgggagtgacagcctagctgggacctgcccatggcctcactcctcacacagtggcacagccctcaaggcacgatgagggccctgacctggtgaccaagcagacacacccatcctgtcactgccatggaggtgaatgcagaggagggggactctgggaaaagtccctcttgcccacggggctgtggttgggaaaccaacacctgtgggcctccgtctcccagggtcaggaaaaggctgagaggcctgggtgtggccagggcctggggctgacacccccacctacagaccctgaatggtgctcccattccacaggagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactga

SEQ ID NO: 1461 - DNA, 4357 bp, Homo sapiens
tccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtatttgtgccaggaagactgcgtgcagaaggtgactgtctcagtggagctgggtcatctcaggtggggagttggggtccccgaaggtgaggaccctctggggaggagggtgcttctctgagacactttcttttcctcacacctgttcctcgccagcaggccttggctccttgaacttttggccgccatgtgcttcccgaaggtgagtgagaggctgcgtgtgcttttgtgggcatgtctgaaaacagaccgtaagggtgcgggtgccctcagtatttcccgaggtgcctgtgtgtcagggctcagtcaggggcacccagcggcaggaggatagtgatggggtgagagtgtcagtggaggcgctggaggtcatatgtgtcgggggcgctggagaacggcaggggtgtggatgagagggagcacctgtcccaggagcccttcacagcccggaaagcccggggcaggggtggggcagggctctgctggaaacgactcggagaatgcttctctcagaggccggctcagctgggtgggcccaagagcaaggcctgtgtgggtcctggtgtctcttcctcctttcctgggttccctccgacctcccatcctctaccactgccccaccgcaaatgctaggcccaccacaccctccagggagctcttcggcctgtgacaataggggtttccatgatgtggcctggctcaggttcaggacagtgacccggaggacacatggctcccgcatgtcggcacggtgctgctttcaccctggttcctgggaaatcaggctagcgggatgggaccatcgctgcctgaaagtgtgcagacagctgccctgcccagaatatgtccccaggccctgcgcactctgtgggtgactgtcaccactctatagtgggggaaaccaggcatgtcacccccgagactaggcccttgacgtgggggctcagcggggattctgtggggtgcctctggcctctgtggatgcagccacgtgtctgcaggcaggaatggcccgggacctgtgggtctgcatgttggcagtcgggaagagtggcaggttgtagggtggacctacctggcaccccaaatattaatcagctcatcagagaggaatggctgctgttaccttctcaattgtcatgtccctaaacattttttccttggccaactctcacctgggaccatagtggttgtgggaaacccagctgagccagcctgctccaggacagtgtccatcctcccgtgtgtgtacatgggggggtgtgtgtgtgcagggaggacaccccggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccatgctggccctgctcttgggcctgcccagctgagccggctcctgagagaagcgctttctgagtcgtttcgaggacagccctggccggtctttccaggctgtgaggggctcctgggactgctgtctcctcttatcctgtacctctgccatgtgtctctgtgtgtgtgtgtgtgtgtgtgtgtgtgtgtgtgtgtgtataaattatcctggaggaaaggttaaggtgacacatggagactgagtgtcaccgttatttccgcaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgggtggatttcccctcaggcaccaggtcacatgtccccgcccccaggcactccaccctgtgtggggctcagggtgagaaggatgaagagggacccacaggctccctcaccccttaccgtgggcaaatgcttgcacctgggtggcagtgagtgggcgggtgggggatctggacgcccggggagactgagggaggcatccaagccccagggctccttgaggaaacaacaggggtgccagacgtggcccgggcccctggctgggcccagttcggggtgtgtgggagctgaggactcactgggcttgaggactgactgatgtggggtgcagaggaggcttgggcctggaaccgagtgctttgttcctaacaggtgatgtcgagcctggcagagctggaggtgagccgtggcctccccctccaccaagcttagtccctgggtcttaggctccacaggacactgggtctgggccccgggtccccttgggaatcacctggaccagtgggggccacagtgggaagggggcaggcaggagcagcatgaaccccctgtgccctcctctccccaggacgacttcaaagagggctacctggagacagtggcggcttattatgaggagcagcacccagtgagtatgacacacccatctgggcaccttgccttccttcacctctgccctgtcttttctttctttctttctttttgtttatttgagacagagtctcgctctgtcgcccaggctggagtgcagtggcatgatcttggctcactgcaacctccaaatctcgggtttaagtgattctcctgcctcagcctgacaagtagttgggactacaggcacccgccaccactccaggctgattttttttgtgtgtgtttttagtagagaccaggtttcaccatgtttgccaggctggtcttgaactcctaaccttgtgttccgtctgccttggcctcccaaagtgctgagattacaggcatgagccaccgggcccagccaacccctgccctgtcttgatgtggtgtgggcagggtgtgcccagcccctgagcttggggtggagggctgggagtgacagcctagctgggacctgcccatggcctcactcctcacacagtggcacagccctcaaggcacgatgagggccctgacctggtgaccaagcagacacacccatcctgtcactgccatggaggtgaatgcagaggagggggactctgggaaaagtccctcttgcccacggggctgtggttgggaaaccaacacctgtgggcctccgtctcccagggtcaggaaaaggctgagaggcctgggtgtggccagggcctggggctgacacccccacctacagaccctgaatggtgctcccattccacaggagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactga

SEQ ID NO: 1462 - DNA, 3885 bp, Homo sapiens
ggccttggctccttgaacttttggccgccatgtgcttcccgaaggtgagtgagaggctgcgtgtgcttttgtgggcatgtctgaaaacagaccgtaagggtgcgggtgccctcagtatttcccgaggtgcctgtgtgtcagggctcagtcaggggcacccagcggcaggaggatagtgatggggtgagagtgtcagtggaggcgctggaggtcatatgtgtcgggggcgctggagaacggcaggggtgtggatgagagggagcacctgtcccaggagcccttcacagcccggaaagcccggggcaggggtggggcagggctctgctggaaacgactcggagaatgcttctctcagaggccggctcagctgggtgggcccaagagcaaggcctgtgtgggtcctggtgtctcttcctcctttcctgggttccctccgacctcccatcctctaccactgccccaccgcaaatgctaggcccaccacaccctccagggagctcttcggcctgtgacaataggggtttccatgatgtggcctggctcaggttcaggacagtgacccggaggacacatggctcccgcatgtcggcacggtgctgctttcaccctggttcctgggaaatcaggctagcgggatgggaccatcgctgcctgaaagtgtgcagacagctgccctgcccagaatatgtccccaggccctgcgcactctgtgggtgactgtcaccactctatagtgggggaaaccaggcatgtcacccccgagactaggcccttgacgtgggggctcagcggggattctgtggggtgcctctggcctctgtggatgcagccacgtgtctgcaggcaggaatggcccgggacctgtgggtctgcatgttggcagtcgggaagagtggcaggttgtagggtggacctacctggcaccccaaatattaatcagctcatcagagaggaatggctgctgttaccttctcaattgtcatgtccctaaacattttttccttggccaactctcacctgggaccatagtggttgtgggaaacccagctgagccagcctgctccaggacagtgtccatcctcccgtgtgtgtacatgggggggtgtgtgtgtgcagggaggacaccccggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccatgctggccctgctcttgggcctgcccagctgagccggctcctgagagaagcgctttctgagtcgtttcgaggacagccctggccggtctttccaggctgtgaggggctcctgggactgctgtctcctcttatcctgtacctctgccatgtgtctctgtgtgtgtgtgtgtgtgtgtgtgtgtgtgtgtgtgtgtataaattatcctggaggaaaggttaaggtgacacatggagactgagtgtcaccgttatttccgcaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgggtggatttcccctcaggcaccaggtcacatgtccccgcccccaggcactccaccctgtgtggggctcagggtgagaaggatgaagagggacccacaggctccctcaccccttaccgtgggcaaatgcttgcacctgggtggcagtgagtgggcgggtgggggatctggacgcccggggagactgagggaggcatccaagccccagggctccttgaggaaacaacaggggtgccagacgtggcccgggcccctggctgggcccagttcggggtgtgtgggagctgaggactcactgggcttgaggactgactgatgtggggtgcagaggaggcttgggcctggaaccgagtgctttgttcctaacaggtgatgtcgagcctggcagagctggaggtgagccgtggcctccccctccaccaagcttagtccctgggtcttaggctccacaggacactgggtctgggccccgggtccccttgggaatcacctggaccagtgggggccacagtgggaagggggcaggcaggagcagcatgaaccccctgtgccctcctctccccaggacgacttcaaagagggctacctggagacagtggcggcttattatgaggagcagcacccagtgagtatgacacacccatctgggcaccttgccttccttcacctctgccctgtcttttctttctttctttctttttgtttatttgagacagagtctcgctctgtcgcccaggctggagtgcagtggcatgatcttggctcactgcaacctccaaatctcgggtttaagtgattctcctgcctcagcctgacaagtagttgggactacaggcacccgccaccactccaggctgattttttttgtgtgtgtttttagtagagaccaggtttcaccatgtttgccaggctggtcttgaactcctaaccttgtgttccgtctgccttggcctcccaaagtgctgagattacaggcatgagccaccgggcccagccaacccctgccctgtcttgatgtggtgtgggcagggtgtgcccagcccctgagcttggggtggagggctgggagtgacagcctagctgggacctgcccatggcctcactcctcacacagtggcacagccctcaaggcacgatgagggccctgacctggtgaccaagcagacacacccatcctgtcactgccatggaggtgaatgcagaggagggggactctgggaaaagtccctcttgcccacggggctgtggttgggaaaccaacacctgtgggcctccgtctcccagggtcaggaaaaggctgagaggcctgggtgtggccagggcctggggctgacacccccacctacagaccctgaatggtgctcccattccacaggagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactga

SEQ ID NO: 1463 - DNA, 14044 bp, Homo sapiens
ggattcccgggcccacccgacccagcggcgcgaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggtgagcgcggggtccgcaggctcctggggtctgcagagagattgggagagggaagccgggcccggactcctgggtccggaggaggcaggggccagattccaatatccaaagagtgactgaggatggggtctgtgctcccggcttcttgggtctgtcgggaagtttggggctgggatttggagctctggaaaggagctgaggtgcggagctgaagtccagacaagactggcaaacccgggactgaagcggggacctatggaggggagcaggcaggcatccggggctggggccctgggctctgggtgcctgggaggggcagggctgccaggatggtggtgggcagagagagcccatacttttcacccagcccgcttcacctgccccctccgatgccctaggactggctgactcgctatggttacctgccgccaccccaccctgcccaggcccagctgcagagccctgagaagttgcgcgatgccatcaaagtcatgcagaggttcgcggggctgccggagaccggccgcatgggtaggtggcccccacccctccccagccctgcctctgcacccagcctgtccaccgcccaacagcctttagacctcagtgtgctcctggaacacggagctgtgaagatgctgatctcaggccccaaacccagagggcctcaggcgttcatctttccataagcatttatcaagaacctggtggctcatgccggtaatcccagggttttgggaggcggagactcaaggattgcttcaggccaggagtttgagaccagcttggccaacaaagtgagacccccccactctccaaggattttttttttttttttttgagacggagtatccctctttttgcccaggctggagtgcaatggtaccatctcggctcaccgcaacctctgcctcccaggttcaagtgattctcctgcctcagcctcctgagtagctgggattacaggcacgcaccatcacaccaggctaattttgtatttttagtagagacggggtttctccatgctgatcaggctggtttcgaactcctggcctcaggtaacccgccggccttggcctcccaaagtcctgggattacaggtgtgagccaccgtgcccagtcctctaaggatttttttaaatttagctgagtgtagtggcataggcctgtggtcccagctactcagaacgctgagatgggaaaattgcttaagcccagaagttcaaggctgcagtgagctatgattgcaccgttgcactccaacctgggcaacagatggagacccagtctctaaccaaatatactttgagcatctcttagatgccacgccctttcagctccaatggtatagtgataaataaagtaggtaaggttcctgctctcatggagctaactttctcgagggagagagagagagacagatcaagaacataaatatgaaagataatttcagatggcggtgagtgtttagaaaaaaataaaatgctattggcattgaggggctggtctggttagggcaggtccctctgaaaagtgtcatatgagctgagaccacaaagaggaggaaccagccatgggaagatgtggaagaagagtgtcccgggcaagtgcaaagaccccacggcacgcagaagcttgtgtgcctggagcaaaaggagcattgaagagctctggcgagaggcctcagccaagggccctgaaaggtgattagggttgattccaagggtgattagcaaccacctaagtgttctcagaagggaagcaattcagaacttggtatgacttgcaatttttttttttttttttttagacagagtctcactctgtggcccaggctgcagtacagtggcgcaatctcggctcattgcaatctctgcctcccgggttcaagtgattctcctgcctcagcctcctgagtagctgggactacaggcatccgccaccatgcccagctaatttttttgtatgtttagtagagacagggttttgccatgttggccaagcaggtctcgaactcttagcctcaagcgatcagcccaccttggcctcccacagtgctgggattacaggcatgagccaccgtgcccggctttgacttgcagttttaagcttcctctgggtcctgatggagaatggaaggcaggagccctgagaccaggcagaagacggctgcggagtccacacgagggatggtggcagaaggatgggtggcatatgtggccagaagtagttggattcggggtgtatattttggaggcagggccgaggaactcttctgtggggttaagtgggcaggaagagggaatttgaaggatctggctcactacaaggaaaggtaggccctgtgtctgtcctggtgactcacaaacagcctagaacagtgtctggcatctatatgtccttcatcactatttgccgcctcaataaatgaggcgcagtttgaccttaatttggagatgaggctactggggatggagcccagctgggaaaggggaccccagagagacctaacccaggagggggtggcttgccacaggaggccagagacccagccggcctgggcactttggacctaatctgggtttgaggagaacttggcagtgatggtgtgaggcctgcacagctcccagggggttccagcctcaaagggtcctcactgcatacccagggctcctttctccagagtccgcccaccagggcccagggaagctggatgcaaaatcctggcctgagcctctgagcatcacctgcatgcagccagtttgtcccaggccaggtgacgccactccaaagggcagtaggaatggcttggtaggagctggcttccagagacagactgcctgggttcaaacctgggctgtggggccttcgagggcacatttcttgagccctctgagcctcagttttcccatgtagaaagttgactggtgctatgattaaggcaggctctcctattgtggacacaccccccaccgccaaatgtctcccgcagacccagggacagtggccaccatgcgtaagccccgctgctccctgcctgacgtgctgggggtggcggggctggtcaggcggcgtcgccggtacgctctgagcggcagcgtgtggaagaagcgaaccctgacatggaggtaggtcctggggcccacccgcaccctggccctgcctgctgggctccggctttgaatggctgcctgctccctccacggccacccttacacctcactcccctctccccagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaaggtaaaatctcctctcttatgagagatcctcttgccaggtctggtcttaagaataagttttctgttgtgtgttttgttttgtttaagaaacaaggtcttgctctgttgctcaggctagagtgcagtggtgcaatcatagctaactgcaaccacgaacttctggctcaagcaatcctcccacctcagactccagagtagctgggatcactggtgcacaccaccatacctggctattttttttgtttgttttttttactttttgtagaaacagggtctcattatcttgctcaggctggagtgcagttgcacgatcacggctcactgcagccttcacctcctgggctcaagtgatcctccctcctcagccaccacgtagccaggaccacagatgtgcaccaccacacctggctagttttaaaactttttgtagagatggggcttcactatgtcaccagggctggtcttgaactcctgggctcaagtgatcctcccatcttggtctctcaaagcattgggattataagcatgagccaccactcctggccaataattaggtttaaattatatttactgatggaggctttatcagctgggaggtctccagagaaacaaaaccaacaggatgtgtgtgtgtgtgcacgtgtgtgtgggatgtgtgtgtgtgtgtatgtgtgtggggggggtgtgtgtgtgcgtgtgtgtaaagagatttattttaaggaattggctcacgggattgtaggggatagcaagtccaaaatttgtacggcaggctggcaactcaggatttcagtgacagtctggaggcagaattccttcctctccaggaaaccttagctttagctctcaaggccttgaactgattggctctgcccccaccccacccccagccacactatggagcatgatctacttgacttaaggtcaactgattgtagatgttaattgcatctacaaagaccttcaccatggcatctagactggtgtttcaccaaccagctgggcacgacagccgggccaaactgacacacacaatgaaccatcacagaggcctagcaggtgcctagctccaagccagagctgggggcttgcggagacgaaaacaaatctttacctggcagctgagtcagaagagtgactggcaatgacaacacccacggtgacacagctccacagaatcccagcagaggaagtcctcaagcctgcaggggctcagagatgttggcccaaagctcttgggcaaggggaggcttcctagaagaggtgacttcgttccctcaatatatatatgaatataggccgggcgtgattgctttcatctgtaatcctagcacttcgggaagcacaggtgggtggatcacctgaggtcaggagtttgagaccagcctgaccaacatgttgaaaccccgtctctactaaaaatacaaaaaattagccgggtgtggtggtgcaagcctgtaatcccagctactggagaggctgaggcaggagaatcagttgaatcctggaggcagaggttgcagtgagccgagatcgtgccactgcactccagcctgggcaacaagagcaaaactccatctcaaatatatatatatatatatatgaatatccacacatacacactgagtgactactagcacaagacaagacatacagagttccgctctccccaggtacacagggttgagatccaatgggaaagcagtgagccagctgagtcaggggtaagaggagccagtgaccagagaaatgacccgggacatatgaggccagaagccaaaactatggcatcagtagggagactgcagaaggcggcaggtcctggatcaccaaggaccttgaaagcatgtggaagactttgatcaatgggggaatcattaaggggttttgcattccggaactatcatcagcttcagcggggggcagggggtaggatagaggcagggaggcaggaagttctcgcagggtccaggcaagagatggtggagtgtggtcctggggaagggggcagtggacggatctgagggaggttcagttaggatgggcaaggattgagatctggctggatcctggtgacaggggagatgaggctggggcccttggaggatggcgtcctggtgctgttaatgcaggtgtgagagtgggaggaggaggagcaggctggcagaaggcaggcacaagtgcaggtctgggcgggagtctgcagcgctctgggctggccacaccggtggggcaagggaggtggaggatcctgccctagagcttggtctcctctgtctgaggtcaggttccccagaggtggggctccagagggaaattcttgtgcaagcagtttctcaggggccatgtgctgaggggaatggggagcaggaacagcctagaagctgagtgaggatgtggtctcagctggagaggaggctgatcgcatgggagctctgcagcagggatggcaatgccggggaggcggtcccgcctgaggccaggcccagctctttgcagccccatattaactacattggctgctggggagcctgagtgacgggggaagggggcagccagggagggtgcctaggccctgtggagggcttggtaaggcagaggctggggaggctgtgtgcctcaacattcacatatgggcttcggctgggcgtggtggcacatgcttgtagtcccagctactcaggaggctaaggcaggaggattgcttgagtcagggaggttgagactgcaatgagctgtgttcacaccactgcactgcggcctgggtgacaaagtgagaccctgtcacacacacagaaaaagagaatgtgggcttcaaagctgaattcaagtaagtcagggttcttccacttgtaatgaacaacttccttaacctcattgtctcaggttcctcgcctgagaaatgcgaggagaacggcgcctgctggtggcgtgggcttgccgatgaaatgagccattcacccatgcctctcagcacagggcctgccctgggccgcatactgtgcattgtcagctgctgtcggagctgggctagcggccgccttgagagccagcagtccacgggggttggcgagcttctgggaggaaagggtggaacgtgactgtcaggtacagagctacagagaaccccagcatgaaggagtaggtggcaggggagaaggactcaacagagatggagaaagactaagcccaaaggtgatcaacaacaagagtgaaggaggaagtggtcagctgtggctggggcaaaacaagcccagtaagttacattggcctgtgtttggtcatccagggacaaagtgacctttttagtgcctgtaggcccagcgcgttggggaagaatttagaatgcagtggggataggtgtgagaggagcgggggaagtgaagattgagttgagaccactggctggagaacttgaccgggaagggagggcagagagcagcatggggtgaggggagggaatggatccaacgagcgtcttaggatgagggagttgtgagcgctcaacaccattacaaagaagggatcggggattgatagactgacagatgcatgcacagaggcaggtatggatgcatgcacagaggcagggatggatggacggacaaatgcatgcatagaggcaaggatggatggatggacagatgcatgcacagagtcagggatggatgaatggacagatgcatgcacagaggcagggatgaatggacggacagatgcatgcacagaggcagggatggatggacggacagatgcatgcacagaggcggggatggatggacagatgcatgcacagaggtggggatggatggatggacagatgcatacacagaggcagggatgaatggacagatgcatgcacagaggcagggatggatggatggacagatgcatgcacagaggcagggatgaatggacagatgcatgcacagaggcagggatggatggatggacagatgcatgcacagaggcagggatgaatggacagatgcatgcacagaggcagggatggatggacagatgcatgcacagaggcggggatggatggatggacagatgcatgcacagaggcagggatgaatggacagatgcatgcacagaggcagggatggatgtacggacagatgcatgcacagaggtggggatggatggacagatgcatgcacagaggcggggatggatggacagatgcatgcacagaggcagggatggatggatgcacagatgcatgcacagaggcggggatggatggacagatgcatgcacagaggcggggatggatggacggacggatgcatggccagaggcagagatggatgggtgggtagattggacggacagatgatggtaggttgttcttgtcctggaggaggtgatccaggctgagtcctcacactgggcagagcaagaggcaggaggtgagcatggggagatgcagctgtgtgccccagtgcaccggaagttacagatgacatcgatgtcctgtcctgatgaaacaggaaacacatttgtcatttgagagttagtggctggggctgggtggaagcttgaggggctgtgggcctggaatggggctgaggggagcgtgcaggagctgcctgccaaagcctggagcaaggatgacaggaggtgccggggcccctgtggactgccctctgggaatcttgtggggctgggtctgcacagctgtggttgtgtaacttcccccagatgcatggcgtgacaagggtgcaggaaggggtgcagggcccggaagcccagtatggccaaggagagacaaggcagggaagaaggtgagagatgaaagatatcgccctgattgaaacaccaaactacccccagtttctcagaaaaaggactcagagcaacaagagaacctacagtcgacagggaaattcgtcagtgcggatgtgatttgagcaagaccattgaagcccctgctgaaaggcaggctggcagagccagggtacctggccatctaccttgaagtctctgtgcctcagtttcctcctctgtaaaatgggcataggagacaggtttggtgagaagtgaacgaaaacgtgtttgctacccctcttaggtctcacgtttcatgcttagacgctcagcgagtggctttagggaccgagagaaatttgcttttcagttcaccaggtcgttacctatgaacctgccctgaacagtgctgaccttagttagagatggccatgaaactcatccgcatggggtaactggggcctccctgtggtgctgcggggctgtgtctctgtcttggtctcttcaggcctctcagcagctggagcaggagctggcaggcggctcaccggttgatgaggagctgggcttcagccggggctggcgtgtgaatcctctgggtcctggcagtcctgagcgcctgagctgaatacagagggaagaggctgggagcaaggccgggtgctggggccggcaggctgtgttctgagagtgcctgctagaggagctctgtgttcccaaggagatggaggaagacctggggtgggggtggtacagggtagggagaggaggggcagaggctgtgaacagggagatgggggaggggggatggaggactcaagggatgtaagggatatggcttgaggagggatgggggcaggaatgagggaaggtcttgggtcaaggacatggacctacatccccagcagatgggggtggcaagggggagacgggtgggggtcgctgactatagactgtagctgggaggaggggatgctcccagggctggggctgcctgaagagaatggcacgcaccttgtaggctcctgccctcaccccaccgccctcttaagtttcttttattttctttttctttttttttctttttactttttttgagacggggccttattctgtcctccaggctggagtgcaatgacatggtcatgcgtcactgcagcctccacctcccgggctccagcgattctcctgcctccctgcctcagcctgggacctgagtagctgggaccacaggcatgcgccaccactcctggccaatttttaaaatttttttgtagagatggggatctccttatgttgtccaggccagtcttgaactcttgggctcaagcgatcctcccacctgggactccaaaagtgctgggtttacaggcatgagccaccacacccagctcctccccctcaaacttctgtgcacaaagtgctcccttcccagaggaggggccccatcggtgtgtaaggtggcctattcctctgtgtgttctctggatcttttcagccctgtggtccagtgtccatcacagccatgctgactgagtgactggagacagggatgatggagagttcaggaagggctgggcagaggaggctggggccacctctggagggtgtcctgctgttcctgttggccccagctgcactcgcagggccttcctgtggcccctttccccaagcaggggcggccgcagctctcacccactttctcctgcagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatggtagggggagagggacctgccgcgaaaccatcattgccccatccagtgtcctctgcagcagggccaggggacgcacacctgcctgactctttcctcacagggaaggcgccccaaaccccatatgacaagcccacaaggaaacccctggctcctccgccccagcccccggcctcgcccacacacaggtgagtcccccaccaactcggagaccttgggtgaccagctgcccagcctcagtgtcctctgagatggggatggtgggggtccctgccttggagaaaacaaacccccctctctactcacctctcctttcctccccagcccatccttccccatccctgatcgatgtgagggcaattttgacgccatcgccaacatccgaggggaaactttcttcttcaaaggtgagtcatttcacttggcctcatatatgttggtttcctgcccacttccagtgacccactggggctgtgggcttaccctggaagcggaacttttttcttctttgagacagggtcttgctttgttgcctgggccgcagtgcagtggtgtgatcatggctcactgcagcctcaaaatactgggctcaagcgatcctcccacctcagcctccctggtagctgggaccacaggcacatgccaccacgccttgctagtaatttattttattattttgtagagatggagtctcactatattgcccaggctgggctcaatctcctggctcaggtgattctccggtgtcagcctcccaatgtgctggcattacaggtctgagccaccaggcaaggccctggcacttttagcgctaaaaagggaaaagtctcaggcgggccaggatgggctggtcaccctagatccattgcgcccttgatttccagatgggacccctccccacccagccacacaccctgggggaggagacctcctgctgtctcatgccttcctgcgaacccctttgtcccctgcaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcggtgagtggggccggcggcggggcgcgctggggccggcgcggggagcccacccctgacctcccggcctccaccctgcagggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtggggagcgcggtgacctgcgggttactgggcctgggggtggggagagggatgtggggaatggggacatggaggccaccctgcggggatgggggtccttgggcatcagggagcggcggggcggggagggaccgggactcaagctctgctcctccaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgccctccacggccgagtcccccgccgctggacctggtcgggggttgtgaggcgctgcggaggccccttgtctgttcccacggacgggggctcgggcgcggactaagcaggggggatctcccgcgcaggggcggcggcggcggggaccggtcgcctggcgctgggctcagtctcctcagggtctgagaccccggcgctgccaccggaacccgccttcaggggcgcacgcgcgctgggaccatgcgtcggtcgtcgcccccgtcgttccctcccggctgccgccagggggcggtcggaccccgcctcccgagcccggggaggggcggggaggacaaggggcgggcccgcggcctcacccggagggacggcagccccggtcgcgcgctggccccgcaggaccttccttttccaggaagagccagcttttctcggagcgcagtcctgggactctccgcagccccgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccatgcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattagaaacttattcatcccactcaggacaataaaaacgaatgtacaa

SEQ ID NO: 1464 - DNA, 4357 bp, Homo sapiens; identical to SEQ ID NO: 1461

SEQ ID NO: 1465 - DNA, 4007 bp, Homo sapiens
tgtctcagtggagctgggtcatctcaggtggggagttggggtccccgaaggtgaggaccctctggggaggagggtgcttctctgagacactttcttttcctcacacctgttcctcgccagcaggccttggctccttgaacttttggccgccatgtgcttcccgaaggtgagtgagaggctgcgtgtgcttttgtgggcatgtctgaaaacagaccgtaagggtgcgggtgccctcagtatttcccgaggtgcctgtgtgtcagggctcagtcaggggcacccagcggcaggaggatagtgatggggtgagagtgtcagtggaggcgctggaggtcatatgtgtcgggggcgctggagaacggcaggggtgtggatgagagggagcacctgtcccaggagcccttcacagcccggaaagcccggggcaggggtggggcagggctctgctggaaacgactcggagaatgcttctctcagaggccggctcagctgggtgggcccaagagcaaggcctgtgtgggtcctggtgtctcttcctcctttcctgggttccctccgacctcccatcctctaccactgccccaccgcaaatgctaggcccaccacaccctccagggagctcttcggcctgtgacaataggggtttccatgatgtggcctggctcaggttcaggacagtgacccggaggacacatggctcccgcatgtcggcacggtgctgctttcaccctggttcctgggaaatcaggctagcgggatgggaccatcgctgcctgaaagtgtgcagacagctgccctgcccagaatatgtccccaggccctgcgcactctgtgggtgactgtcaccactctatagtgggggaaaccaggcatgtcacccccgagactaggcccttgacgtgggggctcagcggggattctgtggggtgcctctggcctctgtggatgcagccacgtgtctgcaggcaggaatggcccgggacctgtgggtctgcatgttggcagtcgggaagagtggcaggttgtagggtggacctacctggcaccccaaatattaatcagctcatcagagaggaatggctgctgttaccttctcaattgtcatgtccctaaacattttttccttggccaactctcacctgggaccatagtggttgtgggaaacccagctgagccagcctgctccaggacagtgtccatcctcccgtgtgtgtacatgggggggtgtgtgtgtgcagggaggacaccccggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccatgctggccctgctcttgggcctgcccagctgagccggctcctgagagaagcgctttctgagtcgtttcgaggacagccctggccggtctttccaggctgtgaggggctcctgggactgctgtctcctcttatcctgtacctctgccatgtgtctctgtgtgtgtgtgtgtgtgtgtgtgtgtgtgtgtgtgtgtataaattatcctggaggaaaggttaaggtgacacatggagactgagtgtcaccgttatttccgcaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgggtggatttcccctcaggcaccaggtcacatgtccccgcccccaggcactccaccctgtgtggggctcagggtgagaaggatgaagagggacccacaggctccctcaccccttaccgtgggcaaatgcttgcacctgggtggcagtgagtgggcgggtgggggatctggacgcccggggagactgagggaggcatccaagccccagggctccttgaggaaacaacaggggtgccagacgtggcccgggcccctggctgggcccagttcggggtgtgtgggagctgaggactcactgggcttgaggactgactgatgtggggtgcagaggaggcttgggcctggaaccgagtgctttgttcctaacaggtgatgtcgagcctggcagagctggaggtgagccgtggcctccccctccaccaagcttagtccctgggtcttaggctccacaggacactgggtctgggccccgggtccccttgggaatcacctggaccagtgggggccacagtgggaagggggcaggcaggagcagcatgaaccccctgtgccctcctctccccaggacgacttcaaagagggctacctggagacagtggcggcttattatgaggagcagcacccagtgagtatgacacacccatctgggcaccttgccttccttcacctctgccctgtcttttctttctttctttctttttgtttatttgagacagagtctcgctctgtcgcccaggctggagtgcagtggcatgatcttggctcactgcaacctccaaatctcgggtttaagtgattctcctgcctcagcctgacaagtagttgggactacaggcacccgccaccactccaggctgattttttttgtgtgtgtttttagtagagaccaggtttcaccatgtttgccaggctggtcttgaactcctaaccttgtgttccgtctgccttggcctcccaaagtgctgagattacaggcatgagccaccgggcccagccaacccctgccctgtcttgatgtggtgtgggcagggtgtgcccagcccctgagcttggggtggagggctgggagtgacagcctagctgggacctgcccatggcctcactcctcacacagtggcacagccctcaaggcacgatgagggccctgacctggtgaccaagcagacacacccatcctgtcactgccatggaggtgaatgcagaggagggggactctgggaaaagtccctcttgcccacggggctgtggttgggaaaccaacacctgtgggcctccgtctcccagggtcaggaaaaggctgagaggcctgggtgtggccagggcctggggctgacacccccacctacagaccctgaatggtgctcccattccacaggagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactga

SEQ ID NO: 1466 - DNA, 4357 bp, Homo sapiens; identical to SEQ ID NO: 1461

SEQ ID NO: 1467 - DNA, 4031 bp, Homo sapiens
ggaagactgcgtgcagaaggtgactgtctcagtggagctgggtcatctcaggtggggagttggggtccccgaaggtgaggaccctctggggaggagggtgcttctctgagacactttcttttcctcacacctgttcctcgccagcaggccttggctccttgaacttttggccgccatgtgcttcccgaaggtgagtgagaggctgcgtgtgcttttgtgggcatgtctgaaaacagaccgtaagggtgcgggtgccctcagtatttcccgaggtgcctgtgtgtcagggctcagtcaggggcacccagcggcaggaggatagtgatggggtgagagtgtcagtggaggcgctggaggtcatatgtgtcgggggcgctggagaacggcaggggtgtggatgagagggagcacctgtcccaggagcccttcacagcccggaaagcccggggcaggggtggggcagggctctgctggaaacgactcggagaatgcttctctcagaggccggctcagctgggtgggcccaagagcaaggcctgtgtgggtcctggtgtctcttcctcctttcctgggttccctccgacctcccatcctctaccactgccccaccgcaaatgctaggcccaccacaccctccagggagctcttcggcctgtgacaataggggtttccatgatgtggcctggctcaggttcaggacagtgacccggaggacacatggctcccgcatgtcggcacggtgctgctttcaccctggttcctgggaaatcaggctagcgggatgggaccatcgctgcctgaaagtgtgcagacagctgccctgcccagaatatgtccccaggccctgcgcactctgtgggtgactgtcaccactctatagtgggggaaaccaggcatgtcacccccgagactaggcccttgacgtgggggctcagcggggattctgtggggtgcctctggcctctgtggatgcagccacgtgtctgcaggcaggaatggcccgggacctgtgggtctgcatgttggcagtcgggaagagtggcaggttgtagggtggacctacctggcaccccaaatattaatcagctcatcagagaggaatggctgctgttaccttctcaattgtcatgtccctaaacattttttccttggccaactctcacctgggaccatagtggttgtgggaaacccagctgagccagcctgctccaggacagtgtccatcctcccgtgtgtgtacatgggggggtgtgtgtgtgcagggaggacaccccggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccatgctggccctgctcttgggcctgcccagctgagccggctcctgagagaagcgctttctgagtcgtttcgaggacagccctggccggtctttccaggctgtgaggggctcctgggactgctgtctcctcttatcctgtacctctgccatgtgtctctgtgtgtgtgtgtgtgtgtgtgtgtgtgtgtgtgtgtgtataaattatcctggaggaaaggttaaggtgacacatggagactgagtgtcaccgttatttccgcaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgggtggatttcccctcaggcaccaggtcacatgtccccgcccccaggcactccaccctgtgtggggctcagggtgagaaggatgaagagggacccacaggctccctcaccccttaccgtgggcaaatgcttgcacctgggtggcagtgagtgggcgggtgggggatctggacgcccggggagactgagggaggcatccaagccccagggctccttgaggaaacaacaggggtgccagacgtggcccgggcccctggctgggcccagttcggggtgtgtgggagctgaggactcactgggcttgaggactgactgatgtggggtgcagaggaggcttgggcctggaaccgagtgctttgttcctaacaggtgatgtcgagcctggcagagctggaggtgagccgtggcctccccctccaccaagcttagtccctgggtcttaggctccacaggacactgggtctgggccccgggtccccttgggaatcacctggaccagtgggggccacagtgggaagggggcaggcaggagcagcatgaaccccctgtgccctcctctccccaggacgacttcaaagagggctacctggagacagtggcggcttattatgaggagcagcacccagtgagtatgacacacccatctgggcaccttgccttccttcacctctgccctgtcttttctttctttctttctttttgtttatttgagacagagtctcgctctgtcgcccaggctggagtgcagtggcatgatcttggctcactgcaacctccaaatctcgggtttaagtgattctcctgcctcagcctgacaagtagttgggactacaggcacccgccaccactccaggctgattttttttgtgtgtgtttttagtagagaccaggtttcaccatgtttgccaggctggtcttgaactcctaaccttgtgttccgtctgccttggcctcccaaagtgctgagattacaggcatgagccaccgggcccagccaacccctgccctgtcttgatgtggtgtgggcagggtgtgcccagcccctgagcttggggtggagggctgggagtgacagcctagctgggacctgcccatggcctcactcctcacacagtggcacagccctcaaggcacgatgagggccctgacctggtgaccaagcagacacacccatcctgtcactgccatggaggtgaatgcagaggagggggactctgggaaaagtccctcttgcccacggggctgtggttgggaaaccaacacctgtgggcctccgtctcccagggtcaggaaaaggctgagaggcctgggtgtggccagggcctggggctgacacccccacctacagaccctgaatggtgctcccattccacaggagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactga

SEQ ID NO: 1468 - DNA, 4357 bp, Homo sapiens; identical to SEQ ID NO: 1461

SEQ ID NO: 1469 - DNA, 39321 bp, Homo sapiens
tttccagtactaagaataaatattggaagctttattgaaattgtatcaaatttacagaaacatttaaagaaaacatattaataatggtcttcctaatcattgaaatttttactttatttttaatttttttgggtacatactaggtgtatacatctatggggtacatgatatattgatacaggtttgcaatgtctaataatcacatcagggtaaatgggatatccataacctcaagcatttatcctttgtgttacaaacaattcaattataccttaaaaatgtacaattattattgactgtagtaaccttgttgtgctatcaaatactaggtcttagtcattctacctttttgtgcccattaacattccccaattccccctcatcatgcccccactacctttcccagcctctggtaaacattcttctactctatctctagaagttcagttgttttcatctttagctccaataaataagtcagaacatgtgatgtctgtcttgctgtgcctggcttatttcacttaatgatctgtagttccatctataatgttgcaaatgacaggatctcattcttttttatggctgaatagtactccgttgtgtatacgtaccatattttatttatccattcatctgctgatggacacttggattgcttccaaatcttggctattgcgagtagtgctacagtaaacatggtgcagatttatcttcaatatactgatttcctttctttggggtatatacctaccagtggaattgctggattgtatggtaactctatttttagtttttgaggtacctacaaactgttctccatagtggttgtactaatatacacttccacagtgcacgagggttcccttttctccacatcctcttcagcatttgttgttacctgtcttttggacagaagatattttaactggggtgagatgatatctcattgtagttttgatttgcatttctctaatggatcaatgatgttgagtacattttcatatgcctgtttgccatttgtatgtcttctttcgagaaatgcctattcagatttttgtccagttttcagattaattttttttctatagaattgttatagttcctgatatagttatagttacagctcctgatatagctagtgatatagtttggatatttgtccctgcccaaatctcattttgagatgtaatcctcagcattaaaggtgggtcttggtggaaggtattttcgtcaagggggaggatccctcattaattgatgctgtcctttcatcaacgcccatatttctgccatatgcattttggaaaagtttttccagtgttaagaataaatattgggagttttattgaaatattaaatttatagaaactgctattattttaataatgagtcttcaaacattgaaattatttttaaatttttgtgggtacaaataggtgtatatgtttatgggggtacatgagatattttgatacagtcatgaaatgtatatgaacacatcagggtaaatggggtatccctgacctcaagcaaccctcacaagacctgagtactcacaagatctggttaagtgtgtggcacctccctccccctctctttgcccttgctcctgccatgtgagatacttattccccttttgccttccacaatggttggaagcttcctgacgcctccctacaagctgatcagatgttagcaccatgcttcctgtacagcctgcaaaactgtgagccaattaaacctcttctttataaattacccagtctcacgtatttctttatagtacttcaagaatggcctaatacagatggatagtttgcaaatattctttcccattctatgggttgtctcttcactttgttgtttcctttgcaatacagatttttaacttgatgtgatcccacttgtccatttttgctttggttgcctgtttgtcaggtattacacaaaaaatctttgcccactccaatgtcctggagagattccccaatgttttattttagctgtttcatagtttgaggtcttagatttaactttttaattaattttgatttttgtatatgttaagagataggggtctagtttcattcttctgcatacggatatccagctttcccagcaccagttattaaagacactatctttaccccaatgtatgttcttcataactttgtcaaaagtgagttcactgtagatgtatgaatttgtttctgggttgtctattctgttcctatgtgtctgtttttatgccagtatcatgctgttttggttactgtagctctgtagaataatttgaagtcaggtaatatgatccctccagtttgattccttttgctcaggataactctgactattctaggtcttttgtggtttccatataaattttaggattgtgttttctatttctttgaagaatgttaaagttttctggatattgcacagtttgtccattaacttgctgagcaacatcttttttttttcttttttcctgagacagggtctcactctgtcttccaggctggagtgcagtggcatgatcacagctcgatgcagtctcaatctcccaggctcaagtgatcctcccacctctctgcctcctgagtatctcggatgacaggtgcatgccaccacgcctggctaatttttatattttttgtagagacagttttgccatgttgcctgggctggtctcaaactcctgggctcaagcaacacacccacctcgacctcctaacatgctagaattacaaacatgagccactgagcccagccagagtattttctttctgttaggtacatgaaatgattcaggctcatcttctttttctcccaatctccgactaggaatcatccctggtccccttttttgtggatagtatttaggaaataataacttggcagttggtgtgtttactgttactgagctgtgactgcatttatgtcctctcggtagaatgaatcacaaaatatatgtatatgggcacacccaacaatttctctattgttcctatgtatttaaaagatatgagttctattctaatcccacactgcaggttttctagctctcctcattcctatttctacaaataccttctctaacagggagaaaccttgccatcatcattctcaacatatttgctcagtggtaccaatctcttaacaatgctgcccatctcctccccctgtcccttccacacctcaccctcagccctcttggtgccagcagacacatagccacaactcctctcatcccacaatgcaggtctaactcctccactctgggaagggaaggcaaaagagacacataaaaactcaaagaggggaatcaaaagaaagaggaagggaaggccacattgattttttaaaaaataataaatcatcttttgattgccctaataaacatctcttggtgatgatacagtttatggatatgactagactttttttttcaattttaggattttgcatctaaatctatgagactttggtctatagctttatgttttttgtttgtttgtttgttttattggttttggtatcaaggttgcactggcctgaaaaactgaattggaaaagttccaacttttttcttctagaagagtttataaaagcctggtatgctttatttattaaatatttggaataacttcagtggagccatctgtcctagagttttctttctaagcaagtttttgaatattccactcagatattgtttgcagttgtgacaaggtacaatgaatctctggtatgaccttgtttccagggcttttactgatggcatgttcatgaaaggaccaacccactggcacttcctaaggtctaatcatttctcctccatattgcaaaatgcaaaacaaaacaaaaatcctacttgttttcttctcaaattagcttttcagcctcctgccctatgcagcatgagatatctggaaatttcttgagaaattatgtgtttgaagcccctaatgtatccatttttttttaattgcagtcttgattgttctcctggtttctggtcccccccatgccttcccctgacccccagggtatggccctctgcctgaaccaagttcagtattcaggttcttccctatagccagaagtggaaagggtccccagagcaaagagctgcattctgtgcatgtgctttctgggatttaccactctctagaattttgctcctttagttctctttgcttctatagcaataagttgcatttaaatattttttgtaattttatagttgtcctcaatcagtccattctgctgccgactactataccttacccaatagcaaaatctattttttttttaaagtgtctgtcactcaggctggagtgcagtggcatgatctcagctcaatgaaacctccaactcccaggttcaagtgatcctcccacctcagcctctctagtagccgggactacagatgtgcgcaatcatgcctggctaatttttgtatttttagtagagacagggtttcatcatgttggccaggctggtctggaactcctgacctcaggtcttgcccacctcaacctcccaaagtactgggattacaggtgcaagccaccatgctcagcctatttgtgctttttcaaagccccatatttaagttatatctctatatacattttaaaaagttatatcacctatgaaaaatgtatttcactttggagagaaatagagttgggtacaataagtcactcacagcagaatgtcctggcttatgtgttggacatctgctagggcagaaaccaccagaaatctggacccactctcttctactaatcctcttaagctgcatacaaggcaagttgacttgcccccttgatccaccattctgagacgggtcacccaaaattagtctgccccaggattattcaaaaatcctgctggtgggctcctgtcctatggccccagattaagggtctctttcttcctggacatacaaaagcactcttgcttatggttccctttgctaaaaactcttcccttattttacatatggctaagcaatacatctttgacctagttatagtcattggctccagcgtggcatcttttcaagtgtcagaaaacagcagtcttgacaatgaactgaactggatataagcaaagtaaaatgctatttctcaataaaaacctttttttgcgtggtggctcacacctgtaatcccagcactttaggaggccgaggcgggcagatcacgacgtcaggagatcgagaccatggtgaaaccctgtctccactaaaaatacaaaaaattagtcaggtgtggtggcaggcgcctgtagtcccagctacttgggaggctgaggaaggagaatggtatgaacccaggaggcagagcttgcagtgagccgagatcatgccactgcattccagcctgggtggcagagcgagactctgtctcaaaaaaaaaaaaaaaaaaaaaaaagaaaaccttttctctacatgttcttaaattgctagatatcctgcaattcaacacctctggtctatattaaatttagattttaacctaaagtgtccacacattggatacagttaaaaatactttctcactatctgatgttcactaagaaggtacttcttattacatatactctataaaatataacctcatagtaaatgctttcctatagtttgtgcattttctgtggcctcttgacttcacacagaatgattttccacattcattacatccatagggtttctgtcttatatgagttctgtggtgaacaattagggcccacttctggtgaaaggttttcccacattcattacacccaaaaagtttctcccgtgtgtcttctcagatattctgtgaaactgtagtagtagcaaaaaaatgcatcccttctcaacttacggatgttgagccaggtttcaccctgtgtgaactctctgatgtttactgaggtgtggcattgagcaaaatgtttcctatattcattcaccaataagtgtttttcacttttagttcttaaacataatctatggcccaaatcccagaataatgttttcctgcattccatatcttcatattgttttttccctctttaagttctcttctctactgtgagaactgacttcagggcaaaggtgttctcattatcattatattaacagatttctctcaccctttatgttctctgctctacaaagttctgacttcacccagagtaatttccctcacttactacatttatagggtttcacctcaagtgtgttctgtgatgtacagttagttttgacttaataataattttccacaaacattacattcatagggtttctcccctgtgtatgttctatgatgtgcaatgagttttgacttcacacagaatgattttccacattcattacatccatagggtttctgtcttatatgagttctctggtgaacaattagggccaacttctgatggaaggttttcccacattcattacatccaaaaggtttctcccctgtgtgtcttctcagatgttctgtgaaactgtagtagcagcagaaaaattttccacattgaatacatgcataagatttcccatctgtgtgttcttagatgtttagtaagggttgacttctcggagaatgacttcccacattcattacattcataaggtttttctcctgtgtgaattctctgatgtttaatgaggtcggattttctgagaaaggtgttgccacatgcatagcattcatagggcttctcccctgtgtgttttctgatgcacagttagaactgacttaaacgaggttttcccacattcatgacattcatgatttctccccacgtgtgttctctgattttgagtaagggatgacttttcactgaaggatttctccattcatgacatctgtaaggtctctcccctgtgtgaattctttgatttctaatgaggtctgaattcttatagaaggtcttcccacatccgtgacattcatagggttttccctgtgtgtgttctctgatgtcttgtgtgggctgacttctgggtgaaggtttttccacattcatgacattcataaggtttttcccctggatgtgttctctgttgtaaatgaagggctaatttttcactgaaaaaggttccacattcattatattcaataatattgctaattgagtgggttctctgaattagagtgggatttaaattctggctgaatgggtaaacattctgatgttcaaagagaatggattcctcaaagatactttctccacattcattacattcatagtggttctctcttggatgtgtttgctgatgagtaataaaaaatgacatataacaggttttcccatgttcagtatatttgcatgttttctgtcctgtgtaagctctcttatgtacaaggaagagtgaattctcagggaaagctttcccacattcattgtattcaaaaggttgctcccaatttttaatcttctgatgccaaatgaggtcttcattcagccagaagctgttcccattgttattatattcagaaggttcctcttcaaaatgaattatttcatgctttcatcacagaaacattttccacctttgttaaactcattgaacttcattcttgaatagtttctactggtattaattaattctgaaatacagagtgacaagaaagattagttgacaaggatatgtaagagaactgaagttagcattatgtttgaaggctcagtttaagccattatctcctcacacctacattatgacaacaatgtgcacacttccagtcttatacctcttttcaactcaacacagcagcaacaaatcaaatttctaaaagttctaattcatagatagtcctataatccaggctccaattgtgtgtgttgttgttgtttttgagacagagtcttcctctgtcacccaggctggagtgtagtggcatgatctcagctctctgcaatctccgcttcctgggttcaagcgattctcatgcctcaacctcccaagtagctgggactacaggcatgcaccaccatgctcagctagtttttatgtttttagtagagacaggattttgcaatgttaaccaggctggtctcaaactcctggcctcaagcaattcacccacattggccttcaaaagggctaggattacagacatgagccactgcatctggcttaattgtttttctagctctgattcactaggaataaaagtatgcaacaataagagtgaaatcaatgagtgaacaagtcatcgttgccacaggatcaggcttatggttctattccggctatgggatttgccctttattccatcaactgtactatattatactgagtccaatgttccaagaacaaacactttttttttaacaaggtatcactgaagtagacatatctttacgtttagattcagattagaaccaagccattcttttacaagtctataatgaatgtaattcactctaggtaagttcatctgtttgtccctcataaattgctcattcccatcataattttatactgatttttttttcattgtcagcttacagtctaacaatgtttttaaaaagttgccttcccaaattttcccaccacttccagattcatttactaaaaaacatgaaaggaccatttgtataattcatttaagcacaaacatcagctggattgctataacaatattctttgttaaacactgaattttaaaatatttcatgcagttctgttttcgttcaccaactatgttcctggcagccattactttacctatgattttctctcagtgccctacatagatatttatatcatggtacctaataaataatgtttatcagaattacccagagagcattttcaaacacaaattttttcaggcttcacgctgaaatcattactgtttgaatgtttaattttaattttaaatgctttttatattttagagacagaatcttgctctgtcacccaggctgcagtgcaatggcacaaacacagctcactgcagcctcttcctgggttaaagcaagactctcagctcagctccccagtagctgagatcacaaaaatcagccaggcatgggaccgcatgtgtgtgccaccatgcctggctaattttttaagttttgatagagatagggtctccccgtgttgaccaagctggtctcaaattcctgggctcaagagattctcccacctcagcctcccaaattgctgggattacaggcatgaaccactgggcccaggctattttaaaataattctgtaaaaaaatgtgaatatggtagaatgctaacgaatgagcaactcaaaaaagcatgtatagaaaaatatatttaatattttatagaaggagggatgctcttgaatgggaagaccacacgagggagctttccaggggtgctgaaaaacactctatatattcatctcaatgatggatacatgagtgtctcatatatatatatacacacatatatatttaattttattaagctgtgacttaactatataatttatatcacaattaaaaaaaaagatgtgtgtatggaagtgatactgggagatgctgggtgattaagagccactggatatttgggtcatgtcaacatgttacttccaaaggtctagagcctctaaaatatgattcctgaagaacatttcaatggtcttattatctgaacttaccctttgtgatctgcctacctttaaattccatctggcactaactcacccagatgactctggcttcgaaatttttcctctaatatccatggctccttgcctgtctccaatttgaggatcacttctggtttaggaatgcaataccctgtgaatgatgcaataccctgtgaatgagaattatattacttctgacaaactgggtgggtttccctgaaggaggaagacagtataccccaaacagtacacacacacacacacacacacacacacctcatttaatcctgtcgtggggcagaggaaaatattctttctggtatccaaaagggatacattgtctctgacctctaaatttcaaagctaaatgttatattttacaaaatttccacaagtttctatcgataagaaaggacatgcattctggccttctacatgggaaacaattcctacctacctactgagacaaggtggctgtagttctccagcatcacattcctctacagggtcctctgagcagggtccagatgatgccactcctcttgagtgaagcccatagtcacatccctaaatgacactgatccctggaaaatcacagttctgctcagtctgatgcaataagaatcagctgatgtgagacaagatgtttagggactaattcttacaatttttgttgttgaaaattaaatagaaaatgttataaagggcctccatgatatatgttgttttatgttacacattgtgggtaaaagatcatagcagaaatatcctgttggtgaattaattacttaatgcaaaagtatttagtacctacatgtgcctagagctttcttagtttctgagtattccaatttgaatacaagagtcttccttacaagagaggaacataccttctcataaggaaacatacatacagagacatatctaccacaggacttaaaggactcacaccacagatatgtgcaacacagatggatcataaaagtgttctgggcaaattcatgtgagagtgtgtcaacatattagacttcactgaagtgataaaactttagttcctttgcaaacatataacaaaaacttaagaaaacgttaaaaacctgaaaaaatatgtggcaagtcaatggaattgcttaacaggataacagcatgtcttacctgtgatgagataaaggttgcagaggcatgggagatgagggagactaggaaatacttttggctttaatcctgttagtgttctccaaatatttatcactcttctaatccataaaaatgtttagcaactactagtttagtttatatttataaagtaaataaaatacaatctacatataaggaaagcttaattttgttttcattttttagataaaaatataaataggcatgctgatagtttcctcccatgccctaaaggactggcagtatatgacataaacacaataatcttgcacacttcctttaggccataggctccctgctctcccaactccaagtcattgatgcaaatagcagaagttgatggtgaactgaaaatacacacctgaatccctgtaacataattcagttttcactcaggaagcaatgccaccaaagtacagtggagactgtgctggagagcagcgttagaggtagattgtctatattacggggcagcagtggagatgtggaagagggaattcactaagcaaaggaagagaagaagggctacttccagagggcctgtataggggccttagaaggtctggaaattagaaccaggaggttgggtgttgggggaggtgagagtacagagtgacaataagacacatgcaggccatgcagctcttggaatgtcttcatgtcatggaagtgagcatgtccagtggaaggttacagagatgattctgaagcttgggagagacctaaggtctggagttcaagaccagcctggccaacatggtgaaaccccgtctctactaaaaatacaaaaaatagccatgcatggcagtggatgcctgtaatcccagctactcaggaggctgaggcaggagaacctcttgaatccgggaggtggaggttgcagtgagccaagatcgtaccactgaactccagcctgggtaacagggtgagactccatctcaaaaatatatatatgtcagagaagaaaaaaacagcgttccaaaatcaatgttaatatttgcctaactgtgaaaacaaaaaaaatactctgtgaacactactagaaaataaaataggccaggtgtggtggctcacacctgtaatcccagccctttggtaggccaaggcgggaggctcacgaggttaggagttcaagaccagcctggtcaacatggtgaaaccccttctttactaaaaatacaaaaattagccaggcgtgctggcaggtacctgtaatcccagctactcaggaggctaagacaggagaatcacttgaaaatccaggaggcagatgttgcagtgagccaagatcgcaccactgtactccagcctgggcaaaaagagtgaaactctgtcaaaaaaaaaagaaaaaagaaaaagaaaaagaaagaaagaaagaatacaaaatggatgtaaaatgcagaattgtacaaatctaaatgtataaaattgcacaaattatcataaaataaaaacttgaagaagagttaataatagtttgtaaaatataaataaatctaggagataaattccattctacaatgaattctagaagaaaaaaaagctaaagagagacttttgggggggggaatgagggcaatcaagagcactgtgtacgttatagcccatttatgcctgaggttacaattttattaatttttgcaatcagaccttgaaatgaccttaagcagtaagatataaataacccccacaggcttagcgttccaataatggaacactaggtataaatgggttagggaattcagaatggcaagcacaaacccaggacaggagaagcttggcaaagacctgaaaagaccctaaggttttacttctggctaatctctatgctcggttcaagcaagtagtgaagactaagatgaagttctttttattattattattattattattattatactttaagtttagggaacatgtgcacaatgtgcagattagttacatatgtatacatgtgccatgctggtgcactgcacccactaactcatcatctagcattaggtatatctcccaatgctatccctcaaccctccccccaacccacaacaggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcattattttttatggctgcatagtattccatggtgtatatgggccacattttcttaatgcagtctatcattgttggacatttgggttggttccaagtctttgctattgtgaataatgccgcaataaacatacgtgtgcatgtgtctttatagcagcatgatttataatccttttggtatatacccagtaatgggatggctgggtcaaatggtatttctagttgtagatccctgaggaattgccacactgacttccacaatggttgaactagtttacagtcccaccaacaatataaaagtgttcctatttctccacatcctctccagcacctgtcgtttcctgactttttaatgattgccattctaactggtgtgagatggtaactcactgtggttttgatttgcatttctctgatggccactgatggtgagcattttttcatgtgttttttggctgcataaatgtcttcttttgagaagtgtctgttcatgtccttcacccacattttgatagggttgtttgttttttttcttgtaaatttgtttgagttcattgtagaatctggatattaaccctttgtcagataactaggttgcgaaaattttctcccattttgcaggttgcctgttcactctgatggtagtttcttttgctgtgcagaaactctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagcttactacatacggctagccagttttcccagcaccatttattaaatagggaatcctttccccattgcttatttttctcaggtttttcaaagatcagatagttgtagatatgcagcgatattcctgagagctctgttctgttccgttgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagtttttccaattctgtgaagaaagtcattggtagcttgatggggatggcattgaatctgtaaattaccttgggcagtatggccattttcatgatattgattcttcctacccatgagcatggaatgttcttccatttgtttgtatcctgttttatttcactgagcagtggtttgtagttctccttgaagaggtccttcacatcccttgtaagttggattcctaggtattttgttctctttgaagcaattgtgaatgggagttcactcatgatttggctctctgtttgtctgttgttgatgtataagaatgcttgtgatttttgtacattgattttgtatcctgagactttgctgaagttgcttatcagcttaagattttgggctgcgacgatcgggttttctggatatacaatcatgtcatctgcaaacagggacaatttgacttcctcttttcctaattgaatacactttatttccttctcctgcctaattgccctggccagaacttccaacactatgttgaataggagtggtgagagagggcatccttgtcttgtgctgattttcaaagggaatgcttccagtttttgcccattcagtatgatattggctgtgggtttgtcatagatagctcttattattttgagatatgttccatcaatacctaatttattgagagtttttagcatgaagcattgttgaatttcgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaagtgagttagggaggattccctctttttctattgattggaatagtttcagaaggaatggtaacagttcttccttgtacccctggtagaattcagctgtgagtccacctggtcctggactctttttggttggtaaggtattaattattgccgcaatttcagctcgttattggcctattcagagattcaacttcttcctggtttagtcttgggagggtgtatgtgtagaggaatttatccatttcttctagattttctagtttatttgcgtagaggtgtttgtagtattctctgatggtagtttgtatttctgtgggattggtggtgatatcccctttatcattttttattgcatctatttgattcttctctctttttttctttattagtcttgctagcggtctatcaattttgttgatcctttcaaaaaaccagttcctggattcattaattttttgaagggttttttgtgtctctatttccttcagttctgctctgattttagttatttcttgccttctgctagcttttgaatgtgtttgctcttgctttcctagttcttttaattgtgatgttagggtgtcaattttggatctttcctgctttctcttgtgggcatgtagtgctataaatttccctctacacactgctttgaatgcatcccagagattctggtatgttgtgtctttgttctcattggtttcaaagaacatctttctttctgccttcattttgttatgtacccagtaatcattcaggggcaggttgttcagtttccatgtagttgagcggttttgagtgggattcttaaccctgagttctagtttgattgcactgtggtctgagagatagtctgttataatttctgttcttttacgcttgctgaggagagctttacttccaagtatgtggtcaattttggaataggtgtggtgtggtgctgaaaaaaatgtatattctgttgatttggggtggagagttctgtagatgtgtattaggtccacttggtgcagagctgagttcaattcctgggtatccttgttgactttctgtctcgttgatctgtctaatgttgacagtggggtgttaaagtctcccattattaatgtttgggagtctaagtctctttgtaggtcaatcaggacttgctttatgaatctgggtgctcctgtattgggtgcatatatatttaggatagttagctcttcttgttgaattgatccctttaccattatgtaatggccttctttgtctcttttgatctttgttggtttaaagtctgtttgatccgagactaggattgcaacccgtctttttttgcttttcatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcttagtctcaatggtctttacattttggcatgattttgcagtggctggtaccggttgttcctttccatgtttagcacttccttcaggagctcttttagggcaggcctggtggtgacaaaatctctgagcatttgcttgtctgtaaagtattttatttctccttcacttatgaagtttagtttggctggatatgaaattctgggttgaaaattattttctttaagaatgttgaatattggcccccactctcttctagcttgtagggtttctgccgagagatccgctgttagtctgatgggcttccctttgagggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccatcactttcaggtacaccagtcagacgtagatttggtcttttcacatagtcccatatttcttggaggctttgctcatttctttttattcttttttctctaaacttcccttctcgcttcatttcattcatttcatcttccattgctgatacgctttcttccagttgatcgcatcggctcctgaggcttctgcattcttcacgtagttctccaggcttggtttccagctccatcagctcctttaagcacttctctgtattggttattctagttatacattcttcttaattttttaaaagttttcaacttctttgcctttggtttgaatgtcctcccatagcttggagtaatttgatcgtgtgaagccttcttctctcagctcgtcaaagtcattctccgtccagctttgttccattgctggtgaggaactgcattcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagtttttcttctaacagacaggaccctcatctgcaggtctgttggagtacctggccgtgtgaggtgtcagtctgcccctgctggggggtgcctcccagttaggctgctcaggggtcagggacccacttgaggaggcagtctgcccgttctcagatctccagctgcatgctgggagaaccactgctctcttcaaagctgtcagacagggacatttaagtctgcagatgttactgctgtctttttgtctgtgccctgccccagaggtgaagcctacagaggcaggcaggcctccttgagctgtggtgggctccacccagttagagcttcccagctgctttgtttacctaagcaagcctgggaaatggtgggcacccctcccccagcctcgctgccaccttgcagtttgatctcagaccgctgtgctagcaatcagtgagactccgtgggcataggaccctccgagccaggcgtgggatacagtctcctggtgctcagtgttttaagcccgtcggaaaagcgcagtattcggttgggagtgacccgattttccaggtgccatctgccacccctttctttgactaggaaagggaactccctgaccccttgtgcttcccaagtgaggcaatgcctcgccctgcttcggctcacgcacggtgtatgcacccactgacctgagcccactgtctggcactccctagtgagatgaacccggtacctcagatggaaatgcagaaatcacccatcttctgccttgctcacactgggagctgtagaccggagctgttcctattcagccatcttggctcctcccctcagtccagttgactaagatgaagttctaaatggaccaggctaagtgcttaaaaagtgccccaggacagagccaatttgcaaataataagaaaggggttttgttgtatttttgttttagttttttgttttttctttttcttttcctttttcttttttgtttggtggtggttgtttgaaacctggccttccaggaaaaatgcctgttaaaacactacctaaacacaagctaaagagagagaattcagtgaccacacataagactgcaaaaaaaagtttgaaaaattcataaaaacaaatggatactgaagacttcagtaattaagaacagcaaagtctagagaagaatgagaaagtgatttctaaagttactaaattataatattaaaatacccagtttcaacaggaacaagaaaatcacaaagcatacaaagaaactggaagtgttgtccaatcaaaggaaaaatagaaattgacagatatatcccagaggcaaaccaaacataacacttcttaaacaaagactttaaatcaactgtcttaaatatgctcaaaagctaaaagaaaacatacgagcaccagagagaaccatgaaacaacttataaaccaaatatcaataaagagattgaaattataaaaaagcaccaaatagacattctaaaactaaaaagtaccataattgaaataatgaattcaccagaggagttcaacagcagatttgggaatgccaaaaataatctgtgaatttaagtataagactattgaaattatcaagtttgagaatcagagcaaaaaagaattaagaaaaataaatggaacccaaaggacctatgggacaccatcaagctgaccagcaaaaacattatgggaaatgtagaagaatacaagagagacaaggaaatagagtatttgccgaaaagccaaaattaaactccctaaatttggtgaaagacacaaatctacacatccaggaagcacaataaactcaaaataaactcaaatacatccaccaagtcatgttataagcaaacagtcagaaaaaaaaaatgacagagaatcaaatgcaaaggagaagcaatttgtcatatacaaaagaacctcaaaaagatcatcagcagaaaccttggaggttagaaggcactggattgatatattcaaagtgctgaaagaaaaagctgtcagctgagaattctatgcatgggaaacatgcctgtcaataatgaggacattcccagatgaacacaagctaagggagtatgtttttactagatctactctgcaaggaatgctaaagggaatcctttgggttgaaatgtgattcacaacaaacaagggaactgttaaaagattataagccaagttttcatctggatttggtcttaaaagagaaattaggattaaataaataagaaaaatggcagagattggcagagtggacaaatttcttcaaataatgcatacaaaaatgtaattagaatgaataagatcgagtatttgatagtacaacagggtgactatagtcaacaattttttttattatactttaagttctggggtacacttgcagaacatgcaggtttgttacataggtatacatgtgccatggtggtttgctgcacccatcaacccatcatctacataaggtatttctgctaatgttatctctcccctaccccaccaccctccaacaggccctggtgtgagatgttcccttccctgtgtccatgtgttctcactgtcccacttatgagtgagaacatgcaatgtttggttttctgttcttgtgttagtttgctgagaatgatggtttccaccatcatccatgtcccagcaaaggacatgaactcatccttttttatggctgcatagtattccatggtgtatatgtaccacattttccttatccagtctatcattgatgggcatttaggttcattccaagtctttgctattgtgaatagtgccacaaaaaacatacatatgcaagtgtccttatagtagaatgatttataatcctttgggtatattcctagtaatgggattgctgggtcaaatggtatttctggttctagattcttgaggaatcaccacactgtcttccacaatggttgaaccaatttacactcccgccaacagtataaaatcgttcttatttctccacatcctctccagcatctgttgtttcctgactttttaatgctcgccattctaaatggtgggaggtggtatctcattgtggttttgatttgcatttctctaatgaccagcgatgatgagctttttttcgtatgtttgttggccacataaatgtcttcttttgagaagcgtctgttcatatccttcacccactttttgatggggttgtttttttcttgtaaatttgtttaagttctttgtagattctggatattaaacctatgtcagatggatagattgcaaaaattttatctcattctgtaggttacctgttcactctgatgatagtttcttttgctgtgcagaagctctttagtttaattagatcccatttgtcaattttggctcttgttgccattgcttttggtgttttagtcatgaagtctttgcccacgcctatgtcctcaatggtattgtctaggttttcttctagggtttttatggttttaggtcttacatttaagtctttaatccatcttgaattaatttttgtatacggtgtaaggagagggtccagtttcagttttctgcatatggctagccagttttcccaacaccatttattaaatagggaatcaatttcccattgcttgtttttgtcaggtctgccaaagatcagatggttgtagacgtgtggtgttatttctgaggcctctgttctattccattgatctatatatctgttttggtaccagtactatgctgttttggttactgtagcattgtagtatagtttgaagtcaggtagtgtgatgcctccagctttgttctttttgcttagaattgtcttggctatctgggctcttttttggttccatatgaaatttaaagtagttttttctaattctgtgaaggatgttaatggtaacttgatggggatagcattgaatctataaattactttgcagtatgcccattttcatgatactgattcttcctatccataagcatggaatgtttttccatttgtgtgtgtcctctcttatttccttgagcagtgttttgtagttctccttgaagaggtccttcacatcctgtgtaagctgtatttcaaggtatttaattttgtttgtagaaattgtgaatgggagttcactcatgatttggctctctgtttgtctattattggtgtataggaatggttgtgatttttgcacaatgattttgtatcctgagacttttctgaagttgcttatcagctttaggagattttgggctgatacgatggagttttctatatatacaatcatgtcatctgcaaacagagacaatttgacttcctcttttcctatctgaacaccctttatttctttctgttgcctgaatgccctggccagaacttccaatatcatgttgaataggagtggtaagagagggcatccttgtcttgtgctgattttcaaagggaatgcttccagtttttgcccattcagtatattggctgtgagtttgtcataaatagctcttattattttgagatacattccatcaatacctagtttttttgagagtttttagcatgaagcggtgtttaattttgtcaaaggccttttctgcacctattgagatattcatgtggtttttttcattggttctgtgtatgtgatggattatgtttattgatttgcctatattgaaccagccttgcatcccagggatgaagccaacttgattgtggtggataagctttttgatgtgctgctggatttggtttgacagtattttattgaggatttttgcatagatgttcttcagggatattggcctgaaattttctttttttgttgtgtccctgcaaggttttggtatcaggacgatgctggcctcataaaatgtgttagagaggattccctctttttctattacttggaatagtttcagagggaatggtatcagctcctctttgtacctctggtagtatctggctgtgaatccgtctggtcctagaccttttttggttggtaggctattactgcctcaatttcagaatttgttattggtctattcagggatttgacttcttcctgctttagacttgggagggtgtatgtgtccaagaatctatccatttcttctagattttctagtttatttgcatagaggtgtttatagtattatctgatggtagtttgtatttctgtgggatcagtagtgatagcccctttatcattttttattgcatctatttgattcttctctcttttcttctttattcttctggctattctattttgttgatcttttcaaaaaaccagctcctggattcattgattttttgaagggtttttcgtatctctatctccatcagttctgctctgatcttagttatttcctgtcttctgctagctttcgaatttgtttgctcttgcttctctagttcttttaattatgatgttagggtgtctattttacgtctttcctgctttctgttgtgggcatttagtgctaaaaatttccctctagacgctactttaaatgtgtcccagagattctggtacgttgtgtctttgttctcattggtttcaaataacttctttatttctgccttaatttcattatttacccagcagtcattcaggagcaggtagttcagttttcatgtaattgtgcagttttgagtgagattcttaatcctgatttctaatttgattgcactgtgttctgagagactgttaagatttccattcttttgcatttgctgaggagtgttttacttccaattatgtggtcaattttagaataaatatgttgtggtgctgagaataatatatattctgttgatttgggtgggagagttctgtagatgtgtcttaggtctgcttggtccagagctgagttaacattctgaatatccttgttaattttctgtcttgttgaactgtctaatattgagactgggctgttaaagtctcccactattattgtgtgggagtctaagtgtctttgtaggtctctaagaacttgctttatgaatctgggtgctcctgtattgagtgcatatatatttaggatagttagctcttcttgttgcattgatccctttaccattatgtaatgcccttctttgtctcttttgatcttcattgttttaaagcctgttttatcagagactaagattgtaacctctgttttttttgctttccatttgcttggtaaatattcctccatccctttattttgatgtgtgtctttgcacatgagatgggtctcctgaatacagcacactgatgggtgttgactctttatccaatttgccagtctgtgtcttttaattggggcatttagcccatttacatttaaggttaatattgttatatgtgaatttgatcctgtcattatgatgctagctggttattttgcccattagtagatgcaggtttttcatagtgtcaatggtctttacaatttggtatgttgttgcagtggctggtactggttgttccttttcacggttagtgcttccttcaggaactcttgtaaggcaggcctggtggtgacaaaatctctcagaatttgcttgtctgtaaaggattttatttctccttcgcttatgaagcttagtttggctggatatgaaattctgggttgaaaattcttttaagaatgttgaatattggcacccactcttttctggcttgtagggtttctgcagggagatctgctgttagtctgatgggcttccctttgtgggtgacctgacctttctctcttgctgcccttaaaattttttccttcatttcaaccttgctgaatctgatgattatgtgtcttggggttgctctcttcaaggagtatctttgtggtattctctgtatttcctgaatttgaatgttgacctctcttgctaggttgggaaagttctcctggataatatcctgaagggtgttttccaacttggttcaattctccccgtcactttcaggtacaccaatcaaacatagatttggtcttttcacatagttccatatttcttggaagctttgttcattcctttttgttcttttttctgtaatcttgtcttctcactttatttcattaatctgatcttcaatctcttatatcctttcttctgcttgattgagtcagctattgatacttgtgtatgcttcatgaagttctcgtgctgtgtttttcagctccatcaggtgatttatgttcttctctaaactggttattctagttagcaatacgtctaatcttttttcaatgttcttagcttccttgcattgggatagaacatgctcctttagcgtggagtagttagttattacctaccttctgaagcctacttctgtcaatttgtcaaactcattctccatccagttttcttcccttgctggcaaggagttgtgatcctttggaggagaataggcattctggtttttggaattttctgccttttgcactggtttctccccatcttcatggatttccttacctttggtgtttgatgttggtgaccttcagatggggtctctgagtggatgtcctttttgttgatgttgatgttattcctttctgtttgttagttttccttctaacagtcaggcccctctgctgcaagtctgctggagtttgctggagttccactccagaccctctttgcctgggtatcaccagcagaggctgccaaacagcaaagattgctgcctgttccttcctctggaagctttgtcccagagggtcacctgccagaggccagctggagctctcctgtatgaggtgtctgttggcccctactggaaggtgtctcccagtcaggagacatgggggtcagtgacccatttgaggaggcagtctgacctttagcagagcttgaacgctgtgctgggagatctgctgctctcttcagagccatcaggaagcaacctttaagtctgctgaaactgtgcccacagccgccccttcccccaggtgctctatcccagggagatggggcttttatctataagcccctgactggggatgctgccttttttgtcagagatgccctgcccagagaggaggaatctagagaggcagtctcagccttgctgagctgtggtgtgttccacccagttcaatcttccaggcagctttgtttacactgtgagggtaaaactgcctactcaagcctcagccatggcagatggccctcctcccaccaggttcgagtatcccaggttgagctcagactgctgggctggcagtgagaatttcaagccagtggatcttagcttgctgggctccgtgggggtaggacctgccgagccaggccactggctcctggcttcagccccctttccaggggagtgaatggttctgtctcactggtgttccaggcaccactggggtatgaaaaaaaagctcctgcagctagcttggtgtctgcccaaacggctgcccagttttgtgcttgaaacccaggccctggtggcataggcaccagagagaatctcctggtctgcaggttgtgaagagtgtgtgaaaagtgcagtatctgggccagagtgcaccattcctcatggctcagtccctaatggcttcccttggctaggagagggagttcccagacccattgcacttcctgggtgagacgacgccccatcctgcttcggctcaccctccatgggctgcactgactgtcccactggtcccagtgagatgacccaagtacctcagttgaaaatgcagaaatcacccgcattctgcgtcaatctctctgggagctgcagaccagagctgttcctatttggccatcttgacacaaatccccaaaataatttattgtacattttaaaataagagtataatttgattgtaacacaaagaaaggataagtgctgtagttgatggataccccactcactctgatgtgattttacacattgtaggcctatatcaaaatatctcatgtatataaatcacataaatatatatactcactatgtatccataaaaattataaacagaaaataaggggaacaaaagaaaaagatctaaccataagctgtctccaagaaactcatagtagatccaaagccagtaagctgaatgcgaaagggtgaagaaagatatttatgcaaataataaccaaaagagtgctgggtagctacactaatactagaaaaacaaaaaacaacaacaaaaaaaaacagactttaagtaaaaaactgttataagagacaaagaaggacattatacaactggaaaagtgttaataaaaaaaatcaattgcaaacatacgtagatcaaagaaaatagaaccaaacatataaagcaaacactgacagatttaaatgaagaaatgcagagttcggtaataatagttggacacttcattgctctgctttcattaatggatagaatatccagacagaagatcagtaagaaaacagagtatttgaataatggtataaaccaagtaggcctaagagaagtatgtggaatactctacctaccaatagcaaaatatgcattattctcaagtgcacaagaaacattgtacagggaagcccacagattagggcacaaaataaatctcagtaaatttaaaaagactgaaataataaaaatatatatatattttctgaccataataggataaagctagaaatcagtaatagaaaaaaatttttaacgtggatattaaagtttaatgatcaaataagaaagcacaaaggaaatttaaaaatacttagaaacaggtgaaaaagtaaagagactgtatcacaacttatgggatgcagccaagaatatgcctataaggagatttatagcaataaatgcctattttcaaaaagaaagaaatcaataactttacactttcagcaactagcaaagaaggatcaaactaaacccaaagctagcagaaggaaggatataatacatattacagcaaagataagtgaacagaaaatagaaaactacagagaaccaaaaaatccaaaagctgattccttaaatagaacaaaattcataagcttttagctagattgactaaagaaaaaaaattcaaaggactaaaatcagcaatgaaagtgacattacaaaaaaaaatgggttataagagaatactatgaacaactgtacactaataaattaagtaactcaatgaaatagacacatttcctagaagcacacacattactaaaactgactcaagaagaaacagaaaatctcaacatacttataacaagtaaagagatgtatcagtaattttttaaaaaactgcccaagggaaaaaaatccagcgtaagatggcttcactggtcaattctatcaaattaaagaagtaatactaatcttcctcaaacatttccaaaaattagaagggaatacttcctaactaattcccatgagttttataatgctggccagcattatcttgataccaaagccaaaaaaagacttcacaggaaaataaaattacaggctaatatcccttatgaatacagatgtaaaaaattataaaatactagcaaacaaaatttggcagcatattaaaaacattacatactatgaccaagttggatctatcccaggaatgcaagagtggttcaatataagaaaattaatcagtgtaagacaccacattaataaaacaaatgaataaacacgtgatcatatcaatgaggcagaaaaaaatacaaaacccaataccattcaaggataataaaagtcagaaaacagaggaaaggaagcaaagttcttcaacataataaagtgcatatataaaaaactcacaggtaacatactccatagtgaaagactgaaacatcccctctaagatcatgaacaggcaaagcatagtgctttcaccactgcaattcaacactgtattaaaagttctagccagagcaaataggcaagaaaaagaaataaaagacattcaaattgaaaggcagaagtaaaactactctatttgcagataacattatttagcaaataatccacaaaaaaactatgagctaacaaatggtttcggcgaagttgcagagtacaaaatcaacacataacaattaggttttctgtaaaaaaaaaaactccaacaatgaactatccaaaaggaaattcagaaaataatcccatttatgatagtatccagtagaataaaatacttaagtgttatggtctgaatgtttgtgcccttcacaacttcatatgttgaaatctaataccattgcaatagtatgaagaggcatggcctttaggaggtgattaggaagctctgccttccttcatgaatgagataagtgtccttataacttaatggacaaagtagtggcttcacaacctggagagacaggtttagatactgtgctgccaataagcagaaattttatttttgataagcttacataaagtaataatgtttttccaaaaataagactttgtcaaatggccccttttaacttctaaaattttttaatacatcaaatctgatttgaatatttaatatagcaagtatggataattccaggaagatggtgatctaagggatcaaaccagagctgaggagacaggtagcactggcaggtttaagagattagatacaggctgggcgcagtggctcatgcctgtaatcccaacactttgggaggccaaggcgggcagatcacctaaggttgggagttcgagaacagcctgaccaacatggagaaaccccgtctctactaaaaatacgaaagtatccagtcatggtggcacatgcctctaatcccagctacttcagaggctgaggtaggagaatcgcttgaacccagaaggtggaggttgcagtgagctgagatcatgccattgcactctggcctgggcaccaagagtgaaactccatctcaaaaaaaaaaaaaaaagattggatacaaacagggagaaggagcaaataaatattgtggataatgatatagcctggtttctcactattggagaaagaagttacaaagatggaaaacagaaaggctatggggttaagattgaaactgggaaatgtctatgtaaactcattgtttaaaaaatatgtatagacagaccaatacaaaaataagtgtacacatgtgtatttctgtgtatgtgtatgtacacatacatacatgtatttcctatctctgtcaattgagagggtctgaggcagtgacagcctctagcaatgagcacccagatcttggtttttaaattccatcctccactagaaagaacaatgtcctttggagaaatggctgatggcaaaggtagtgcaggaaaaggacaagatgggccaggcatatctgttgtgccacagagtaattactcaaaaattgatgtgggaagcaggctgaaaatggaataggtaattccaaaattccatcccaaactaaagcaacaattaagctggaaaaacaaaaaaaaccctctcagcatcaagcttttcagaattctccaatctaattaaaaacctagtaagcccagaacatttctggcgtggcttgctgatgcctgtgccaaagtggacagtatgcactttgttttcagagaactgtagttgtgtgttttgatctgtctatgcgggctctctgaagaagtggctcacaggcttgtctttgttttgcctgccttggaactttctcagggctagtcttccaggaagtgctagttgaaagcatttaaaggcaattatctggcctcagcagccagatgagaaaagcagcagatggactgataaaactgggagtggaaaaactgggaaggaaatacatgggggccggggtggggataaggggtttgaaaagctcctgcataaaccagggaattgaggtcatgtgcaaggccagggcaatatgcacgctcacaaaaaacctgagaggaacctaagctttcagtctggttgaccttcaggctcagtgtaagcaggaagtaaagctttacacagagatgtaaatggcctggcaaaccattacaagagcgccctaaaacagggcaaatatgcaaagaccagaatagttttttgttttgttttggctttgggcatttaaagaaatctctgtcagatcacaaactgaccactaaactaagggaacagaggtttctgtgaccatgtacaacaaagaactttacaaaaatagttttgaaaagtcacaaaataaacaaacaatgcaaaataaacagcaacaacaaattctggggaaaagaatctgatttctagaattaacacattttaatattcaaaatgttcagttttcaataaaaaattatgaggaatgcaaagaagataatatgacccacagacacacagaaaaaagaaatgaataaaacctgtcctcaaagacacctttgttattggtcttactagataaagaatttaaatcaactgttctaaatgtgcacaaaaagctaaatgaaaccagacaactaacagaaagcaggtgagcgatgccctgccaaatataaaatattaatatacagaacaaaattacaaaaatgtaattaggaatgtctggagctgacaagtacaaaaactaaatttttttaaaatcagtcaaaggatttaataaaagattggagctcaaagagaacaaagaatcagcaaaattgaagacactgatggagattactcattctgtggagcagagaaaaagaatggtgaaaaatggacagtgcctaagagatctatgagacaacatcaagcataccaacaagttaataacaagagttgctaatgaagaggagaaaagggaaccaaaaatatctgaagaaataatgtctgaagaccttctaaactgatgaaagacatgaatctctatgcccaagactctcaagaaactataattaggataagctcaaagaacttcaaactgagagaaataataaattgtcacaagacaaagaatctcaaaagtagcaagagataagggactaaccatgtacaaaggatctgaaataagattaacagccagacttttattaggaaccatgaaggccagaggcagtaggataatggcacctttcaagtgccaaaagaaaaaaaatatatatcaaaaattctacatttggcaaaactgcctttcaaaaatgaaagagaaattaaaacattcctagatcaacagaatctgagagaatttattagtactagatctgtcctacaagaaatgcaaaaggaagtccttaaggttgaaacaaaaggacattagacagtaactccaatcgaaacacacaaaaaattcaaatggtaaaagtaactactgtaagtaaatgcaaaagccagtcttattgtattcttggcttttatgttctctcttttttctatatgatttaaaagacaaatacataaaacaataattataaatctatggtaatgtgcacgctatttatgaaggcataaaatgagacaataagaagacaaaggacagggacaaagccgtataggaggagagtttttatataatattaaggcttagttagtattaatgcaagctagattgttataaattcaagatgctaattgcaattccaagtattaacactaggtaaataatgactacaaacaaatacaaaaggaattaaaatggcacattagaaaaaaacaaacacaaaagaaggcatacacagaaaaactgaaaacaaaaaagatgtaatacgtatggaaaacaaatagcaaaatggtataagtcctttatcagtttataatttactctaaatgtaaataaactaaactcccaactaaaagacagaaattggcaaaataggctgggcatggtggcttacacctgtaatcccagcactttgggaggctgaggtgggcggatcacgaggtcaggagtttgagaccagcctgaccaatacagtgaaaccccatctctactaaaaaaaaaaaaaaaatacaaaaattagccaggtgtagtggtgtacacctgtaatcccagctactcgggaggctgaggcagaagaactgcttgaacgctggaggcagaggttgcagagagtcaagatcgcaccactgcactccagcctgggtgatgcagtaagactctgtctcaaaaaaaaaataaaataaaataaataataaaaataaaaataaattggcaaaataaataaaaatatatgatccaggtatatattgtctacaagacactctctttagatacaaacacacaacacaataggttgaaattgaaatgacagaagaggatagtaacctaaagaatgccagggtggctatactgagacaaaagagactttaaatcaaaaattgttacaagagaaaaacactacatattgattaaaaaaaaaaaaaaactaagtctacaaagaagacatagtaacagaaatagaaataaatcatcctgaagtttacatagaatttcaagggatctcaactagccaaaataatcttgaaaacccatgcatgtatggtaaaatgattttcaacaaagttgtcaagaacagtcaatagggaaaggacaatttttctaacaaatagtgttggtaaaactggatagccacatgcaaaacaaaacaaaaacaaaaaaattaactcaaaatgaatcaaagacctaaatctaagaactaaaggtacaaaactcatggcagaacacataggagaatggattcgtgtggcaatgttttcttggatataataccaaaaaccacaggcaacagaaataaaaataaattggaccacatcaaacttaaaaattgtgcatcaaaggacacagttaactgaatgaaaagacaaccaacacaacaggaggaaatatttgcaattcatgtatctgatgaggaattaatataaaaaatatataaagaacccctacaactcaaaacaaacaaaataacctgattcaaagatggacaaaggatttgaacagacatttctccattaaagatatataaatggtcagcaagcttatgaaaatatgctcaacatcactgatcattagggaaatacaaatcaaaaccacagtgaaaaattaccatacacccattacaatggctgctatcaaaacaacaaaagaaaataacgagtgttggcaaggatatggagaaatcagaatcctgtacactgaggatgggactgtaaaatggtgcaccttctgtagaaaacaggtcggtgtttcctcaaggaattaaaaatagaattaccataggttccagccataccacttctgagtatataaccaaaagaactgaaagaaggatctcaaagaatagttgtaccccatgttcacagtagcattattcacaacagttaaaaggaggaaggaacccaaatgtccactgacagatgaatgaataaacaaaacatgggtacaatgaaatatcattcaacatcagaaaggagataaattctgacacatgctacaacactgaggaagcttgaggacattacgctaggtgaaataagccagtcacaataagacaaatactgtatgatttcacttatatgagatatagcaaaaatagtgaaactcatagaaacagaaagtaggatggtggttgccaggggcaaggaggaggggaaaatggggagttattgtttaatgggtagagaatttcaatttcccaagatgaaaaaattctggtgattagatgtacaatatgaatatacttaacactgcttctgaactgtacatccaaaaatagttaagattgctaaagcaaaaaactaacaataaataaagatgcctgctttggccacatatattcaacattgtactaaaaatttcagccagaggaattaggctaagtaaataaataaataaacccaaattagaaagaaagaaatgaaatagttttgtttgcagatgacatgatcttatatgcagaaaatactaaagaatccacaaagaaactactagaagtaggaaacaaattcagcaaaattacaagatacaagatcaacactcaaaaattatttgtgtactcattacaatgagcagtcaaaaagcaaattaacaattccacttacaatagcatttaaacaaaagaaattttaggcttgtgggccatcacagtctctactgcaaccagtcaactctgccctcgtagtgtgaaagtactcacaggctatacataaatacatgagtatggctgagtcccgataaaactttatagacactgaagtctgaatttcatataatttacgatagcatttaaatgaaaaactatttaataaatttaagcaaggatatgcaacacttgtacactgaaaactacaaaatattaatgaaggaaagaagacctagggaaaaaaaatcttatgttcattgattataagatttaatattaagataacactccccaaagtgttatcacccactctaatacttacccaatccaatacttatcaaaaactcaacatacttttttgcagaaatagaaaagctaactaaaaattcctatggattgcaaagcaccctgctgtggaaaactgtcggtttcacaataaattaaatgtaaaattaccatatcacccagcaatttcacttgtacgtatatacccaaaacaactgaaagcatgtattcaaacaaatatttgtacatgaatgctcataggagcactctccacaatagcgaaacacaggatgacccccaatgtccatcaacagatgaatggataaacaaaaggtgatatatccatataatagaatattgttcagtcataaaaagggacaaagtactgatatacaactacaacataaatgggtcttgaaaacattattctaagtgagagatcagacacaaattgtatgattccattcatatgccatatccaaaataggcaaatctataaagacagaaaggagattattggttgttaggggctgggagcacagcggggaaaagggagcaactgcttattaagttacaatactgcttattaagggtgatgtgtttccttttggtgtgatgaaaatattccagaaataaatggtggttatggttgtacaacattgtgaatgtactaaagtcactgaattctatactttaaaatggcttgtgaatttcatgtgatgtgtgttttaccacaattttttttttaggtagaatccctcgaaagttattgcaaatattccagttctgcccagtctctaaggctgtcacaaagcctgccacatcctaacaacccatgatcaccctagcctaccaggactgtttctttaaacaaccatgagtcctaatgctacacaattcattggatttttttttttttttttttttttcctgagacggagtctcactctgttgcccaggctggagcgcagtggcacaatctcggctcactgcaacctccacctcctgggttcaagtgatactcctgcctcagcctcctgactagctgggattacaggcacgcaccaccatgcccagctaatttttgtaattttagtagagacagggtttcaccatgttggtcaggctggtctcgaactcctgacctcatgatccacccgccttagccttccaaagtgctgggattacaggcgtgagccaatgtgcccggcctatttgaattttttaatcatatactttcttttgctatctgttaagttttcccctggactgcacatgaattactcactttgttgtactacttttttaagtacctgcaagactgtcatcagaagtttcacaatgtcacctaataaagcccaccgacaaactgttttatgttccagtttcacaactgtaagatcacaagatctgcattcacctatatgacatttttgtcttactcttcatcaactctctatcagaaatcagcaaacattttctgtaaagagtcacacagtaaatattttaggcttgtaggccattacagtctctgctgcaaccagtcaactctgcctttgtagtgtgaaagtaccaacaggcaatacataaatacatgagtatagctgagtcccaataaaaattcatagacaatgaagtctgaatttcatacaatttccaagcaaaataatactcttggtttttttccctcagccacctaaaagtataaaaaccatccttcatttgtggaccataaaaaaacagacagtaggctgcatttgacccatgaactgtaatgtgacctctcctctatattttccaggatgttatttctactttcatatgaatgtatagacattttttaaacctcaataattagttttaagcaaaactgtgaaaaaataaacaacttacctgggatgtgatcatattccactagtgttggcagagcagagaaaaccgagagggtgtagcttacaaacaagaaaagaacatgagaaatgtcacttgcctaaaaatgtccacctcccagctggcaaaacatctctaaaagggagatactcacacgtccatgcatgactctggcatggttatgtactgcttggacacattagttttcaaatgtgaaaacgtttggttttctactgacttataaacaacttatgctgtactctaacagagtatgcaaaccaatatattaaactaattaagcaagttaggaaaagccaaagaatggaacataatactttcattaaaactgatgctaaacaaaaatattcaggttttaatctttattataaaccagagaatcccaacaaggttttgaaaaaagtgatgtggtatttttcagcccagtttttttttgtttgcttttttgagacagagtcctgccctgtcacccaggctggagtgcaatggcacagtcttggctcactgtaacctctgcctcctgggttcaggtgattctcctgcctcagcctcccaagtagctgggactacaggtgcgcaccaccacgtcgggctaattttttgtatttttagtaaagacggggtttcaccatgttggtcaggctggtctcgaactcctgacctcgtgatctgccggcctcagcctcccaaagtgctgtgattacaggcgtgagccactgcgcccggcagagcccagtttttttggaaggaaaacgaacttgctctaacttggtttcaggttctcaaaaccatctttggattttaaaaagcaaacggattttttcttactctgttgtcaatgcagcaaacacctgcctgagtcctcaagcgactcagtgtctgttcttgactctgccacaacaaaatgtgtcaatgtcaacagtcacttaacatgttaagcttgtttcctgtccaccccaccccatcccatcttttaaataaagccgaaatagataacttacagacctttcttgcggctgcacctctgattctgtaagatcaagatgggggcatccgtacatctctagttgtgctgcaatatgccagcagctcaacatcgagaacgagcgagtaacgaatccaggcatggagggtgctgtcctccacttggctgctaagctcggccctccgcatgatgccttcacaactccccaagaagcggtgctgtctgctccttcggccttgccctcctctgccgccacatctgaatgggcacaaatctcccaccatcacccagcctgtgggagtctgaacaggacacaaatcgagcctctgctcctcccatccgtgctctagatctctaatgaggtctcggcccaacaggtccgatgtcctcctaggagggcccctgcaccctcacccctcctttcccttctcaccccacaacagatgttttgctccaagacagctgggcctaagcccttcagttcgaatcctcatccaagactgaaagctcctacatcttcctgtcactttagccacaagctgcaccgtctggaaatgcccactgctactagggacacaggcgaggccggacagtgccggaggacccggggtgcctccctccacgtgcgcggcctcacaggtcagtggaaacaagaaatcccccaatccacagccacgatgacttcaaaatacttcctgaaggcatcaggccatgaagctgcgacctgcgaggacacagcaagcggggtgacgctgagcagaggcttggtgtggagtccgcgcccgcagggtccctccccgccccgcgggtgcttcccgccacctcgctcgcctctgcgtcgcagtgacaacgcggggatgccgaccacaggtggttggaaggagacagcgagattctgaggggaaagaataaggagagaagcagcatcttttgggcagaaggcccgtttccgcacggtcctgccgaggcctccgggcatccttcacctcagggaagagaaaatccaaccttacttatcacaggcgcgggacctacgttcccttcgggagcagaagaaccaggacaggattaggacgcaggccaggcggcaaagccgctccctctctcccacctccaggacaagcggcacctccagtccaccctcgctccagccctcccgtactctacccccggcatcctctgccccgaagcagggagatgccgggagccctccctaccaggctgtaccggagaaaaacaaacctggagccacaccgcgcacatgcgcagaaagccc

SEQ ID NO: 1470 - DNA, 31762 bp, Homo sapiens
ctactgtttacaatgtggtttaatgagaattggaactagccctactattagcagacagcatcagggcggaggcccccagcccagaccccatggtcttccccatcccgaagtgggatggatttcctcatctgcatacacagcacttcgtcgatataaatggtgttctctttgacctggatctcctcctgcagggcaagctgtctgcgatgcagccctttcagctctgcctgagcttgggctaaagtttccttcaatctaggagaaagggaagaagagaagagaataatttctctctatgcattgctttttcaagggaaagaatgttccccagtgttcagtgcaggagccaaattgatatgtgctcttccccttcctctctcctcatgaagacagagatctcactaattttagaataaaatgcatactgaaaaggccatgaaaaaaagaaaaagacagagatttcaatttggcggccacaggccagattcatgacgtagacaccttatgaaatgctgatgtttaaaactgcagatttgacctaaacatctggatttgggcttctttagaatcactcaatattgggatccattttctccaaggcaacaattttggcgggaggtggtggagacttccctctagggggcattcctcaagcattccagagcaggctggcttcattcacgctgctggtcactatctagcctctgcttgatatccaggttgggattgagacccgaaggccctctgcccactggctgctagcctaccttgcgacattgtgggtgatctcttgaacctccttcattagcctatattgtgcgacatcacgacacagctccacgttcggccggtgtgtcctggtctccaagcgcgtatgagccaccttggctggcccttcttggtcaaggatggccttttcaagagctgtaatatttttctcctgggaagcaatctcttccatgaccttacaaaaaggattagagtaggtgaggccaagctgtgctcctcaaaactcaacagctgacagcagatgggttgtgatcatgtaagttaggaagagggaacctcagatttcttcttaagcagcatgccagagtctgatctctcttccctaaagcagtgattgctggtgggcaaggtcacataagacttaaaaccttatggactcaagggacaggacgggccattgtcacctcatctacccacaggagatgccctcagcaaaggcctggccagagtggggatctcactactgctcaaagctgcctgctcaccttggtacagggtacctttgtatcatgagcagaaagctgcctatttcctcaccactcctatcctgctagcaccagctctgtcctctggaagcctgaggaaagaaggagcagttgggtctgagtttggttgttatttttgtgagtgactttatgcacagaaaaagactacttttaggccagatgtggtggctcacagctgtaatcacagcactttgggaggctgaggagggaagatcacgaggttaggagttcgagaccagcctgccaacacggtgaaacccccaactctactaaaaatacaaaaattagccgggtgttgtggcacacacctgtaatcccagatactcaggaggctgaggcaggagaattgcttgaacccaggaggcggaggttgcagtgagccaagatcgtgccactgcactccagcttgggggacagagtgagactccgcctcagaaaaaaaagaaaagaaaagaaaaagactacttttaagttacttggttttaacaaaattaatatttaactggtttaaaatatatttcttcattaagcattttttttaaaacttgtacatctacttttgcaatatacacaaaagtagatagactaaggaacctcgcatagtcatcagcagtttcagcaatgagcagtatgtggccagtcttgcttcatctatactcctgtccatcagcttagttattttaaaactaatcccagatattatgtccttttagttaaatatttcacttaaatatttgagtgtgtatttctaagcataggattctttattttcttttgacaaaaccacaatacctttatcacaccaaaaaagagacaaaagacttattctttaacattataataatatttagtgatcacatttcaccaattgttccatatattttggtagagttggtttgtccaaattacatcccaatgaggtccagaaattgcacttggctttcttaagcttctatttaaacacttcttaaggttttcataagtccggttcacagatatactatttttaaatttagcagatattagcaattactttaagctgctttcgactaataattgctcctacttcaaacttacttaaagtcctttgaatatttatttaaagcagcatttataaatttgatacataactttttaaaatatttgaattatcttttttttttggcctggaattttatttatttatttttttaaggtgaattttatttttttatttttttattatactttaagttttagggtacatgtgcacaacgtgcaggtttgttacatatgtatacatgtgccatgttggtgtgctgcacccattaactcatcatttagcattagttatatctcctaatgctatccctcccccctcccccaaccccacaacaggccctggtgtgtgatgttccccttcctgtgtccatgtgttctcattgttcagttcccacctatgagtgagaacatgcggtgtttggttttttgtctttgcgatagtttgctgagaatgatggtttagaacttcatccatgtccctgcaatggctgcatagtattccatggtgtatatgtgccacattttcttaatccattctatcgttgttggacatttgggttggttccaagtctttgctattgtgaatagtgccacaataaacatacgtgtgcatgtgtccttatagcagcattatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtctctcactgtggttttgatttgcatttctctgatggccagtgatgacgagcattttttcgtgtgtcttttggctgcataaatatcttcttttgagaagtgtctgttcatatcctttgcccactttttaatggggttgtttgtttttttcttgtaaatttgttggagttcattctagattctggatattagccctttgtcagatgagtagactgcaaaaattttcttccattctgcaggttgcctgtttactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacatgtaagtctttaatccactttgaattgatttttgtataaggtgtaaggaagggatccagtttcagctttctacatatggctagccagttttcccagcaccatttattaaatagggaatcctttccccatttcttgtttttgtcaggtttgtcaaagatcagatggttgtagatatgcggcagtatttctgagggctctgttctgttccattggtctacatctctgttttggtacaagtaccatgctgttttggttactggagccttgtagtatagtttgaagtcaggtagcgtgatgcctccagctttgttcttttggcttaggattgacttggcaatgccagcccttttttggttccatatggactttaaagtagttttttccaattcagtgaagaaagtcattggtagcttgatggggatggcattgaatctataaattaccttgggcagtatggccattttcataatattgattcttcctacccatgagcatggaatgttcttccatttgtttgtatcctcttttatttcattgagcagtggtttgtagttctccttgaagaggtccttcacatcccttgtaaattggattcctaggtattttattctctttgaagcaattgtgaatgggagttcactcatgatttggctctctgtttgtctgttattggtgtatacgaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacattatgttgaataggagtggtgagagagggcatccctgtcttgtgccagttttcaaagggaatgtttccagtgtttgcccattcagtatgatattggctgtgggtttcttatagatagctcttattattttgagatatgtcccatcaatacctaatttattgagagtttttagcatgaagcgttgttgaattttgtcaaaggccttttctgcatctattgagataatcatatggtttttgtcattggttctgtttatatgctggattatgtttattgatttgcatatgttgaaccagccttgcatcccagggatgaagcccacttgatcatggtggataagctttttgatgtgctgctggattcagtttgccagtattttattgaggatttttgcatcaatgttcatcagggatattggtctaaaattctctctttttttgttgtgtctctgcctggctttggtatcaggatggtgctggcctcataaaatgagttagggaggattccatctttttctattgattggaatagtttcagaaggaatgataccagctcctccttgtacctctggtagaattcggctgggaatccgtatggtcctggaattttttttggttggtaagctattaactattgcctcaatttcagagcctgttattggtctattcagagattcaacttcttcctggtttagtcttgggagggtttatgtgtcgaggagtttatccatgtcttctagattttctagtttatttgtgtagaggtgtttatagtattctctgctggtaatttgtatttctgtgggatcggtggtgatatcccccttatcattttttattgcttctatttgattcttctctcttttcttctttattcatcttgctagcggtctatcaattttgttgatcttttcaaaaaaccagctcctggattcattgattttttttgaagggttttttgtgtctctatttccttcagttctgctctgatcttagttatttcttgccttctgctagcttttgaatgtgtttgctcttgcttctctagttcttctaattgtgatgttagggtgtaaattttagatctttcctgctttctcttgtgggcatttagtgctataaaattccctctacacactgcttcgaatgtgtcccagagattctggtatgttgtgtctttgttctcattggtttcaaagaacatctttatttctgtcttcattttgttatgtacccagtagtcattcaggagcaggttgttcagtttccatgtagttgagtggttttgagtgagtttcttaatcctgagttctagtttgattgcactgtggtctgagagacagtttgttatgatgtcctttcttttacatttgctgaggagtgctttacttccaactttgtggtcaattttggaataagtgcggtgtggtgctgagaagaatgtatattctgttgatttggggtggagagttctgtagatgtctattaggtctgcttggtgcagagctgagttcaattcctggatatccttgttaactttctgtctcgttgatctgtctaatgttgacagtggggtggtaaagtctcccattattattgtgtgggagtctaagtctctttgtaggtctctaaggacttgctttatgaatctgggtgctcctgtattgactgcatatatatttaggatagttagctcttcttgttgaattgatccctttaccattatgtaatgccctcctttgtctcttttgatctttgttggtttaaagtctgttttatcagagactaggattgcaacccctgcctttttttgttttccatttgcttggtagatcttcttccatccctttattttgagcctatgtgtgtctctgcacatgagatgggtttcctgaatacagcacactgatgggtcttgactctttatccaatttgccagtctgagtcttttaattggagcatttagcccatttacatttaaggttaatattgttatgtgtgaatttgatcctgtcattatgatgttagctgattattttgctcatgagttgatgcagtttcttcctagcgtcgatggtctttacaatttggcatgtttttgcagcggctggtaccagttgttcctttccatgtttagtgcttccttcaggagctcttgcaaggcaggcctgatggtgacaaaatctctcagcatttgcttgtctgtaaaggattttatttttccttcacttataatgcttagtttggctggatatgaaattctgggttgaaatttcttttctttaagaatgttgaatatcggcccccactctcttctggcttgtagagtttctgctgagagatcagctgttagtctgatgggcttccctttgtgggtaacccaacctttctctctggctgcccttaacattttttccttcatttcaactttggtgaatctgacaattatgtgtcttggagttgctcttctcaaggagtatctttgtggcattctctgtatttcctgaatttgaatgttggcctgccttgctagattggggaagttctcctggataatatactgcagagtgttttccaacttggttccattctccccatcactttcaggtacaccaatcagatgtagatttggtcttttcacatagtcccatatttcttggaggctttgttcgtttcttttcattcttttttctctaaacttctcttctcacttaatttcattcatttgatcttccatcactgataccctttcttccagttgatcgaattggctactgaggcttgtgcattcgtcacgtagttctcgtgccttggttttcagctccatcaggtcctttaaggacttctctgcattggttattctagttagccattcatctaattttttttcaaggtttttaacttctttgccatgggttcgaacttcctcctttagctcagagtagtttgatcatctgaagccttcttctctcaacttgtcaaagtcattctccattaagctttgttccattgctggtgaggagctgcattcctttggaggaggagaggcactctgatttttagagtttccagttttactgctctgttttttccccatctttgtggttttatctacctttggtctttgatgatggtgacgtacagatagggttttggtgtggatgtcctttctgtttgttagtttttcttctaacagtcaggaccctcagctgcagttctgttggagtttgctggaggtccactccaaaccctgtttgcctgggtatcagctgcggaggctgcagaacagcggatattggtgaacggcaaatgttgctgcctgattgttcctctggaagttttgtttcagaggagtacccagccgtgtgaggtgtcagtctgcccctactggggggtgcctcccagttaggctactcgggggtcagggacccacttgaggaggcagtctgtccgttctcagatctccagctgcatgctgggagaaccactactctcttcaaagctgtcggacagggacatttaagtctgcagaggattctgctgccttttgtttggcagtaccctcccccagaggtggagtctacagaggcaggcaggcctccttgagctgcagtgggctccacccagttcgagcttcagggctgctttgtttacctactcaagcctcagcaatgacaggcacctctccgccagcctggctgccaccttgcaatttgatctcagactgctgtgctagcagtgagcgaggctccgtgggtgtaggaccctccaagccatgtgcgggatataatctcctggtgtgccgtttgctaagaccgttgggaaagcgcagtattagggtggaagtgacctgattttccaggtgccatctgtcacccctttctttgactaggaaagggaattccctgaccccttgcacttcccgggtgaggcaatgcctcaccgtgcttcggcttatgcttggtgcgctgcacccactgtcctgcacccactttccgacactccccagtgagatgaacctggtacctcagttggaaacgcagaaatcacccatcttctgcgtcgctcacgctgggagctgtaggctggagctgttcctatttgaccatcttggctccacccctatttaaattatcttaacaaataagaccttctggagttcttaaatagatttgtcaatctaacaaattagtaaaaaaagatgatgctttaaattttcttaaatattcgaatgctatcttcaaatttaaagtttcaactaaaatcataaggctaaaacaattatttaattatatattttaaagaaatttttaaaaaacaggccaaatctcttaaattttacaaataccttaaccatccaaaatacatagatagcaatacacttataataaaactactactgctatgagtgagatcaagaatcagcaaactatggcctataaactaaatccagtctgcaacctgtttttgtacagactgtgaaataagattttttttaagtaataatcttcaatttctttagagctgttttaagtttaaagaaaaattgagcagaaagtagaattcccatatgctttctccccccatccaggttttccttattattagcatcttccattagtgtggtacacttgttattaatacaattgatgagccaatattgatatattattattaactaaagtccacaatttacattagggttcactctttgtgttgtacaatctatgagttttgtttgtttgtttgcttttgttttttatggagtcttactctgtcacccaggctggatagcaatggcatgatctcagctcactgcaacctctgcctcctaggttcaagcaattctcctgcctcagcctcccaaatagctgggattacaggcaggcgccaccacagccagctaatttttgtatttttagtagagacagggtttcgctgtgttggccaagctggtcttgaacctctgacctcaggtgatccacccgcctcagcctcccaaagtgctaggattacaggcatgagccaccgcgcccagccgattctatgggttttgacagatgtataactacatgtatccactttacaatatcatacagaatatgttttgctgccctagaacacccctgggctgcttccattgatccttccttccttcttccacccacccaaacccctgacaaccgctgatctttttcatctccatagttttgtcttttctagaatgtcatatagttggacttatgattcatatcatacagtatgagtttcaaatcagcttctttaacttagcaatacgcatttaaagttcctctatgtcttttcatggcttgatagctcacgcctttttagtgctgaataatatttcattgtctggatgtaccacagtttatccatccattcacctatcttagctgtttgcaagttttggcaatcatgaataaagctgctatagacattcatacacaggtttttgtatgaacataagttttcagcccatctgggcaaataccaaggaaggagattgctgaatcctaagagtatatgtttagccttgtaagaaactgccaccctctcttccaaaggggctgtaccattttgcattctcatcatcaatgaatgagagttcctgttgctccacatcctcaccagcatttgggggtgtcagtgctttggattttctgtaggtgccgaggtgttgttgttttaatttgcaattccctaatgacataggatgttgagcatcttttcgtatgcttacttgccctctgtatatctgtattggtgaggtgtctgtttagagcttttgttcatttttgtagttggtctgttttcccattgttgaattttaagagttctttgtacgttttggataacaattctttatcagatatgtattttgcaagtattttatcccagtgtgtggtttgtcttttcattgtcttagggatttttaaattttaaatggttggggagaaaaataaaagcagaatatcgtcatgtgaaaattacataaaattatatttttaatgcccataaataaagctgtattgaaacacagccatgcttattcatttattattgcttctgaactaccatggcagaattaagtcatggtgacacactgtatgtgatgttctcacggctttgcactgttgcccagagcactataaatcacagtgacatgtatataacttgacagttttccaaccatgtatcaccatacagtgacatcttactattttatttttatgcattttttttgagatggagtttcgctcttattgcccaggctggagcacaatggcacaatctcggctcactgcaacctctgtctcccaggttcaagcgattctcctgcctcagcctcccgagtagctgtgattacaggcgcctgccaccacaccaggctaattttttgtatttttagtagagacagggtttcaccctgttgcccaggctagtcgtgaactcctgacctctcaggtgatccacccaccttggcctcccaaagtgctgggattacaggcgtgagccaccacgcccggccgtgacatcttattttattgttttattaccagtatgtctttgtttctgctccttagcctcttctcttcctctcttctcttctcagtgctctcccatcctcccttctgtcctatctcagatccatctttcaaggcctatactaagttcttattccaccaggaagtctctggattattccttggctatcatcatcatcatcatcatcatcaatcaactatttttattatttatatgtatgatattatatgttaatcatatatgcaaaatgtgtgtgtgtgtgtgtgtgtgtgtgtgaaatgtatacatgccaggcactgttctaaatattttatatgagttgtctaacttaaccctggctggggaagactattgtttctccccattttatcaaggaggaaactaaggaacaggggagttcagggtctccctaaggtcacacagcaagtgttgaagccacagttcaaacccaagatgtctggctctgacgtctacccatttccactaggctcgtctacctctcggtttgctgaatattgcagtttcaccctcgatgatactctggtttctccagcacatcacagaaataaatcttgtccacaactggactctgagctctgggagggagtgttcaggatgtggcaacaggacagggattcaggggctgagaaggcctgggctccactcccaccgtgccgccttggggcccttcccctctctgtttcagcttcaccagcagtaaagcgtagggtgggctgacagtggcctgctgaaatgtgtagcttgaaatccaccaatgtgggagtatttgtactacagacatcgacaaattctacaggaaggaccctaatctgtagaatttgccgatatctgtggtacaaatgctcccactttgtatttgcagtacaaatactaaccccctctgatatggtttggctctgtgtccccacccaaatctcatcttgcattgtaatccccacatgttgagggaggaatctggtgggaggtaattggatcatgggggcagcttcccccatgctgttctcatgatagtgagagagttctcatgagatctgatggttttaaaagtggcagtttcccctgcactctttctgtctcctgctgccttgtgaagaaggtgctggcttctccttcaccttctgccacgactgtaagtttcctgaggcctccccagccatgtggaactgtaagtcaattaaacctctttcctttataaattacccagtcttgggtagctctttacggtggtgtgaaagtgactaaaacaccctctgagagccagtttaccagcgcaacactgtataaccaggagaaacgaccagctagagtcctaaagctccaaccgggtttggaaaaactggctgcatcaactcctgtaacttcagagtcctaaagggcacgtgagagcatgtagtccatttccgtacttcacatacggaggagtggcaactggagtgggaagacagccaggcacaaagctgcaaccagcccctaagcctcccgtctcctgcctcagggttctgttctctgcatttctgttctctgcagcagtgagtgacaatggaggcccagagtggggcaaagtcccgctccagtccccaaaaatgcaaagcctgctgctaagcttgagagatatgaatgacccttacccacgagttaacccaatatcccaagcccagaagtctagcggtctggcccagggggcattcttgttttccatggtgaaagctcctgaatctgctcttcttccatgctccctcaagggacctcaccttggccagatgatcagccagcttgtccctggcatcctttgtatccttcagcccattcttgaatgccgtgtccaccacatcacactgcttgcgcagatcattggctgtctgggacaggattcgatccaccagggctttcagcatcagggagttgttccgctgcttgtcagccttctccacattggtgctggagaagtccaaccagtcttccagactcacggagctgaaacagacctcacgctttcattcacagcatatttggggtggggaagggggttgggagagagggacgagctacaccttcccctcataagaaccacctagaatgttaccctatctctaggcagagcaaatagtggtctgtcagtatcaatagctgtcactttgggcaacctccctactctggcattgggctggcaccttatagacattatctcatttaatcctcatgatggccaagtgagctaacttttctaatccccattttacagatgagggaaactgagctcagaaaaatgaagtaacttgggtgagattgctcagctagagataatttgagcatcaaaataatactaatgtaatagattacactgaataaaatagaaaccatccatctatacagatttaaataaaaaagtgaataaattactcgtttgaagaggaactatcttctggaacgacactgatgaacttcaaaataatgttaattggaagaaaccagacacacacacacacacacacacacacacacacacacacacatatctagtatataatgctgtttaatgaaaagcaggcaaaaccaacctattacaagtcaggaaagttattaccttcaggatggagggagggactattgattggaagaggacaggatgatagggatggtgataatgttttctttcttgacctggtggtgatatgaggctttgttcagtttgtgattagaagcagcctctgagatggcacttagtgatcccccctcctggtattcatgcctttgtgtaatcccctcgccttgagtatgggatgaatttattgacttccttctcacaaatagaaggatgtcacttctgggattaggatataaaaaagactgtggcttctgtcatccgttctctctctctctctctctctctctctctctcggatcactcattatgggagaaaccagttgccatgtcatgggacatccccatggtgaaattcacaaggcaaggaaccaaggcccaccatcacccacaatcagcttggaattggaccccacccgggtcaagccttcagatggattgcaaccccagcagctggcttgactacagcctcagaagacatcaagcctggggcacccagttgaacagggcctggtttccccacccaaggaaccatgagataatacatgtttattgtcttaagctgcaaagttttgggataatttagtatacagcaaaagataactaacacaatgagaatgcttcaaacttgtgcacttttctatatgtatgttttatttcaaaaagaaggttttaaaaattaaagtgagttaggctgtgatataatgttaaccgaaaaatgcaaattagatgtcacagaaaaggtacatagtataatctcatttttataaactaaacaaagtttaccgtatgtgtgtgagtgcacatgtacatatgtttgtatgaacatgcagctaacaccagttatctcagtggatgtaaaaacagaaaggggaggccaggggcggtggctcacgcctgtaatcccagcactttgggaggccgaggcgggcagatcacgaggtcaggagattgagaccatcctggctaacttggtgaaaccccatctctactaaaaatacaaaaaattagccaggcatggtggcgggcgcctgtagtcccagctacttgggaggctgagacaggagaatggcgtgaacccgggagacggagcttgcagtgaggtgagatcgcgccactgcactccagcctaagtgacagagcaagactctgtctcaaaaaaaaaagggggggggaaattcacttgctcttcctacatttttagattattttacttgttaaaaacatgtatagatgaaggaataaaatgttttattctttaaaggtttaaaggttttatgtcagactttcttagttagtgagcctaacctggagaatcaggagcctctgggcccaatgtcaaggtcaccattcaatgctgcctttgccccaagcccaccacttccaagctctcagccagctgcaaggacgagccgctaggtcttgcctatctgagaagcactgggtcacccgcgaggaggaagacggcaaggcccactcactttggctcaatcctcacggcgttctcagaatatctgatgtttggtgagttgttgttgagcgagaagcagatatcatctatggtcagggccacaaacttgtccttcaaatccttctcaagattgtacttggcagagcggttcatcctgaagggagaaagtaaactgggtttctgcctctggagtgcccaggtggcacccacgtcctcagagaggtcctggaaagtgaagctgcagctaggtctggtgcaggatgatggtactgccccccacccatcaccccaacactcatgcgtataccatttgatgcccggtgacaaatcaacgtaaccaaatgtggacttggagattctcccttctactgttacattttccagtgtcaccattgcagcctactatgtgtgaggggtcagcctcaccagtgggttccagcgtcctccagtttataaccagggtgaaatccagctccagccccacccttaccagagggcggctgccatgtatgagggatgtggccagctcttaccctgagtgctggggcaatctggggacacaaagtgggagcgggaatgttgaacccctttctttctgtgccatggagcccagcttttgtggacactgccttttctcaaaattcccagtggagatttggagggcaggccgaagagtcataccgaatctgctcggaagcctcctccaaggtacgggtcagcagagccataatgccctggatgatctcagcctcctttatcagctcatgctccactgtgtcgtgcaccaggtcaatgccaatgcgcttctccctggcagggggaaaggcagccagtcagccaacacgtgcaacatgaggtgactcaacattggctaatggctgcacactcagaactatctgcacgactgatttgagtgtcacccgatccatccgatgacacagtgggtgacagatattagttggtgtctatgtgacttcaaaatatccaaacacaatgaagaaaaattgattgatgactggtcacttggtctgaaacatgccaaatggacttttttttctctctctctttttcttttctttgtattttttttaaattatactttaagttctagggtacatgtgcacaacgtgcaggtttgatacataggtatacatgtgccacattggtttgctgcacccatcaactcatcatttatattatgtatttctcctaatgctatccctcccccagccccccacaccctgacaggccccggtgtgtgatgttccctgccctttgtctaagtgttctcattgttcaattcccacctatgagtgagaacatgcagtgtttggttttctgtccttgtgatagtttgcgcagaatgatggtctccagctgcatccatgtccctgcaaaggacatgaactcttccttttttatggctgcatagtattccatggtgtatatgtgccacattttcttaatctagtctattactgatggacatttgggttggttccaagtctttgctattgtgaatagtgccacaataaacaaacgtgtgcatatgtctttatagtagcatgatttataatcctttgggtatatacccagtaatgggattgctgggtcaaatggtaattctagttctagatccttgaggaatcaccacactgtcttccacaatggttgcactaatttaccctcccaccaacagtgtaaaagcattcctatttctccacatcctctccagcatctgttgtttcctgactttttaatggttgccattctaactagcatgagatggtatctcattgtggttttgatttgcagccagatggactttttttcccaagaagaggaaagttttaaataataataataaattcaaagacttgtttccttccttgatcctcattcagtgtttagacaaacaattgaacatagaaagatgttttagggtgggcgcagtgactcacgcctgtaatcccagcattttgggaggctgaggcaggtggatcgcctgaggtcgggagttggagaccagcctggccaacatggagaaaccccgtctctactaaaaacacaaaattagccaagagtggtggtgcatgcctgtaatcctagctactcaggaggctgaggcaggagaatcatttgaacccgggaggtggaggtttcggtgggccgagattgcaccattccactccagcctgggcaacaagagcgaaactccatctcaaaaaaaattttaaaagatgtttatagtaataataactattaataataataacaccaatagtaatattgcctctgccagtgagcacttactccatgacaggcattgtgctgagctttattaatatataaacattctttcttagccctttcaagtacagatggggaaactgagtttcagagagactaagtgatctacccagtgtcacagaactgtgtgccacatgtgcttctagccaagatgccatcctcctcccaaactgaccctgctacacaacgttttgctctttttcaacctgcatgatagtgcttggaaaggaggttcccctactcactagctgggtgcccttagccactatataacctacctgtgccttggtttccttttctgtaaaatgggggtaattattagtacttcataggattgtggcacactacaaatgagctataaaagcataagctacagtacctggcacatagtacatgctcagtaaacttagcagcctctacgttatcattatcctcaggcttagacttgagccaactgggtgttgagctctttgatgagctgctatttctctttgcttcatagatttctaaatctggctggggagactgctgcctggttcctgcaacgggtcctgtttaagcttatggaaggaacagggctttccaggaagacaggggcatggtgcatttgagaaactgcaagtagctccacacacctaagcacatcccactactggggacaagatatggatccagagaggtcactgggggccctatcatgatgaaccttggtttgctaagctaagaagcttaaaatttatcttgaagccattggggtttgaaggattctaagcatggcggtgaccgggaaaaatctgcatttggaaaagttcactcaacagccagtgtgcagggtgcactagattataggggactatgctaacagcaagaagacctgttagggcactccagctaggtctgcggcagaacccaggtctggaaaccagcatcaccccagagtagaaaggatcattctattcactggatttataggagggaaataataataaaaagcactatgttcctatagtgctgtctggattacaaagtgcttccgtgtggctctgcatgggagagacatactgtcccctgggagctgtagtgtctgttctcaccttcttccttggcaacagaacccctggttttttggctgagcacctggctgcccaaagtaaaaccaatcatttcccagcatctgttggtgtggccatgtgattaagttctgtcaataggatgcaaatagaaatgatgaatgccagaccccacttactcctacttgctggaatgtagacataatggctggagctccagctgccaacttaaaccacaaggtaacattaggagtgaaagccatgtgcagtagaacaagaagatagaaaaagcctggaaccctaaaactgtggcccaccattccaaccctggactgactatctctagactctttgaatgtaagagagaaagaaatcgttttctttaaattcaatattattttaaagttttctgctacccacagccaaacctagtcctaacatatttgagttgagttagtcaagagcagagttgaggcatgaaccaagtccagtgccccttgcactgcccagcaccaggggcatgctgggataacttcaggctctaaaagaacacctgctcaagtgctgtgttctaactcaccatcgcacacagccggcatttactacccagcatctcatttgtcacaacacatgaatcatttgagggaccttcgctcctacctgtatgccaggcatgtctcagtgatgtgcaagggctctttcaaggtctccagggctttttccaatctgatcttatatatgagtagatcatcagttacattcacaagctgctcaagtttgtcatctaactccttcttccagaactggacttcctcgagtctctgttctgaagcacacggggaagttacaccagggctaatctatcccaaggtagccaacatttgaattagaaacttgaagactgttgtaaaaccacctgtgacatgctcttttcctcttagtgctgtgctatttggggcatcttttcatctttttaaatgtttatttgcaggaaggaaggaagatatattttcttacagtccacatcagatttatcattctacacccactagttcttcagtgcccactgtttttaataacttttaattttatcaaagatataaatgtgtgttgttagaaaagtcaaatagtatcacaaagaattaaaactctctgacctgtccccatccatttgagacggagtctcactgtgtcacccaggctggagtgcagtggtgcaatctctgctcactgcaagctctgcctcccaggttcatgccattctcctgtctcaacctcccgagtagctgtgactacaggcatccgccaccacacccggctaattttttgtattttttagtagagactgggtttcaccatgttagccaggatggtctcgatctcctgacctcgtgatccgcctgcctcggcctcccaaagtgctgggattacaggtgtcagccactgcgccaggccccttatcacttctgacatttgcttatactgctattcactcattatcagttttgatattatatgttgatttcctgtgatgaaagataatgatttgctcttaaccaactcacacaacatacttccgtctcccaatatagttgtatcaccattttgttaaacaataaataagtaaacttactatttatttacattttgtaaatatataaatgttatttacacctgagccctatcatacactgtaataaatttcttttcttacaaaattttctgttttggggaggagttaaaatggcatttttgcttcactttcttttttaaatgataattaaaggcagatttattagtcaccatgagtaaaaaatgactgattatactaggaaaacaattaaatatatatatatttaattgataatgagtagttcagcatttgaatcttaaagtcataatgtactggttgtagtgtcagtttccacttctgtaagctgactctgttttaaaaaaaaatgttattgtatatatttgaggtttacaacatgacattatgagatagtaaaatgggtagcatagtgattccttcagtttctttatattattaattttttctcaatatgccctcaatatattccaacccatcaagtaagctatcaattttctttcctccttggagatgtctctcctagagcatcttctcctcctgctggatgagttgctctctagtttgctgtgtagctgtcatcctatgactttgcttccaggaatccccttcactcttctcctgttgctgtcccgtttcctggattgtatttcttcctcttccttgatttactctttcagtatgctgaagcatatccttcagtaacttcctaagaaatggatgcatgtgaggtaaagtttttgaaaacctgcaagtctgcaaatgtctttattctaccctcgacatttcattctatttggctgtgccctgagttacagtttgtaactcttttttatttggaattgtgattgtgtccctccatttccttctaatttccagagtttctgttgaaaagtctgatgccactctgattcctgattctttgtatatgacctgttttttccactctgaaaaattttagtaatctattttcctagggtcctgaaatttcacactggtgtcaaacttatttaattgttgtgtcacatgccagatataccctttgatatggtttggctctgtgtccccacccaaatctcatctccagctgttatcctcacctgttgagggaaggacttggtgggagataattggatcattgaggcagtttcccccatgctgctctcctgatagtgagtgagctctcttgagatctgatagttttataagggtctcttcccccttcattttctcttctctctcctgccaccatgtgaagaaggtccttgttttctcttagccttccaccatgattataagtttcctgaggtctccctagccatgtggaactgtgggtcgattaaacctctttcctttataaattatccagtctcaggtatttctttatagcagtgtgaaaattgactgatacagagaattagtactggaagtgaggcactgctataaagataacctggaaatgtggtagtgactttggagctgggttaacaggcagaggttgggacagtgtggagggctcagaagaagacagaaagttttgggaaagtttggaacttcctagagacttgttgaatggtttcgatcaaaatgttgacagtgatatggacaatgaagtcctgctgaggtagtctcagatggagataaggaacttattgggaactgaagcaaagttcactcttcttatgctttagcaaagagactggcagcattttgcccctgccctagagatctgtggaactttgaatttgagagagattatctgaaattggaacttatgtttaaaagggatgctctgcttcccccattttgggggaaggaattcaagccagctacagaaatttgcataagtaacaagaagccgaatgctaattgccaagacaatggggaaaatgtctccagggcatgtcagagatcttcacagcagcccctctcatcacagaccaagaggcctaggagaaaaaaatgcttcctgggccaggcctagggccctgcttcctcatcttcttctttttagagacaggatctcactctgtcacccaggctggagtgcagtggcacaaccatagctcactgtaactttgaactcctgggctcaggagatcctcccacctcagcctcctgggtagctgagactacaggtacacaccaccacacccacctaattttcttatttttgtagaggcaagggtctctctgtgttgccaaggctggtctcaaactcctggtctcaactgatcttcctattttggcttcccaaagtgctgggattccaggtgtgagccaccataacttctccattttctctatgctctttctgaaactcctattagttattgagcctcccagactgatcctctaattttcttgtcttttctttgctgttattttgttgtccttttttcccactttctggatattctcaacacttcttttgatttttaagatttttctgctcttatattcttaatttctaagaacgcttgttctccaaatgttctcttttttaaagactcctctgcatgttccaaggatgcaatctcttctctaaattcttgatggatttgatagtgtatgtcttctttttctctatgcactatctgtctcctgagtttctgtgtctttgattatttgttttggtgtctgccatgttattggctttcctcaattatttggtgatcatctgatttagactgagatgctaaagtgctacctggaaatgctgtctagagggacagtgcttgtcaaccagaatgctttatcatacagagtgatcagttgagaccctggcatctcacaggagaatcctcaaatgttaatatttatggatctttcctttcggggccagttactttctactttctccacagaaaagtcctccagtctcctgtctgagggtagaagcctggctaccagtgtcttaggaaacagctggaagaattactatgtagacatagaaatgaatgaatcaccaagtagacattcattgaaccttttaacctttaaccttctgctggggtgagggagagccagagtgaagaggaagctctttataaagactttcaaccaatcttgtttctggttctatcctgaccctccagcttcagaagtaactggatgcatccagttttgagcattacaagatttctgcagcatgaatcagctggcttcttattgttctctacccagcctgattttctgcagtccctaggtttgttaccagctgacctttgctttctaaaatcttgatttcattatttgtctactgttgcttcctctctaactctctgtgtgtgtgtatgtgtgcacacgcatgtgcttgcctgtgtatgcatctcaatctctctcatgcttggggcatagctttattattattttgttagctttactgttattaattctttactgctattttgttggaattctaaaaggaagagaagacaaatgcatgtgcttaatccaccatgtagatgggcatcttcccattgacaccttgtaactgattttcacctctactgtgtaccctccactatcctactggacatctcttatctcaaaggtcaccaataatctttaagtcactagtccaaatttattttggctcagctctcagtctcttagacatttagacaaccactgatacaatagaagacttcctcgcctgtgaaacctcatcctttttttttttttttttttttttttgagacagagtctcactctttcacccaggccggactgcagtggcgctatctcggctcactgcaagctccgcctcccaggttcacaccattctcctgcctcagcctcccaagtagctgggactacaggtgcccaccaccatgcctggctaattttttgtatttttagtagagacgaggtctcaccgtgttagccaggatggtcttgatctcctgatctcgtgatctgcccacatcggcctcccaaagtgctgggattacaggcgtgagccactgcgcccagccaaaacctcatcttttggctttcataaccttggtctcatctgtttattcttccacctgaacttatgttcctcagctcttctcttggtcctcttcaactcatgtgcccttttcttctcttttgatacattctttgggtagtctaatctacccttatggctccccttacccatctttatgtgatttctggcgttacttcttaaattctaacaggctacccaatgaactgaacattccaaaatcaaggtcttcctcaggcttggccctgcttcatctccctctcatcttcatcatgctgctcttcctcacgtactctacacattaacttggacctctctactcattccccataaatgtcccactcatcctgcctttattattttgtccaagctatctccttgacttttgttgttaaaattcattcataaatccaacatacatattatcgagcaccttttctctccatctttactgccattgccttcatctaggccagcaacttacaataattttagttacttgcctttttacttgtgttgtgtctcttttacatagtagaatgtatcagtctttttcaattttatactcctaagcatctagcacagggtcagacctatttgaagagtgaatgaattaatgaatgaacgagctctgatcccattaaccaggatagggaactacagaagcagaagcaagttttgaaggacaatgatgagttcatcttgggacatacttattttgaggtgcctgaaggaatctaggtggcaatatatagcaagtagttctctattttcccaaagagttctcatgagaaattagagctgaagatttctatttgcaaaccaataacacaaagaaaatagtgataaaatttctaatgaggtcatcaagaaagattgcttagagagaagagaagaaaaagctaagaagatgaagaacaaaacgctaaagaacaccaataggaaatgaatggggaaagaagcatccataatagagaagaggaagaaatggccagagagaaaggaaattttaatcaggaaaaatttgtgccatagaattctaaaagtaactggacacatccagttttgagcatccagtattgtagagagatcaagttggatgaagactaagtgatcattagattggaaaattgagtagtcattggatgtgaccaattggaagtgatgtgccctctcctccaatctgacggtgctttattggtgcctcttatgggatgaagcacaccgtatcctgggtatcctgtactggactcatctctactttcagactgcaagctccccaagggcaaacaccagtctggtgtgtctatatcatcagcaccagcacaggtacttgcaagttatttttaactttttattgaaatatcaaaaacctatagaagagtacacatatcataaaattcaatgtattttcatagtgaacacacacatataagacccagctcaagaaacagaatataactggcatcccaggaggtctctcatgaccccttccagttctatcattccacacaccaaggtatagattcatttttcattttatttggtttgttttactttacataaatagaataatatggcatgtactcatctgtgtgtcatttattgtactcagcatcttactaagtttgtaagattcatcagtagtgttgtatatagctgtaggccactcattctctttgctgtgaggtatagcatatttatccatcctactgttgataagcatgtgggtagtttccagttggggccattacaaatggccctcctttggccattgcagcatatatctttggtaaacatatattcccgtatgataaaactctaaaggtagaataaccaggtgaaaagtatgcatgtcttcaactgtagtcaatactgccaaagctttccaaagtgattacagcaatttgtatttccaccagcagaatatgacagtaacagttgctccacatcctctttcctctcctttcttcttgttctcttccttctttttaattgtagccattccatggctgtataatggcatctcaacttgattttaatttgtatgtccctgatgactcataaaattagagcacctctttacatgttcgtcggctgtttgaatgtcctcgcttgtaaggtgtctgtcaagatttgtccatttgtttattgagttatctgcctttttcttttgtattcttaaaagttatttatatattttggatatggatttgtcagatatatatattgcaaatatcttttcctactctttagattgctgttcagccttttgatgaggtatttttgttaaacaaaagttcttcattttaatatagtctaatttattgtttttcttttctatgaatgcttcttttcaggcctgcttaagaataagaaatctttgccttcgacaagtcataaagatcataaatatattctcccataagtgtcattgtttcacctttcccatttagatatgcactccacttagatttgcagatagatagatagatagatagatagatagatagatagatagatagatagataatacgaggtaggggttgggattattattattttttttttttttgcgacggagtcttgctctgtcacccaggctggagtgcagtggcactatctcacgtcactgcaagttccgcctcctgagttcacgccattctcctgcctcagcctcccgagtagctgggactacaggcacccgccaccacgcccagctaatttttagtgtttttagtagagatggagtttcaccatgctagccaggatggtctcgctgtcctgacctcgtgatctgcccgccttggcctcccaaagtgctgtgattacaggtgtaagccacggcgcctggccaagatatcattttttatatgaatatctaattgggcaattcattgaaaaggctttcttttgcccattacactgtagtgttgctttgtcatactcagatgaatgaatgtatgtgggtttgtttctggactctgccatgtttcattggtcaacaggtctatcctcacttatactttgctgtctcaattaccatagctttgtcacagctctcagtacctacggtagaagtcttccaactgtgttcttctttaagatagttgtgccaatttttttttttttttttttttgagatggagtctcgctcttgtcgcccgggctggagtgcagtggcgtgatctcggctcactgcaacctccgcctcccgggttcaagcgattctcctacctcagcctcctgagtagctgggattacaggcacccaccaccatgcccagctaatttttttgtacttttagtagagacagggtttcaccatgttggccaggctggtcttgaactcctgacctcaggtgatccacccacctcggcctcccaaagtgctgggagccaggcatgagccaccacactcagcctcgtgcctattcttgaccttttgcatttccatatgaattttagaagcagtttgccaatttcaccataaaacctgctgagattttcattggcattgcattgaatatatagattaatttttgaagggaatcaacacttttaaatactaggttttccaatccattaactcataaatccctgcatttactaagaatttctttaatttcttgaaaaaatgatttttcagtgcaaaacacttgcacatcttttgctagatttattcctacatatttgatgcttttaatgcctaatggctaattttaaaatgattccatgaatcaatgaaggttcactttttccccgtatctactgaaacagagtattgtgaaaatgaataatgatttctcttcttttttttgttttgagacagagtctcaccctgtcacccaggctggagtgcagtggcacgatctcggctcactgcaacctccacctccttggttcaagcgattctcctgcctcagcctcctgagtaaccgggactacagatgcatgccaccatgccccactaattttttgtatttttagtaaagacagggtttcaccatgttagccaggatggtctcaatctcctgaccttgtgatccgcccacgttggcctcccaaagtgctggaatcacaggcgtgagccaccatgcccgggcgccttctcatttttaacacctacctatttgcacaattatttagaacaggcctatctacagggtggtatcaatgtaagggtcaacctattaggagagcctaacatctaacattgctgacctgaatgaaggtttcatttactggaaattagaaaactacagtcctcagaccaggtttgatccataaacgtgtttgttcagctggcccagtgttataaataaattaagtcagttaccaacatttaaaacgtgaataaattcctgctttccagattttcttgaaaaaatcggacaatcaggcaacactgggctcatgttctttcttggaagcaatgggttgaaactgagtagcagcttcctccttagatggggcacacgttctccaggtccccacagtccctactaaaccctaatgccttacattcaatccctatgctacctgcttggtccctatagatagtcgagttggttacccctggttaatccctttttggcatttagccgacgttggttgtttgttttgttttatgtttatttttgttttgattatttaaggatactatctttttttttaaatgtgctttcctgagatctttgctaaagaacgctaccttttaaatactgttttaggcagggtgcggtggctcgtgcctgtaatcccagactttgggaggctgaggcgggcggaccacctgaggtcaggagttcaagaccagcctggccaacatgatgaaaccccgtctctaccaaaaatacaaaaattagccgggtgtgatggtgcacgcctgtaatcccagctactcaggaggctgaggcaggagaagcgctcgaacctggaaggcagagattgcagtgagctgagattgtgccactgtactctggcctgtgtgatggagcgagactctgtctcaagaaatttaagtaaatactgttttaagtaaggaattgtcaagagaaaatgactccttttaagactcaagtaaatgttcttctctagaaaaacttttccaatttttcacatctactccgccccgtctttgttcccctaccccagcacctatctggttatacacctgtcccttggtatcctcagaggatttgttccagagtccctgacagacaccaaaatccatggatgctcaagtcttttatacaaaatggtgtagtgttttcatataacctatgcacatcttcccatatactttccttttctctttcttttctttctctttctttctttctttctctctttcattcttcctttctttttctttcttttttttttttttatgaaacagggtcttggtatatcacccagggtggtctctaactcctgggcttacaggatcctactgcctcagccctccaagtagctgggactaacagcacatgctaccacacccagccagtatactttaaatcatcttcagattacttataatacctaatacaatgcaaatactatgtaaatagctgttgaactgtattgtttttatttgtattctttaattgttgtaatcttttattgtttttttttcctaagtattttggacctacaactggctgaacccatggatacaaagggctgactgtattctgatgattaatttttgtatctttatcctcttcaagttagaagcccctaaaaagcagagattctgatcattccctgtgatatgcctagtgtgtagtacatagatgcccatagatgctcaataactgtgcatcaaatcaacaaataaatgaatgatgggtggctgaaaatcaggctgggttaccttgtgtctatcttagggcagtgaacttaaacatagaacctggagaatacacatgattttctctaatattcaaaaataatatgttgccacatctgaacatgacactatagctaaactcaacagcctcatcctagcatgttcacgaatatgccaagcatgttgtcttacctagtttcttgttcacatcgctttgagattttcttgtggtcttttcaatttcatccacaagcctctggctttctgcgaccaggcgttctgatcgggacctttgagcgtctgctctgtggtactggttcttgttagcaatgtgccactctgagggcaggaacttgggtggaggttgtaatagtttagccatttgaggtttccaaattcctgatcaaaagcagactcttttagattaaatgaaagcaatttgtccttttttatgataatttttattcaaggatgacatatatacggaaaattgcataaatcataatctgtacacaaaataaatctatctgtgtagccggcacccaaaccaagaaacaagcattaccagcatctctaacctcctcccagttactccacctcaagcccctcagggtaaccagtatcctgacttttaacactacaaattcgttttgctgtttttgaatttaacataaatggaataatacagtatgtattattctgtctctgacttctttagctcaacattatgtttgtaaaattcatccatattgtctatatgattgcagtttgttcgttctcgttgctgtgtaggtgccgttatatgaataaaatctagctgtcttttctactgtttatggatatttgggttgtttacactccagggccataatgagaatgctattaatagtctcatacatgtcttttggtgaacacgtgtatgcatttttataactcattagaattgttgggtcatggagtaatgttctgccaaacagatgagcccagagatgttttcttaaaaaaagaagaagaaaaagaagaggaagaagaaggaggaggaggaggaggaggaggaggaaatgtaacatgtgtaaactgacaactgggtattgaacttgttcaacacataaaagaatctgaaaacttccaggacaaagaaaaggagagaacaggaaggggaacaacacaggggaagccagctggcagaggctgtcggcagtggaaacgctaaaattacccatttcatcttcatacaactctgatggaccatgagaactgccttcctcagacagggctgaaatctgcccccactcccatctctaccctaaggtctgagtccctgctcttaggggcctctggatctctgaagccttcacatatataaggatgaaactagagtcagatcttgactaggctgagaacctcagcccacccagccccctcagacaacatggagtttctccgtttcttcctagcccagtcccttttatggcttctaccgaatttatctgagtgtggagcccagcatttaacccaaggctcctggataagtctgaatagcccccagagaggtggggacctaaattagggctcatcccaacgtcataaggatttggttaggcggggagggttgcgggtaggggtcggtggggtggggtcatggtttacttacctcagcgccacacagaaccactacgcaagctcgggatgggagcctccttaccccaactggagcttccagctcttgcagaacagagaggtaaac

SEQ ID NO: 1471 - DNA, 3458 bp, Homo sapiens
cacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttccctgctggctgtggtcggacccccactcccggctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctcccaccttctccccagatcactggcaagtggttttatatcgcatcggcctttcgaaacgaggagtacaataagtcggttcaggagatccaagcaaccttcttttacttcacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggctggctttaatctccaccagactcttgccccaggactgtgatgggcgattggccacttctcaataatcttcctgttttccttccgccttctgtttggctttagacaggaccagtgcatctataacaccacctacctgaatgtccagcgggaaaatgggaccatctccagatacggtgagggccagccctcaggcaggagggttcactgtgggaacagggcaggccagcataaggtgggggctggatgtagagccctggaggctttgggcacagagaaataaccactaacatttttgagctctaacgatgtgctcagaaacaactctaagaggacactgagagaattagaggaggaaaaagaagaacagagacctcaaatagtttccccaaggtcacacagcttataattagaactagaattggaactccaggctggcttcagatctgcctctctctcatgccctctttaagatcctttgcaaaccaatggtagaagcctgtatgttggagaggtggtaccttcaactatgtcccccatcaccgcagaggtggcacatggcagggagctgatggagctgaactgacaccatttagcatcccgagcctcctctctgggcctcattttcctcatctgtaaaacggagaaaggccctgacagccacggtctgtgtgaggctcctgagatctcatgtacagaaagtgcttggcgtggagctgggcatgcagcaggggctgggcacacggtggcccaaaggagccctgggccttcactgatgggctgtgtggccactgacacacctaggcctcctcacctgtaagacagacaccattgtgccatcccatgttctcacccagaggctccttttctcttccagtgggaggccaagagcatttcgctcacttgctgatcctcagggacaccaagacctacatgcttgcttttgacgtgaacgatgagaagaactgggggctgtctgtctatggtaggcatgcttagcagccccaaactcatgcccctctcaggcctcaccccccattcacccacccctgggctggcccctagaaccccagccctccctggcctcccgccgggccccaccatgtccccagtcagtctccttgctccccctgcagctgacaagccagagacgaccaaggagcaactgggagagttctacgaagctctcgactgcttgcgcattcccaagtcagatgtcgtgtacaccgattggaaaaaggtaaacgcaagggattggacagtgcccaccttgtccatggcccaacttgggcagccccagaggcccagagcaggagagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccacctccactccccactcatttttaatacccgtgcagtggggaattgatactgtggttttcaatgtcacccacactgcagcacggccacagtcaccatcccgatttttgctacaaatgaaaattactttataatgagctccttaacacttttctttaaacctgtgtttggaagacttgcgttggtgtggccctgtgcccaatacctgtgaaatcacagcaccgatgagctggttccaatttttaaaatatatacatgcagtacttccatgactattcaaagaaaaacaattccttccatttgccatctgagatgaccaccagtggtgtgaactacctcctgcccccatctgcagtcccaggatcctgggacagggcttatgaacacaaccactgtagtcagctcacctgatccacagcctggcacccccactgtctggctagggagcctcgaatgggtcccaaggccaccctgctcctcagttacatcatctgcatagtagtggtggttgtgaggaattcaggagctgcagcataagggctcggcaggtcctaagtgcacagtaaatgccagtgattcttaagagtctgagctcccattgtagaggcaagtaagctgaggttcagagacagaaaatgacttgcccaagatcacccagctgggaagtgacagtgccagggttggagccctggttgagctggttccacaggccagagctcattctgccctctccctggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaa

SEQ ID NO: 1472 - DNA, 60253 bp, Homo sapiens
tttcataaactacccagtctcaggtagttctttatagcaatgtgagaacagacaaatacaaggtggatggggtggggagagttcaggcatgtggtgcctatcacaaggaccttattccagtattaccatggccatcgggggaggcacgttgtggggaccaggctggaggcaggaaggcctgagtgaaggctgctgtgggcaactaggcaagaggcggttgcctgggccaggacagggcagggcagggaagggctggggtgatgcagagggcttggggcccaggccagaggggctgggtgtctccatggatgtgttcttagggtgctcacctgggagacccagaagaaggagataacacgtaagggtgaggctggtccctggaaatcagctgacatcctgcaaatgtggagccctgaggtggagccaagcccgaggcacagcccactcagtggcacaagccacaaagggccggcctcaccccaacctgggtgctcgtgattgacagcctcttgttacgtgagggaagcagcaccccttccgtggcagaaaagttgggcctgaattgtttgagcaattccacgtgtgcagctgcgtataccatccagggtgataggaccatgagcccgaggccctgatgtcctggggtctagtcctgtgtccacaggcaccactcccctttgtacctcctgtcccaacagccaagctccacagggccaagactacagcatcctttgctcagcacccaaaccacagctgtgcccacagcacggaggctggggacaccgagctgatgtcctcagaaggcaagtggacaggacagcctctggggtcccacaatgtcctggaactgaaggctcagaacctacaggaagtttgtccatttcagtgttactttcagtgagacaccattttcaaccatactcaggaggatccgctgaaaaatgaaacagaaatgagtcatgatgggcagagcagggagaagcaagggagacgagaagtggggaacatggaagaaaaagccacgtgaggaagaaaccagaggtcaagagaaaaagaatcatggaggtagaggaagcaaaaaacacacataacaaagaatgtggactttgggtcagaccaatgtgagtttaaatccaggttctctcccaaaccagtttgggcagatggcccattggaaccccactctcctcatcagtaaaaggggggcagagtgagggtcctgagggttagcacatggactgtgtgaagcagacaatgcccagtgcttagcaccggaatcagggtctagcaggtgctccctaaatggcaggtgctgtttgctactgaaagtactggaaggctgggcgccatggctcacgcctgtaatcccagcaatttgggaggctgaggtgggtggatcacctgaggctgggagtgcaagatcagcccgaccaacatggagaaaccctgtctctactaaaaatacaaaattagccagacgtggtggtgcatgcctgtaatcccagctactcgggaggctgaggcaagagaatcacttgaacccgggaggcggaggttgcagtgagccgagattccaccactgtaccccagcctgggcaaccagagcaaaactcagtctcaaaaaaaaaaaaaaaaagaaaaagaaaaaagaaaaaaaaaagaaagaaaggagcactggagagtccaggtgcatactcttgtagacagcaacttgctgtgtgcctcatttacatctctggcctcagtcaaaagggacttggctaggcagccccacctcaaggccctccgcagttgaaagatttatggttctgagataggcaaagggggaaaactggagaaacagaagccaccagagggaggcaggcagagcacccaacaggtcccctgggaaagggcttggctgggcatcaaacctaccaccccataaacttgacattgaaggcaaaagttaatgacatacagcagagacacggatggctttgggtattttttttgtcttcttttctttttttaagatcaatattcattcttcatttgccctcgtaacgaaaatagatttttaaatgcctcaaatatacaaacatcattgatgcacacacattccagaaatgcagaggtatgctgctgccacggggtaggggtgcgggaggcggcctggcctcatggccgcagaccgtgccccagcccgggcctggcaggtagctggccactgataaacgccactgggatcctaggagaagctggggaccatgcgtgaggtactgaaggggaccatggtggatggcatcctgggcactttgtagcttgtctgagggaaaggcctctgctgccatagaaaagctggacacatgtcaccctggggccctgacatcctaaaatgccccactgactaccagtcactaggagaaaggtctccggctatgcccttcccagtgatgcttgccccagagtgactggtcacaggtgggggacaggtttgctccagaaaccgtaggcctttcttgtctggccccctaaagaggacccaagatcaggaaaactccccagtttaaaaaaatatctgtccatctgtatataaaatacctattattagctggagttgcacacatgcaggaccaggagagactgcctgaggttctgcctggaccgaaggaggcctcgctcacagcacctctgtgaggggactggtgctcctgggaagtcacttctcttggtgaccgagctgacaccccctccacttggaaagcacagggactgagcaggcgggacctgtgctggagggagaccctcctggtgaggaactatgcgggccttctgggcctcagcagctccagcccactcctggcctggcaggccacctgcccacccacccacccatctgcctctgggcccccagtgaagtcagaagaggcaggagccccgcaggctgtgagcctggcgcaggtcggctgacagcgagcttctcatctgcctggtggtagagcggacgctctcggcagcctgcacggcccggctcagggccttgttgagctcctctaggtcgcccaggtcgagctggatggagtgccggtgtctccgggctggtgggggagaggctgtgggcggccacttggcagctggttgggctgaggtaggtcctgcaggcgcatagtacctgaggagagaagtgagtgggctcgttacacatggggagggctggggacaagccgaggagcaccgtgtgtggggtcaacccccttctaaatcccagctgggccagtggctcctactctctgggtctcagtttctttacctctaaaatgggaataatgggcacacatccagggatttcttagaaagatgaaggaagataacaacatgagtgcctgacccagaacaggtgttcaaggacaggaagttcaatctacctgttcatctgatttactgcccatctagtacatgccagccagcgtgccaggctctggggttacagtgggacaagaaaacatggactcctgcaatcttcttggagccggatcttggggaggccaggatcaccctaggcttgatagcaaaaccccctcatggaagaatatctgggggttccatttgccaagcaaggggtgctggagaaaggcaataattaataattaataatagtaataataataataatagggattctgcaggagtgggagggtctggccccatgtcctgggaagtgggtagaagagcatccttcctagcccagtcctataggaatgtgaggtgttgttttaaagtgctgtgggaatgggctgacaagcccattgagatgaagcacggatttccctaagaggtgacaatggcatccatcagggccactaagtttagggttcaaggaaaccagcagtgggcaagagggggtgtggcctcagcactgttaaataaagggtgtgtgtggtggaggagggagataaagaagcatggacctaaatcaggaataagtttaggaggacgcagcagagtcattcattggcatcttgcttggcacactgtaaactctggctttattcctgagcccctgctgtctaacttgcattgttatacagtgtgtagaaacagatgatccaaacagacatttctccaaaggagctattcaaatggacaatacgtacatgaaaagatgcatatccttagccatcaggaaatgcaaagtgaaaccactgcacaccctctaacatcaaaaaggacagatagcaacaagtgttgacaagaatgtggagaaactggaatcctcagcactgctggtgggaatgtaaatggtggagccactgtggaaaacagtctgacagttcctccaacagttaaacccagtgcctagcccagggctggcatcctcatctttggtacccatgtaccagttggtgcctttatctttattttacagatgagcaaagcggagctcagagaagctaagtgattcaggaggcagtagaatgcaccagccttagcagctcaggccctggagccctgccccaaatcccagtcattctgctgggctactcatgggactctggacaagctaagtcactttgcaaggcctctgttttcccacctaaaacgaccacagttagcaacctctcagcttagagctgatggaaaattcaggtaaaaagctggcactgcctggctccggtaagtgctccataaacgtgagctcctaagacccagagtcagacagctggaaggggcagccatgggttcacacctgggcccgactctccccacatatctaatgtgtgctaattggcaagcagcagatgctgataaaataatctgaactgtatgaacgggcttcttgcatccccaaaacagcagcctgcactccctcctctagggaccgtctggtgtaagtaactacagaggctcctcaaattacgatggggttatgcccctataaacccgctgtaaagtcgaaaaatcataaatcgaaccattgtaaaagtagggactgtctgggctgggttttcatacacccccaccttctgttaatttgatgaccaacttggcctgaaagttacccaaaactctccctagggccaacactgaaaaagtccctctgggctggaaagtctcggctgcaggggctatgggacggctgcccagcagggggcagcacaggcccactccgctttccaaactacactggtctcaaccactgggcccgttcagtcctgctgaccagcagctggagaaatttcagggtgtcaccagcgcaaattctagcagcattagaagcaccatcattattggcaacttctatgtactatgggctttccatgcattaattcattcaatcctcagcacaacccatttcgcagagaaggaaactgaggcataggtataacccgcccatcctgagttggaaacagcaacctggtgagttctgcccacaggcctgagcctggaagaatgtgaaatggggcctcaggagaagtaaagactccatggctaccgtggggtcaccaaattctgggcaaaacctttcccgatcaatgagttggaacactggcaggcgctttcccccgtgtctgctggaggtctgagcatgcagcattggttctcatctctgctggagtggaagattccttagcgacttgcttagactcagctgagagggcagcaagaaagcaaatttacataccgggcgcggtggctacaccttgtaatgccagtgctttgggaggccaatgcgggcagatcacctgaggccaggaggtcaagaccagcctggccaacatggcgaaacccatctctaccaaaaataccaaaaaaattagccgggtgtggtggcacactattgtattcccagctacttgagaggaggaggcatgagaatagcttgaatcttggagatgggggttgcagtgagccaagatggcgccactgcactccagcctgggcgacaaagccagaccctgtctcagaaaacacatatacataaaaaatttttaaaagcacatttataggcctggtccccgaatagaggaccagggctggatggcgccttgggtccctgctccaccaagcaccagccctcacagtgacgcaggccctcactgcctacacacccaggcttctggcaacacagccactgaagacatccagtcccaatcgactcatttcacagcaggggaagcaggcagagaagtagctgctgacagctgagacaagaagacaggtttcctacttctggggactgggcttttgtccctgcacaatcctatcatgttgaacccacttttactccttcttcttcctactagtgacaacactgagcaatagcaacattctctgtgatggcgaagctactgtttgctcagcaatgagcacgtgaccaaatggcaccacaaactccacacacttctcatttggttcctgccacgtgccacacttaatcctcacgcacaggattaagtacgtggttgagactcttcctccatttaacagatggggaagtggaggctctgagaggaagttagtttgccaaggccacagtgctactagggggcagatgggactccacggtagctctggccaactccaaacccaagccacttctgtctcggctgccctgcctctcctggcttgactgatgttacgtccagaatctgtgcaaaaagtcctacaatattcccgaccaggactccccagagatgtccaggtcatcaaaaacaaggaaggtctgaggatctgtcacagccgagggggcgtaaggaggcatggcaatcgcataccacatgggatcgtggatgggatcctggaacagagacaggactttggaggaaaacggcctgaaggaactacgaacttcagttaccaataatgtatggatattgcttcactaacgtggccaatgtgccacattattgtaagatattaataataggggaaactgtttgtgcaggagtgaggaggattgtgggaatctctctggactatctgctcaatttccctataaatctaaaactgtcctaaaaaataaagtctattaaaaaaaacccagtgctcatcacttacttgcggagaaaacccataaggaaaatggaagatggttaggattctcagtctccacaaagttataagctcccagagggcagggccctcttgctagtccccttcactgctgggtcccagggccgagcactctccttggtacatgggtttgttgagtgcctatatgagtgttggctttgttgagtgactatatgagtgttgggctcctactgcatgttatccacgcagggataaaacacaggaggagtatactgcatctcagctgccccacccaggtctgaatgctaacatattcagtgatctatagaaagaggctgggaaggtcagaatgaaggctcttacacagcggcaggtggataaggcatgatgggaaccgaggagatgtaggcaaaggctggaggggctggtgctgggggcgctgttgccagataccacagtccggggggtgggcgtggcgacgaccccgcctgcttgctcctctgcttggggctgggagttgaagatgcttttctcctcgtggtggccttctctgcccctatcagggagggaacagcacagagagacagagtctgaccacttggcagatccagccaaagatggagggtccacccagcccttcccctatgagagctggacaggccctaccctgtgagactccatgtcggggaggtctctctttggggaacaaatcctctgccccagttgctctgtcccagactggaacaacagctgctccagttaaactcacccaggtctaataaccctggtcaaggagagctgagggtctggctaagagaagaaacagtatttgtccctaccagaggtggctgagcctggaccatctgcctctgggggagacccaacttgaccacacaggggacactgaagggtatcagcgggaggcggtcccagtgggtcccctgtgacagcaccacctagaagaggaggaagagatgtcaggggaggattacatctaaatcatcagatcaggagcccccatgcaggccttctgcagcactgagctctcctcgggacccactgcggaggggacaagctgcctccatctgggtgatgacattgacaacaaccatgacagtgagagcaagcatttagtgagccaggccctctgctaagggccttcctgcattattttatcaaatccaacaagccactgggctagccactgtcctcactcccccactttacagatggggaaattaagggtccaagacgtcaagtaatttgccaagggtctcagagctgggaagcagtggtccttggatcctaagcccgggctctcccaaatgcagcccaaccccccgccccaaccacagtgagacagagccattctccatgtgggagtggcccagaacagtcccctggggaaccaggggggtcagtagaggcaaaagggaacaggaggagagtgggtgccattgttctcttcccacatacatccccaatgccacacctgggtgagttccagggctggtctgtttctctttcaggccttggctcaaccaccactccctctgggaagccctcccacccaccccggcagagtcaggcaccccccagccccactcgtgctcccctaccccagctttggccactctgctttgttgtgtgttccttggggacggggcccagggccccataggggtaagtgatgaatgaatgaatgaatgaatgaatgcatgcaggcatgaacggagaggcctgtcaggactctaacactagcacaggaagagcatagtggtgaaaaggtgggactctggagtcacaaagacctgggttcaaatcctgcttctaccacttgtaagctgtgtgcccttgggcaagttacttaatctctctgagccttggtgtccttgtctataaaatggacgtaatagtactgcagtacttagttcatagaactgtgaggattaatttatgcaaaacccttaacatgacaccctctacagagagggacttaataaatggcagctcattatcatcagtcattatcatcactattgcttgaaaagtcctagagaccatctcttccaatcctttcattatagatgtggtgactgaggtacagagaagtcaaggaactggcctaaggtcacacagcaagtcagtggcagaactgggactagaacccattgcctggattatcgggccactgctctctctgccactcctgtggacttgggggaaagtatgaggggtgaagggaggatggaggggagaataagacataatcactgatgccaggtcccctgctgcctggaggccacctatcaggacccttcaggaacttcttaaatcaaggagggtggcttcaggcagcagcacctgaagcaacagatgtgacggcaggacacccagaaaaatcctcttccctggtctgtccctataacccactgctaagttcagggcaggccagatcttgtcaagtacacactcccctgagggcaagaagctgcagccacagctgcctgggccagttttccaggtgccattccttacccgcatcctgggtcctaatgggccggcagtggggacaggagactgtgccattgccttttgggaccgccttaggggacagaacatggtattcgtggcctggggaaagaaaccagaactgtcagtatcagccctgtggatggatgcaaaatagaggaagattctggaataatgatctcctcttcctccaaatggttttaatagtctctgtctctctctcacgtgtgcacacggtgagtgtgcatacacacatcatgtgtaaaatatgtacatatttaagtatgacacacatacacacatatacgtcaccgaacatctttgtgtctgtttattgtaagctttctccagactcctattctgtttcatctcagatcctagaaccagctgacatccagtagcaaccaacacacccaggctaagtcaggatttgaaagcaggccaggaagaaatgataagcaaagcaacaataagaaatgaacaagtgatgctattccccacaccccgacttgctggtttggttctgaatggctcgggcacagggtcagtggtgttttctccccatgctctgagcggctgtaacatggggataaacatagcgcccatttcacaggcttgttgggagaactgaacggggccgtatccgtgtcgtgctccgcccagtgcctggcagatggaaagcagttgatgttatgagaaagctgggcggactgtggcctcctcacccagccccaccacctcctgccttacccacccctgagtttcaaataaggccttctgggtgacacctgaagccactgtggagcggtctcatcatctcatttccctcctgtgctgttctggctttgtgtatgtggagctgaacgtaattgctcttattttcccgacgcgacagatgaggaatctgagggtcagagaggctcagagccattttctgtgagactgacttcagagtctttggttttgacttctatactctcttcctctcattgtgttggaagcatttctccaggttaagctcactattaagggttaagatcacctttaaaggctacagaaaacctcatccaatgatatcatctctttccttttgctagtaagtccacagagagattgtccggtgagcttggaggtgttcctgctactgtcgtttctaactccttggcctctgtccactccctcgttatggtccatggagcagaatgtgcctctggcctcttgccttgtccccagaatctgaggtcagcagccctccctcttctgcaaggtgtctgtgagagatgatgcctttactataattacctattggttatcatcttctctgctacagtcagattcatgaaggtgagaaccatatccatatatatatatatatatatatatttatgtatttttgagacggagtctcactgtcacccaggctggagtgcaatggcatgatcttggctcactgcaacctctgcctcctgggttcaagagattcttgtgcctcagcctcccaaatagctgggattacaggcacccgccaccacacccagctaattttttttgcatgtttagtagaaacggggttttgtcacattggccaggctggtcttgaactactgatctcaggtgattctcccacctcggcctcccaaagtgctgggattagaggtgtgagccaccacacccaacccatatttttgtgttaatgttataagcacttgaaatgctaccatgtgtcatctcaagtctttactctgtgccaggtcctgtttcctgagacacaggggccctctggaaatgagaacctgaaggaagccaggtgcaaatgggacatccaattcagtgtccaccctgtatgctccgagccggaaaagcacaggtgatcagaacttctttaggattgaccagctgaacagacttcccagaaccaagcatgggccctggcaaaggggaagcatcagaaagtgtttgctgaatgaatgaatgaatgaatgaatgaacaagtgcaccgagattcatggaggcaatgctccctgctggttttcatatcacagaactgatagaaaatgatatttgaatggcccactgggtatatggaaagggcttctcataacagaggagcccccgctgacaccaggagctgcacccatcccggccctccctcctgacctacctgtgtattggccccggaaggtgaccctgtctggccatccagcactgcccacccctctctttccatcccgagctgcctgtggactgtccttggtggtcttgctcttctcagagaacagtggtagggagggcagctcagattctgaacctggggtagaaaaagtggggcatcagagggggcaaggggtgggggtcacatttctcaaggagtgggtatgccatgagtttaggctctggggtggatgcctgggttttaatccccagtctcccccttaggagtaacagctggcatttccagaaccctgcccccgtgccaagcgctagtctagacgctctgtgtgtgccgtgttgggcaccttcacagcaatcccacgatgtggacactgttataactacatggtgagctgtccctttaactgctcagagcaggtaaacaactcggccaaggacaagtggaggggagctcgctgatcccggctactgactccagagccctgatcctttagcacatcccctgcgctcattgggcttcagcgcccttatctgtgaaatgtggataatatgaccatcttgcagtggaggttaagcaagacagcagctacaaagcccttacagacaccctacacgcagtaggtgtgcaggactttagaagtgctctgtgcttcacagcactataatatcctaaaacagatgcacaaaaacccttctccaagtttccttgaatactgttgctgtggtccctgaccactgagccaacatgctcagactgtggcctctggaaatcagcctttgcaggtggtcacttactcagggacagtcggagcacctcccgaggcactgaggaagacctggctcgctgccttcctggagggacaatctgctcttcacctctaggctcaccaggcaatctctctgtggatttactagcaaaaggaaagagagatgatgtcattggatgaggttttgtgtggcctttaaaggttatttgtgagaagttcaacctggagaaatgcttctaacacgatggaaggaagagagtatagaagtcaaagccagactctgaagtcagtttcacagaaaatggctctgcgcctctctgatcctcagtttcctcatctgtcaagtggggataataacagcaattacctcagagggttataaaaagattaatgagaaaatgttcataaaacccttcatcaagtgccctcccatagactcaaaagaagccagctgattttatgtcattgtcataaatgaacaaacaccgaattaatgggtgagagtgaaggcatgctggcaatgttctaactctttggttgggtggtgggtctagggatattcattgtattattctttattattattattattattttgagacagagcctctctctgttgcccaggctggagtgcagtggcacaatctcagctcactgcaacctccgcctcctgggttcaagcaattctcctgcctcagcctcctgagtagctgggattacaggcgcacaccaccacgcccagctaatttttgtgtttttagtagagacagggtttcaccatgttggtcaggctggtttcgaactcctgaactcgtcatcttcccgcctcggcctcccaaagtgctggattacaggcatgagccactgcgcccggcctattctttattattaacatagaggtttatatattcttttgtgcatcaaatactgcacagtgaacaagctcaacagtgaatgaatgaatgagtgagagagggatgtggcagtgcctgagtccatatgtctggggagagccagaggccagccaagactatcttctgtagctgccaccaggacagaggtgggagttttgaggtcacccacctgccataatgggagccccaggtggctggggagtctgctggccggccgcgggtccgggcggggcggtcaaaggcagatgctgggcgtgtcgggctgccctggagtggctggtgcaggctgtcttccagccgcagacgaagccgggacacctcttcttgcagctcacagatggcctggctggggttggagtggagacagaaacaaagaacagaggcatgaggaacagagctgcagccacccgagtatgccaggatgcggcagcctttgtcccttcacagcaggcacagggtctatctctgctgtcaaacgattctagaactttcctgtgcgacacttttcttgctacacaacttgacacctttctgagttcatgtccctgtgcagtgaacaaaacagaacttttctttgaagttttctcttcctaacacatggggtctgagtggctgttcaggaacaccagtgacaaattctcgagatggagacaaggatgcagcatagagagggccctagctacagttctgccataaaataccaaccttcactctctgtccaggcccagctcctctccctaccactgtgcaagcccatctctccagacctggcagaagatgcttgtccaccatctccccacacagacagtgagccgccagcagacaagaaagaagcgggcttcctgtcttataacccctgaggccctgcaccttgtggatgctcaggaaacagtactgcagtggatctgggctctgagacggagcagaataaagcgctgtgagtggagagcggacagggagacacctcgatgcttcctagcaccacctgaaccgggagggctgactaagagcaggctggaagctgtctgcaagactatagtaaatcctggtgaaacccccaacatggtccaacctccagccaccagcactgagggagtaaatcctgtctgtgtttctctccaatcagtccctgcatcttcagggtcttgttttgtgggcattgctgacaccgcagcagacaatcctacccagatacccctccccacaagaccccctcaaccacggagcagcgttagagccaggctcagcaaagccaccctccaggcggatgcaggctccacatctacttggtctggcttctggggtgggaattcccactggggccgttcttgcctggtggcccctggactcctgggtgagtatcccctggtgccgcctccagcagacatgagcgctcagatgactgtgtcagaaggagtggaggcctcttcctggctgtgccccagcgctgagtgtgtgtgtctgagggcagtgggttcccttggtaatccccagggagacgcttgctggtgtttctgaggcaaagccacgagggcaagtgtgggcggtggctactggagagtgacatctccccacccccagttaactcctgaaatggagagctccgcctcctagtcagaaggcactaaaaaaaaagacttaccaggccgggggcgtgagtcagccacttgggtatctcagtctctctgatgtaactctttagtttcttactgagtgccagcaggcacttaacattcatctttctctgcaaacttacttccctgtctctgcacatggcagcagcatctacctgactagccagacagaactctgagtcactctagatcccctccttccctgaacatccctgaagttaattagttaccaagtctcatgggcccaacttccaaaatacctcttcccaaatgaatcccttcttcccctctgtaggggccctccccgagaacccagtccccatcatctctctcctggatgtggcagccttctcagcagtctcttggtctccgttctcaccctgccggtggccagagaactctaaaacataaacctgcctacgctacgtccctgcttaaaatccccttccctgtcctctcagcctttgtgcactcatggaatatgcagtgaatgtctccccttacccatggccttcaggccctgtaggatctcccataggtctctcctctctacccctctcttcctttactgctcaacactccaccccctcacactagaggatctggctgaccgtttagctcctccaaggtgatgggcactctctcacctttaggactttgcacatgccattccctccactgaagatactcttctatctctcttccttctgatgtctgctgagataccacttcctccaggaagccctccctgaagcctctaaccggaccagatgctccttcgctgtgctcccacagtcctttagtcctctgccatcatggtatttatcacaatggagggcactactgcctgtttctttgtctgttcatcctacaagatggtaagctttaagaggcctaggatagagtcttgtccactattgtattcccaaggcctggcataccctagacaaacaagcctctaattcctccactgatgtcaggggaggctgcaggggtagacttactaaactcagacaaggaagccaaacaccagcagctggacacaactttgcacgtaggcaacatgacagcctcatgcctgttcgagccaaagaaaccttggctgggccaccaccgagcagtctccccagcgcatcccgggacagacacccactccagcaagggtgtgtaagtgatcactggccaaaagcaactaagaggaggtgtgagagaactgaccaagcgattttaccatttctgttcaaccaaggaagtggaactttcttagtagaaaaaatgcacacgaaccaaaaaaagaaaagaaaaactcagaaggcagtagcttcttggtccatacaatcaatggtcaaattgcagaaaagatagccctagaaaggacaggcttttctcggaaaagagatgatggagagagagggcataagtgtcagcaccagaaaggtgaatctttaggtcatattccactggctggagaagtgtgtcctcgatgtctagatcaatgaggtcccacagaaacgctgggaactgggaggcaggacacctgggtccgtctgctcctaccaccaccatctgtgtgagctgggcaggtctccacctccacctgctaacacgtcgcatcacgctcccgtctgtatgatgagcttgaatccccaggatccaagtgtctaacttactctcgccctgccctggtgagcaggaagctggggatggtctctgttggtccacagggtagaggcgcagcggcaggggcgggggctgggggtgggctgattgtcttgttgggaaggggctgttcagaaatccgtttgtgcccctcaaactctgagccaggaaccgctagggaggcagagagagaacccaaagtgagtttaagcagagagaacttccaagctcacacttgtgcaggtggaatgatgggggaagtgaagagacggtgcctagttcaaggtcacaaaggaagttcctgatgaggccaatgacccacactgacctccaaaccagaagatctagattttgctgggagtgtggggtgctgagctgggcctgccccgctgtttctaaccagaacccctcctcccacccaccatgacaccatccgagtcttcaggaacttcccctgcaaagaattaatcacttcttcacttgggttcctcaagacttgatcaccttctcaccatgtttttgtggggctggcttcagagcctcctctgaaattatagtcacctctttccacgtatgcatgtttctggggagagcattaataacttttaacgaatctcccaaagggatgggtgaccaaaggttaaaaaccactaatccgtcccctgcattaaaagcaatgaactggccagacatggtggctcacgcctgtaatcccagcactctgggaggctgagacgggaggattgcttgcgcccagaagtttgagtctagcctaggtaatatagaaagaccccatctttgcaaaaaaaaaaaaaaattatatatataaaaaaattagctggatgtggaagtatgcccctttggtcccagctacttgggaggctgaagcaggaggatcgcttgggccagggaggacaaggctgcagtgagccataatggcgacactgcactgcagcctgggtgacagagcaagaccctgtctcaaaaacaataaagaaataaataaaaaataaaagcaatgaaacccttggaatactactcagcaatatataaaggagctaactattaatacacagaataatctagataaatctccagagaattatgctgagtgaaaagccaatcccaaaaggttacatagtatatgattctatttatagaacattcttgaaatgataaaattatagaaatggagaacagattagtgcttaccaggggttaaggacaggctgggggcaggagggaagtgggtgtgcctatgaaagggtagcatgaggctccttgtggtgatggaacgttctgtatcttgactgcatcaatgtcaacatctggctgtgacattgtactacagttttgcaagatagtctcactggggaaaactgagtaaaggcacatgggatctctgtgtattatttcttataactgcatgtgaatctacaattatctccaaataaaaagtttaattaaaggccgggcgtggcggctcacacctataatcccagcactttgggaggctgaggcgggcggatcacttgaggtcaggagtttgagactagcctggccaacatggtgaaacccatttctactaaaaatacaaaaattagctggacgcagtggtgcatacctgtagtcccagctactcgcgaggctgaggctggagaatcacttgaacctgagtggtggaggttgcagtgagctgagatcgtaccactacataccagcctgggggacagagtgagactccatctcaaaaaaaaaaagtttaattaaaaacgtttttaaaataatgaaccagctgggcgtggtggctcatgccggtaatcccagcactttgggaggccgaggcgggcgggtcacaaggtcaggagttcgagaccagcctgaccaacatggtgaaaccccatatccactaaaaatacaaaaattagccaggcgtggtggcgcgtgcctataatcccagcttctcaggaggctgaggcaggagaatctcttgaacccgggaggtggatgttgcagtgagcagagagtgcaccattgcactccagcctggacaacagagcgagactccatctcaaaaaaaaaaaaagatgaaccttttaggcaaagctaatctgaggtgtcagaagtcagaacagtggttatgtttgggaagcaggtagtgactaaatgggacttcagtgaggttctggggttcagatcatactgagtttcttggtgtctgttcaccttgtaaaaactcatcaatttaagttctttttggtggtttttaatttcaataaataattcatgtgtatttctaaaggtcaaaaactgaatcacatatagatttcatagacatggaaagtgtttatagtacaatttagtgaaaaaaggaggtcgccaaatattcacatataaaatgatcttattttttgttttttttttttatgttttttgagatggagttttgctctttcgcccaggctgaagtgaagtggcgcaatctcagctcactgcaacctccgcccccgggtttaagccattctcctgcctcagcctcctgagtagctgggattttaggtgccagccaccacgtctggctaatttttgtatttttagtggagatggggttttgccatgttggccaggctggtcttgagcttctgacctcaggtgatccacccgcctcagcctcccaaagtgttaggattacaggcgtgagccaccgtgcccagcctcatttctgttttaagtatagtcacgcatcacttaatattgggtataagctcccagaaacacattgttattctgtttcaccatgtcacaaacatcatagattacccacacctattacatatgtgaggtagatggaatagcccattattgtaggctacaaacctctacaacattgcctgctgaatactgtaggtatctgtaacacaatggtaagtatttgtgtatctaaacatagaaaacagaccataaaaatatggtataaaagattttaaaaatggtacacctgtaaagggtccttaccatgaatggagctcgcaggactggaagttgctctgggtgagtcagtgagtgagtggtgagtgaatgtgaaggcctaggacattactgtacactgctgtagactttataaacaccatacacttaggctaaatttacaacatttatacaaaagttttttcttcaataattaatcaagtttaacttacagtaacatttttactttataagctttttaaatggtttttaaccttttgactcttttgtaataacatttaacttaaaaatacattgtaaagtaaaaaatattttctttcttgatatccttataagcttttttctatttttaacttttttttaaaaaactttaaaaacttttctgttagaaactaagacaaacacacacacatcacagacacacacacacattagcctaggcctgtatagggtcagggtcatcaatatccctgtcttctacctccacatcttgttcttctggggcaataatagcactgtcatctgtgataacaacaccttcttctggaatacctctcgaaggactacctgaggctatttaatagttaacatttttaggctgggcgcggtggctcacgcctgtaatcccagcactttgggaggctgaggagggcggatcacgaggtcaggagatcgagaccatcttggctaacacggtgaaaccccgtctctactaaaaatacaaaaaattagccaggcatggtggtgggcgcctgtagtcccagctacttgggaggctgaggcaggagaatggcgtgaacctgggaggcagagcttgcagtgagccgagattgtgccactgcagtctggcctgggtgaaagagcgagactctgtctcaaaaaaaaaaaaaaaaaatagttaacatttttaaaataagtagaagaaatacactctaaaataatgataaaaagtatagtaaatacataaaccagtaacagagtcattagttatcaagtattaggtactgtacataatcgtaggtgctatacggtactttttttttttttttttgagacagagtcttgctctgtcacccaggctggtgtgcagtggtgcgatcttggctcactgaaacctctgcctccgcctcctgggttcaagcaattctcatgcctcagcctcctgagtagctgggattacagtcgtaagccaccacacctggctaatttttgtatttttaatagagatggggttttgtcatgttggccacaggtgatcctggccttaagtgatcctcccaccttggcctcccaaagtgctgagattacaggcatgagccaccatgcccggcctgtactgtacttttttttttttttttgatacagagtcttgctctgtcacccaggctggagtgcaatggcacgattgcagctcactgcaacttccacctcccgggttcaagcaattctcctgcctcagcctcccaagtagctaggattacaggcacctgccaccatgcctggctaattttttgtatttttagtagagacggggtttcaccacgttggccaggctcgtctcgaactcctgacctcaggtgatccacccgcctcggcctcccaaagtgctgggattacaggcacgagccgctgcacccggctgggactgtactttcatgtgaccggcagcgcagtaggtttgtttccaccagcatcaccacaaacatgtgagtgaagtgttgctctgcaatgactgcaacatcgcaaccaaaggaattttcagctccatgaaaatcttatgggaccaccgccgtgcacgctgtctgtcgttgaacaaaacgttgctatgcagtgcatgacagtatgtgtaaacaaacacacatttatatcggcacagagaacagctcacaggttctacaccaaaacgtcagcactgatggtttccagagtatttttttttcttttgttcccttttgtccacgttatctgtaatttcaaatttcagtacaatgaacctggctaatatgtcatatcctaaagggttctgcaagtttttctatttgatttttcaacccatgcagttctgtccaagtcagactcctgcactcacccatctcggctgccagtgtccgctccaggctgaagttgggtgccctctgccggagaggcccacttgggctggagaggtacctctgtgcttggctccggggtgtgctgggctctgtggctcttctgggaatcagagaacccctggccttggggtaggaagctccatccctgggcacagatgcagcaaagggctgggctaatgttcctgctgtgctgggggaccgtggaggaagggacacacaggggtcacacagagtgagacactcaggcggcagcatctgagcccctccacatgctaacccaataagctcccaccctttgtaactttgcatctcgggtggtacaatatttccaaggacacacacacattagatgcccaattctttgtaaactgttcactggccaacccaatatgcaaaataataaagctcagtttatgtgtagaatacataaaagagaaataggatttctaatccttcctttgcatgcacccttgggttgccatgtgggcctcctgaagggcctgcacccagctttggaggctccatccctccactcttcacccctgtcccctccgccttctcccttccctttgggttccatgtagccaccctgagtgccctttgcccttgtcttctgttcacctcacagtgccctccctgtagtttttattcattcatccattcatttgctcaacaaaaatgaatttcccagtctgtcgctaattagctatgtgaggctggactagttactcccctctctgaagctctgtttcctctgtccataacacaggaacaagaaatcacggttaggggatgaaatgagggcctacgaatggacagaccatcctctcttattctgggccatcacaggcactgtgattcccaggctgtcccaggaatgtggcactgacgggacaatggcgggatcccgggatacctgatgtgggagagccggtgctctggagtctgggtgaggggtgaaactctgcttgtttctgagcccacaaagccactgtctgtctctggggacgccatccaggtctcctgaaagaggcagtatccctttatgtctgaggaatgtgtccaaggcacactgggaagcccttcccaaatcgtggcctggcctcacctcccagaggctcacaccccagggttgctggcccagctcccaacagccaggcccaggagtgagggctctcaggctctcaggcctcagcacaagaatctggctaccagcagggactctgcaccccaggaggaccctcagcaagtgctgcctccctgaggggtggcagccagagcccttgggagagacaaggccatggacaaggactagcaaggggagagggagaaagccttatttccagtgtctcctggcttaggcctggaatactatggtcttatctgacagtggaaatgctcaggcccaaggcattggaaaaacgagaccatcaaatatgtacaggtcctacccgctgggtttaacacacggcacagagaacacaaacagagcaacacaggtgcctgccctcgctgagttcatgtctagtgcagagaatcctgaccatgggctcgttaggactacagaagtgtgtgtgtgtgtgtgtgtgtttgtgcataagtgcacatgcatgcatatatatgcattattctatgacagtcacatttccatagtggcctgtgactttgcagcagtgatgtctactctaaagagcatagaactagtctctccagctgtgatgggcaggctcagagaagtataagcaatgggttgcaagctctcagaggaggaacaagagctccggaagagggacaggtttggggggtgacactgagcataagtcctgcatgtcaggtgggattgtggctggcagggacaggagcagcaagtattccaagaaggaatagcacaaggaaagacccagaagcagaaagttgagaagacccaggaatgaccctgaggttctgggcccattcccccatgtggagacttacctccaggtggggcccaccgcctcggtgcaaaggcttctgtggaaggcgctcagagatgccgcttccctccaggctggtcatactactttggtgggatgctgcggacttggtgcctggagggtggggtggcacgccagggcctggaggggctgcctcagccttgcccaggcctgacatgtgcccgtctctagccagggatgcctggaaacctggtggcttcatagataccatcttctccgtggcctccctggcatgggaagagaagaccatccttgagttctgccaggcagccctgacgcaggggttggcctgtcctgggagccaagcagcccagggcacaagctctggagtcagacatccctggctgcccagcctggttctgccaccttctagctgtgtgacctagggcaaggcacttcccctctctcaacctcacttttctcaactataaaatatggatgccaacaaaacccacccaacaccaaagaggaaatgttaaagcagcatttcccagacttaaggagtttgcataccaccttccctatttcagtcatttccataaacttccatctactccaaagattttagatcactattcaaaacagaagatcagtgtgtcatgtgacaaacagaaactaactttgaggataaatataagaaacctgaatattatcatatactagatagatccacttgcctgctaaatgctctaggccttgtgtgctctcatactgtctctctctctctttttccacagaagttcaagagaggcattaaagacaccacagctctcagtaaactatcacaaggacaaaaaaccaaacaccgcatgttcttactcataggtggcaattgaacaatgaaaacaaatggacacaggaaggggaacatcacacaccgggggctgttgtggggtggggggagggatagcattaggagatatacctaatgttaaatgacgagttaatgggtgcagcacaccaacatggcacatgtatacatatgtaacaaacctgcacgttgtgcacgtgtaccctaaaacttaaagtacaaaaaaagaaaaataaaaaagacaccacagcactaactgagactttctccttggcatcattagaaggtcagagacagaaaaagagaatgatattcttttttctttttttttttttgagacagggtctcacactatcacccaggctggagtgcagtggcccgatctcagctcactgcaacctccgcctcctgggctcaagagattcacctgcttcagcctcccaaatagctagggctataggcgtgtaccaccatgcctggctaatttttgtatttcttgttgagatggggctttgccgttttgctcaggctagtcttgaactcctggactcaagtgatccacctgccttggcctccctcaatgctgggattacaggcatgagccactgtgcccagctgagaataatgttctttaatactgcatgtgtcctactgaaaatcatgtcccacactacccaaaatcatttcaagggctatcagtggtatacattccacacttgaagaggcaggacaggtaagccatgtctaaactgtgaagcgctgtcttattcactctgacagtgatcatccctgtggttttagggtggaaacaaacattctgcaggaaaggctcagtgacttactccaggggagccccatgacttttctcagcctgcaccgggcactgccttgggaggaccctggtggcctctgctttccctggagttgcagccaccccatcaacttccagggagtcacctcccccctcttcctcctcctcctcctctccttcttcctcctcctccattctcatggcttctgggagagacttcacactgaggtacctgcagaagaacacacagaggggcatgacctctgcccagtgggggacagccaagatccagctgctggccagacaccctggtcaggtccaggtggcactcaccgctccatgaggccatggtaaacttgctccatctgcagctccttgtgcctgagtcgggccagggggtcctgtggcctgtcctccacctcactgttgccagagctcacctccacatttacgtgcaatgggcaggggccagtgctggcggcggcagtggtggtagcaggctggggtcagaaagatggacagacagagattcagcagatagttaaacaccacttttaagcacttacctcctgccaggctcgagctgtgggctgcggggtaagaagcacattagactcactaagcccaccacccttttatgtatgtgtaaactatggagactgggctgtgtggtcttcgatactggctgccatgaattgagcacctgctgtgtgccaggcaccatacagataccatgtcacaacaatcccaccagtacctacgattattacaaaccattttatagacaggtaactcacgctcaaatgatttgcccaaagtcaacagaaacaaggagcagagttgagatttaaacctagatttcctgccagagttaactctcctgacccccatccattccagcatggccaccccagccccctgcaataccttcaactgcaggagcatgagggtcccttaagatattgtactcaggttttctccccattcaagtgtgtagtggcacctggtagagttttcctaccctctaggccagagcacagcacaagattttccccaaaccatagggccagcatgacctcagctgtcagggatgtcctaccagtgtcccaccctacccagcatgccaggctctctttcctgctcccatcctcaacagacaagtctttgcagcacaggcaacaggagttgggaggcatagagaccccactactgtcatctgtgtgaacgcactacactcaatttgctcgcctgcaaaacggagatagtgattgtctctcaaggggttgtggtgtgggccagacagccttctacaaagccccttttgtgtagggctcttgtctaggtttcaccccattatccatgcagtactacaagctagaaacctggagccatccgtgtctcccttcctccctctcacggccactccaagtccactcaaacataccttcccaacctctcttaagtccacacatgcttctccatttgccctgccacctccccagcctcagactggcctacccacaagtcatcttatgtcatcccctgccagaaaatccagcagagtttaaggccatgctctctacgtgacccacaagcccctacatcatggggcccctgcctgcctctccagccacatctcagactatttttcctttctcttcccatactctagccacagggcctttgcacaagctgttttccctgctggatgggttttctctttctgtctctagtaattcctacttagtctcaggtctcatttaaacatgacttcttcagggaaagcttctctgacctcctcctcaaactcagtcatgttactcctgctactctcacagaaccccataattctccttcagtgcactgaccaaaattataactaaatcactgtaaccagttcaactctacagaaaactctgtgaaggtagacgccaccttccctgccacctcccatcccactgaatccctaccatgtgtcatggtacatggcacacacttcataaatatgtaatatttacatatttggcacacactggcatatggcacacacttcataaatatgtaatacgtattgaagaaatgaattaacgaagaaatgaatgcacgagggaacagcccaatatggttgagccaagaggtacctcagggcaggaggtcttgatggctggcatgggggcttgtccagaaggagcaggcaggtgcgttggctgatggaggcagggcagggctggggtgctgtccagagctgagtctgacccgggcggctcaggctcttgctgggtctggtctatgtgttccttcagctcttccaggcagcttcccagacggtatatctctgcctccagctccctggaatgcagaaacattaccaccaggagcccaagatggcagctacatcaggcaggtccaggaacagagtatcagagcagagactccaggggatgcccccttagggtccatttaatatcagcctttagatgatggtgagaactcaaaataagcaagatgaaagaaggttccattgggaatcaggaggtctcagcccaagtcccctctgccatccacaggctgtgggacattagagaaatcccacccccatctagcctcagtttccccatcatccaataagggtttcaaggcatcttctcagcacgtgggtccaaagggactcaaatcacagcttttgatcgtgccaccatttggatatgtatactaattaggataagatttctctctattccccgtgtacaaattataaggacaaagtgcctccctcctggagactgagggaccccaggggcccatcccatctgtccttccaggccttccaccccagcaggtacctgcgaggatcaaatcttccaggcgtccccttggagccggcaagcggctgggcagggtgttgctcccgacaagccttcaggtactcctcctctagggccgcgtgggcagccttcagccgctggaagccctgaaaccagaccaggccaggaagacttgagtgctcagtccccgcggggcctgtccctgaagacacagtggatgagacagcttgcgggaggccatgggatgcacctgggcccctgggttcatgcaagatacaggctgaggttgagatctctggaggctgcctgccctggagagctgccgtggtcaagctctctgccatcaggctggcacaacagagacacaactcagagacttggcaccagctccagagggcaccagcccttcctgcatagacttacaaggaccccaatgtaccacaaactgtcatagctgtcacagtgtcaaatacactctcactattatctccataaggaccctttacatgagagactctggatcctcattcttgatttgcaaaactgtgggcttcagaaaattagccactctttccccaaatccttatagactatcgacaccgataatgttatcatcaccatcacattattgagaatgtttactgagcattgaggctctgggctaaagcactttgcatttatttaatcttcaatataatcataatgagaggggtgatttatcatcttcatttaaaaaggatgaaactgaggcacagggaggtcacttaagttgatgaaggtcatggagtgagtgagttgtagagacaggatgtgggcccaggccctctggccccagagctcatggtcctagcaattctgctaggctcccataggaggatcacaggtaatacatggctaaagctgcaggaattggggttggtatcactgtcttactaccatccacatcccactcaactctgaggagagacagaagccaagcacaacctaaaacccattccctggtcacatctaatcttctgacagctctcaacttccctgtatatggggggattagaacagagagcaaaaaaatgaatggttttagtttataaggtccttggtcatccactggatgatattacatgatacatatgacacattttgtgattggaaaatgtacatgacatctatgtaaccacacaggaaatatcctgccataacatttttttagaaactaggtgttttgaatttgcctctccagaccttctctcagctcctctcccaccctgctctgtgctttgagcatcagggctgtctacctgctggcttctggttgggtctgtctagtgggagggacctatgagagatcacagggtgggaagagagagacttgagagtgggcacagctcccggctaatgctactacccggggattcctcagtctttgttgggtcccctgatgctgcccacacctttgctgacagttctctcctttgacgcctacactcccagacttgagagccccacctgtcccttaatgggaccctggctgatgcagcaggaatctaaattgtatttatgaccaccgttatctaaaactccaaattccaaaggatatacaccaataggactctataaagggtctcccctccagcccccactttttttaacagggtttccaaacttttggcaactattttgtaattttgtttaaaggcgataaaaaagaaaaggcctttttctgcttgctgagaggcaggataatttgtggaaagtagtgcagggcagtgattatgaccctggatttgaaagagagacagacctggctccaggttctcctgcctactagctgtggggcctttgagtcacccctctgagcttcagttccatcctggttaaatgagggtgataaatgtaactgcttcactgggttttgatgatgaccaaataaaataacatactctagggtttaccacagtccctgtacacaaccatccttgcttaataatgggtaactattgtgaaataatgatcgttatcatgggaagctactcaggaactgtttgctctaaaagagaccctgtgtctgggattctcttttctgtcttgcagcaaagaaggcttcagagacagagtcatgggagacagtggttgtctggcagttccatgggtggctcctgaattgggcagtaccttgacttggtcctggggcatgagacgtcctgcctgtatcagtctttcaaaggactccacctggacattgggaggggaaggaaatatgctccattaatccagtcctgtagactcccacacccagccacatctatgccttggtaagaggagctgggtccgtcctcaggatgtggggtttctgccaagcatggagacgtgggtgctgggaacagcttctaccaccagccccaggcatggtagccttgagaaaaattgaagtgaaacctgcaggaatttactgacaacaaagcaagtcactcatgtgcatcaagactaatgagtcaggatatttactgcagcatgaacagtagggaggggacaagaaattgcctaaatgcctgtcggtggaatagtattcagccatcaacaagaggaaggcacacgtgtatgttctgagctattaatgcctccaagacctatttttcagtgtcaaatcaaggtacagggcaatgtttacggtatgctaccatctgtatagaatatgtggagagtaaaaaggaaaacgataaatacattgcttatatacgatatactatctctagaggaattcaagaaactaaaatatgaattgcttctgggaaggagaactgggtggctggaagacaggaatgagaagtagatttttctactacatgtcctttgcatcctttgaaatctgaacaatgtgaattcgttgcctacccaaaaataaatattcaaatttaagacttcaaaaagtcaaggtacagtagcttatgcagccatttctataaatgcaagtgtgtgcattgaacatttttgcatgggttggaggaaagatttagtttttgctcaatatgccctctgtactgtgcaaaggtccttatcatgggcatctattacctgctcaaaaaagtttaattacaaaaaaaggcaagggatgatgtaaggttcggttttaagaaagctctagatcagtgtgaaatatagaaatgtatattatataatcatattacataattttataatatataaaatagaactataatgtgagctacaccatctataattttctcatagccacattgagaatgtaaaaagaaacaggtaaaattaatttttatattttatttagccccaaatatcatttcaacatgtaatcaatactaaaaaaatagggagacactttatatttctaagtctctgaaatctggcatgtgtttcatacccacagcacgtctcaattcagagcagcccatgtcaagtactcaacagtcacatgtggccagcagcttctgaattggaccgtgcagcactagacatgaggggtcagctaaggccccagctcctgctcagtgtgatgatttgacattgctttattttgtggacaacatataggacgaagaagaaatgtgtctccggctacggaaccaagaatggtggtggcaaaaggaaacgaagcctgtaatcccagcactttgggaggccgaggcaggcatatcacctgaggtcaggagctcaagaccagcctggccaacatggtgaaaccccatctctactaaaaatacaaaaattagccaggcatggtggcgcgtgcctgtaatctcagcttctagggaggcttgaggcaggagaattgcttgaacccgggaagcggaggttgcagtgagccaagactgcaccactgcactccagcctgggcaacagagtgagactctgtctcaaaaaaaaaaaaaaagaagaaaagaaatgaagtacttgtatgtgctactccaacaaggattaactttgaaaacatcatggtaagtgacagatgtcagacacaggacaaatattgcgtgaatctattgctatgagacatccacaataggcaagcctataaagacaggaagcagaagagcagccgacggaggctggggaaagaggggatggggagtgactgcctaatacagatgaggtttcttagtgcgtgatgaaaatgttctaaaactgactgtggtgatagtggcagaactgcaaatatactaaaaaccgctgaagcaagcaaacactttaaatgagtcaaccgcatggtatgtgaattatatttcagtaaagcaagggaaagaaggagagatgggaggggagggaagaggagaggaggggaggggaggagagaagagaagaggagaggggaagggagaggagaggagaggagggaagggaagggaagaataaaatggtggtgcttctgaaagaatttgttttatgggcatggtagtgcatgtaactattgcatttctcttttggcattggcaactaggaagctcaaagctaaatgtgtgactctaatgtgcttagggtccaacagaacattttatttactcactccacgtattttatttttttctacccttacttcctctctgccccagttttctcacttctgttttcagaatgtggctaaaacgtatgtattttcataaggtgctttaaaccacttctggaataaagccaatgtacagttataaacagacctgcaaacaattcacggttacttggactgtttcatgaagatacgaagacccttgagaagtaactaggaattgatttatttaataaaatgaactaagaaagtgaggcaacttatcctgaagaggaaaaggtagagtggagattctgttacccttccagaatcctgaaagagctcagagtttcccgggagccagcctagagacacttccaagcacaagtggagggatttggatgagatgcattgccaaaaaggggggtgagacctagcactggtgacaaggaggaggctggagctgtgtggcctctaaaaccagggaggggctcatgttttggggatggctgagttaactcggtgcagaggcaggggaatgacaagtgagactcccagagtgcctctcacccaagcaggcagaggttctgtgttctccaggtgagttaagtctctcgggggcaaagctgggagtccactcaccttggccaggaactggctggcctgagaagccagtgcctgggtctgctctgctgaggactggtcctcagagatgtcccggttctccggaagccaccccagggtgggcatgctggtaagcgaggaggggctcaagtctcctcgagctgatggccaccctggaatacacaactgctgaaagctggggccaagaacagtccttccaggagctgaaggactgaggctgaacgtcaaagccaccacctccatcatcaagttatagctcagtcaccatgtgcgatcttcacatcagccccaggaagtgggctgggtagaacattgtcccccatttacaagggagaacaaggtccagatctgccccaggccacatggttggctggagcagagctacgctaggcctctgggttcccagtcaacagcgtgggctctcacacagggagacgtgagttccaatccagacacttcccctccatagctgtatgaacttcagcgtgtcctcacctctccaattggtccccttggctgtcatgggtgtgacaacagtgcacacctcagcgggttattgtggggattaagtgaggtcacatgtgtcaaggcttagcacagggcctggctgagatatgggctccccagggacaatgctctatgttttcaactcacccagggtcaccaagatgccaagtggcagggccagggctgcccccaggctgctgtggatcaaagcaggacactttccacatctctgacccttttgagtcaaagtgcccagggtggggccttgcctccctccttcccctggcctgaggccagcgccatccccagggtgaaccaagtcagtcccacagagcagaatcccaggcagaaggagcctccagctgcagctcttctcccggactcacctgaggccgcagaggcctgggggtcctcggccgggcccggccaccactctgcagagcggggctgtgggatggtgaaggacaagaccttggtcccctggggcaccattcccgtgtggatgctgtggttgggctggggtgggtcagagaacaggttcacctgtggaagcagggaggcacagcacagccaagtcagggtaggggcaaacccacctgaaacgcctcatcttcattcaggagctcaacacacatgccctgtagtaataaataccatctttcagtgcagcccttggctaggccaaacacaggtgaagaactgcatgccttttcatttactcttaatggcagtcctgaaaggaagacagggtggggaccccaacagcccattatatagaagaaaaaactgagacacagagaggttattaagtcagttactcaaaatccccagctgataagtccttggatgaggatcacaacactgctctatctgaccccaacacctatggttctcctattaacagtaattttttattaataatgtgtgttataattatatcataattaatataccatataacatataattatttcttaacaaatataagcatttctaataattattatactgataataatagcaactaatagctattcgaatgaatgagtgaaccagcaagtaaacaaactaatctgccattggtagcggatctctatcatttgaggatggatttaacatggcagccagcccagttggtgagggagcagtctggagtcaggcaggtgaccaaggaaggcctcttgaagctggaaagcagagggaaaccacaggctgttcaacagcttaaagcagagttgagagaactatgttctgtttttgtaaagaaggttttattgaacacagccatgcctgtttgtttatgtgttgtctatggctgctttcacactctggtggcagagttgagtagttgtgacagagactatatgctccacaaagccaaacattgtcacaatctggccctttacagagaaagtttgccaactctggcttagcatgtgggctctgcagctagagcccaggttcctgtctaggctctaccacagcacacctctgagtcctagttggtttaataacctctctgcgcacaaaataagtgctcaataaatagtggccaccaccctgacattcatcaccattatcttcaccaccaccgtcatcaccactaccatcattagcatcaccatcagcatcaccatcagcatcatcaccatcagcatcatcaccaccactgtcattaccaccaccatcatcaccgtcagcaccataacaatcactattaccatcaccatcattcaccatcattaccatcaccatcactatcaccattatcaccaacaccatcactattaccaccaccatcatcaccatttttaccattaccgtcatcatcataaccatcaccgtcatcatcgtaaccatcaccattatcaccatcaccgttatcgtcatcaccatcattatctgcacagccaccatggagacaggcccgtggaaaagcaacaccccttagtgggatttgctcatcatgatgttggggggttatcttaactgcccccactgcaccaaggtcaggaatgagcagtttagggtgggcctggtggaaggggctccctggcccccaggcaagcaggctctcttgcttaagctgtataggtcccggctgtagccgaaaaatcaactccaagtgtggcatggtccccgccgcctccccctctttcaggcccagcctccccagatgagaacaaagctggattttaataatcccctcagccatctgctcagactcccctgtgggggcctttcctatcagcacccctctcctgaggtgacccaaatcccaggggaggcccagccctctgacatgtttccctccccagacccctctctcagcctcaggccccacctagggagtgacagggaatggggatgggccagggaagccaggaagcccttttgtttcagggaccgataaggagtttgaagcagagaagcccaaaacctgagcagatgcccaggcagagcgatgaggtggggagtggcggtgggggtgggggtggcagctgcagctgctccggccaggccctcccagggctggtctctctggacacagccagggtgtcccgggtgctccccaaggctggattcactcccttgggggattctgtgaaaggtgaatcaggattctgtgaagggaggactagtgaatttgggaaacattgggttaaacaaatgaatattctctgcacagatggatttctctcagcctttaaaatgctaatgggctttatgaatggggagggaggggaggaggaagagagagaggaagatgtttccccaactcatctgcatacagaagcctccccctccccccatccccacccaggggcttctagaccaacttgcagccatcagaacacactgaaaagaggtggttttacatcatctccgtaattccttcttgggtaatttctggtcacctcagctcttccagatccctcttcagctgagatggaggaacaggggctgggggggaggtggcaacatggcagcaaatgcagtgagatcactataaaccctggccagaggccagtgtagagaacagagcccaccagtgactcctgaccagtcctggctccctgccccacagctgggctccctggtcctgccccaaccccaaggctccagacccatcggtgttcctgggccaggcctccccagctgcagatcccgcaactaccaagtctagttctgctagagtgtggtgtcactcgtgggcttcagagctaggctgccgagttccaactcctgctctggcacctacttgttgaatgatcttggtcaagttatttaacctctctgtgcctcagcttccccaactgcaaattatttaagagagtggtccataaacatcacctatgaccattcttattactataacagtcatcaatccacctcatccctatgcctgtctccacacccagtgccagggcctgagtgccagggcttacccaggcatgaggaaagaaacacctgttctggaatcagggagatgtaggtttcagtcccagctttgcctgttgcaccagctgtgggatgttgagcaaaccattccacctggctgtgccttggtgtgtgtgtggaggggctcaaatatgaccctgaagctggggtgggatacctgttgctgctcagtgaatgtcaatctccttcctatgggtccccatccattgctgtccacctacccaccatgcctagcctgggtgtccagcgcaacatccccagcgcggctccctcccaggtgggtccagccctcccccgtgggctctgagcagagtgaaatggctcggtgggttctgaggactgcctctgaactcgtgggttctgagcagaagaccatcctggggtctctccagccttcggggtagagtgcacagaggtccagatggagtgaggcactggccagctggaatctcagctcccctcaagccccatggacccagagtgaatcccctccctgttccggggctctgtgttctcttctgcacataggagctgcaagcctgccatgtactgttccttcagggcagctgtgagatggggttgggcaggagatgatagtatcatcctgcttccttccggtagagccctgaatggtgctcacacttcttgaggctgagagaggggttgggggagggagcagagccctcgggccaagcaatcatttttccagaaagcgggagtgagtgagctggcacagaaccatttctggcctctcctgtgacaccctcacacacatgagccaggggtctgggtgctggccagggcagggtgactacacatgggggggaccctgagtcctactgggtcaagggagcacccacgagaggagataccccagctgtgctcccccgtgtccacccccgcctgtcactgtggctggcacacaagaggcctggcagtaaacacctttataatattccctaactcttacaaagtgcctgcctagtgccaggtaaatgctttctgtatactgactcatgcccttaaacgagtgcaggaggaaggaagggaggagggagggtgcagacgctccacgcctccagcccccgccactccatgaccttcagaggcccctatcccaacgggagccccagtttcccaatctgccaaatggggaagcccaagtgtttgggtctgatgaccagttcctttctccttggacctacttggagtctgcagccatgggaatgtggtttccccagagaggatgacctaacaaagccccttccctccctttcccaactcccccgtctcttccaaccctggatctggctcagtggttcagaaagctggaaggagcctgcttggctcccaggaggaagtctgattagcccctcttttacagatgtgcccgatgaggccaagagggaagggtcctgcctgtgccaggcagcaggtgtggggacgcagcggggggggggggggtcctggtcctagaacaggcccccttccatttcctcaccacagtggcctccgcccacctgccccggaagtgcctctcgacattgagagcagcagctgtggcaggggcagggtcctggagcatgacagggggaggcactggggcatctgcatctctgcacctcagctcccacatcctcctctactgctgcctgatgaggcaagaggagggcacagcaaaagcaggaagccacgaggggccgcacaggtcccacttcctgcctcactcagaaaagaggaaggtgcagaattcacagcctcctccgaagacggggtgggggctggggtggtgggttccccctctgctctcctcctgccccatactgctgttcaggggaggggagaggctgtggtgaggtggtggggagggagaaaggcaaaggtgtgatccaggaagattcaggcccaaaaaacaagcaccaggggctgagcagaaattctgtgttactcttttgaggctcacagagcccaagtaacgtccttaaggtcacacagctggttagcaatggagccaggagtcgaacccaggtggtcttactccagaacccatctagaaggagagagattctcatgaaattcctgggctcatggtagctcaggcctgtaatcccagcagcactttgggaggctgaggcaggaggatcacttgagcccaggagttcaagaccagcttgggcaacaaagtaagaccccgtctctacaaaacattgaaaaaaaaaaaattagcagggaatagtgatgactgcctgcattcccagctaccagggaggctgaagcaagaggatcccttgagcccaggaggttgagattgcagtaagttacgaccatgccactgcactccagcctaggtgacagagcaagaccctgactcaaaaaaaaaaaaaaaaaaaaaagcccagggaaggcaaggtcactgcccaaggtcacagagggaccttggggtagaagaaaactggcgttccactatctccagggcctcagtagatggaggaggcagtggcctttctctaggactatggaaaagtgtcacctcctcggggacttgggcccatgcctccaccccatcccggcctggtaccttggccccgaggcgtagctggtcaatggtgttctcggcctcagcgtacttggtgaggagcctgtggtagtcttcctgcagaaagcgggagcaacacggtcacatgcgcaggcacacaatgaacccctccttgctgggagaccctgatagcaaacccccttccataagggcttctgggttcctgagaggaaagcattcaatggtgggatccgagctgagcaatcttcaggcttgtgtgcaacacagacccaccacgttcaagttctggagcatgagagggcagtgggacaactcttctacccccatgacaacgggtctagactgagggcctctggctggtttaccttgatacataacccatgtcgcagatggctgccactgttttatttctccaaatgccctgcccaccggttggctctgtggggtgaggcccatatctttctttccccctgctgcactgtcggtgtttaagaagcatgtgcttaagaagtacctgattttcaatggctaattgaatgaatcacccaagagtcccatggcagagaaatagaagacttaaaatcactgttccacctactcagagtcacttatcttaaacaagtccaaagaactttataaaaacaagtcattgcaggaaaaaaggaaaagcatgtcacctttgaaggatgtgaggaactgactccttctgaaaacgggtcggtaactaagtaagtaccattatgggtcagtaacggtaacagtaaaaggacagaacggaacatctcgctggcccttcccataggaacaagaacttggtaaccaagtagttgatgagggacacttttactttttagcatatttccagcaattaatgcaggaatgagagcattagcatactaccactttgtcacctcaaatgaaagactagcccaagacaatgaccatcagaggctgtcaaaatcaccaacaagagagcagcaggcatcctgtgcttactgaaggaggcactcacgtgctcttgccaaaactccccacgcccgtggagctcatggtctggaagggaaatggtcatgtttctcctccagaccaccaaagcctctagctcaaaacctaacaatattcaagaaaaagaggacaatgggacgcatgaaaagagaccacagcacatcagcaaagcccagactgcggacgactctgcaggacagactgatttccgcaacaaatgaattgcacggcagaagtaagaaggaggacggactaagagagtaaaagagatctgaaaaagtaaatgcaagaaagaaagaaagaaaaagacaaagggagaggacagacttgaaaggcaccaaatgcaatatacaagccatgtttggatcctgaggcccatggacgggaacgaataagccatttatgagacacagagagatctgaatgcgggtgtgatatttgttcatatttaaggacctggtgttaacatttaggtgaccatggtatgtggttatgtttaatataaggtctttatctttagacatacacacactaacacatttttagataaaaggattggatgcctgaaattttgcttcaaaataatctagtgggggtgaataggggagaggtaaggccacaggcgagaaaggttttcggggctgctaattgtggatgcggggggtaggtacatgggagtgtattctacgatcttctctcttgtatatgttttaatttttttatagcagaagttgaaaagaagcaaacagatcatccttgaaacacgagtacaatcactggtctttttgagcaaagggcttgggtgtatctcagggctccaggtacaccctccctccaccagcagggagttcctggcccaaaccccaggcctccctaccgcagccagcctctaccccagggcttcctgcccaagccagcctccaccccaggcctccccaccccaccagcctctatcccagggctctccacctcagccagcctccaccccaggcctccccaccccaccagcctctatcccagggcttcctaccccagccagcctccaccccaggcctccccaccccaccagcctctatcccagggcttcctaccccagccagcctccaccccaggcctccccaccccaccaggctctaccccagggctccccaccccaggcctccccaccccactggcctccatcccagggcttcccaccctagccagcctccaccccaggcctccccaccccaccagcctccgtcctagggcttcccaccccagccaggctctatcccaggcctctccaccccagccagcctctactccaggcctccccaccccaattagcctccaccccaagccaacaggggccttggtgacacatccacagccatgagtcccactaacctggagctgatggaccagctcagtggcttgctcaggcgtctgaaattcttggggtaccctggtgatagggtgggcaggaggcgtgtcctttgccagggctgcttctccactgctcaacagcacctcctgcacaatctcagctggagacttgaagatgaggggcctggcaggggcctgaggcttcctgttgtggcttctggacttggggggacggtagctctcatctttggggaatctcacccggggccctaccttggagaaatcagggagtgggtagttcaactgcccccggccatacttgggggcattagaagaggagcggccagccagagtggctccctgtctgggcagcggcctgccctgccgcgttggcctgggctggggattcagggggctgatggagccaatgaatcgggaagggagtggcttaggtgacgtctttgtctgcttccagatgtgttccttgggctgagggcagaagaatctggtcgtttctctcctccatctatctgtggcatgctgcggactctgggctgggggagctgaggagtcctggaattccatgggggttgcccgagcaacactgcctccagttctgccatctgggcttaggaggtggtggctggggccctctggcaaggtttctgccagggcagtgggctgggggccatcggtctctccttcccaggtagaatcaaggctgtcactagggtggtcgaggctcactgtcccactgctccaggaccttgccgggctgagttcaacggatgggttgacctcggaatgttcagaaagtttgtccccactggcttgttcgccagaagccacccagcccctggcctgaccatgcccaagagccatggggctggtgtttccatggccttccaagctgagaccagcctcataccccaaccttgaggagctctctccagcctcctcaacctccagacttccgagggtcccatctggctcctcttcagtcatgtccagctgacggccctgctgggggagccaggcaagaggctcatgggaacttgctgggctgtccacatcctctgcttcagcctctggaaagacaggccattcacttcttagcatataccagctctgcacccaccttgtaacttaccctaagtcacttcaactctctggcttccatttcctcatcacgtggggatggaaagaatcccaaggtggtggtagacttagccaagtgcttgtctgatacctgatctgattatctcagaggtccttcaaactcaaactcaaacccaaacccggtggatggtccctccagtgtctcccatctcagcagacggcaacaccatcccctctatgcatacaggccagaaggctgggaggcatctttgccatctctctccctctaaccccctgaatccattctgtcacttggtcctgtccaatgggacctcctataaagatcgcaaactcatctactgctctgaagtctaccaccactaccttagctcgcgtcccatcctctcatctggctaactgcagtcagtagccacctaaccatctcctctatcctcacccacatcccacatctgaaaactcatccatgtcttcctgtggaagaaaagcagaaccttcactatggtcctaaggtcgctgccaccccggccccattagctctcctgatccatctctctccatggcccctcaagctccccctgctcctgctatgtgcacacaacgctcctcccaccatgggggctacgcatgtgcgcatccctctgccgagggattctctcccctccttggcctagttaactcctatctgtccttcaggcgttcgctcaacctctgcctcctcaaggaagacttagctctccctgactaggtcaagttctcccttttacaggccctcataggactggctccctctactttgtaacacttatcatagcagcagttttccatttatttgtgcagttgtttcattgacatttgtctcgcccactacactgcaagttctatgaagccaaggatgctctctgttttgttcatgattatatttgcagtgccggtacctgacactatttgttgactaaacagaaggaaggagaaaagggaggtgagtgaggaagagagggaaggaaggagggagagaggaagataaggtatataaagcccccaggaaatagatagttattgtaattattacatagtgggtactcaagaaatatttatccatctacccacccatctatcccgccatccttcctcccaacatccatccatctacccacccatgcacccattcatcacccacctgtccattcatccatgcatctaaccaccatccatgcagtcattgtttatggagcacccactctgctctagaccccgtgttgacctcagggataagtccaaagtttcatgagacatagtttgggtaccaccaggcatagactctctgttcaggcagatgcacctttgtcgcactctctgttcctccatgctctttcccctacccttgatgcctctacgtctcttaaccacttaacatgtccttcagcaagttactcttgcttacagcagcatacttgaagcccagggaggttacgtaagttgccaaagatcacccagtggttccctggacctaggacccaggccccagccatgcaggtgagtttgcttccaccactaggggtcacgtactaggggtgaaggggcctgggctttggagctagggagccctgggttcaatcctggctcctatcacccctcactggggccacgggcaagctgctgacctctctggcaatccatagtcaaacttgaggatagttcctcctacctgacagagggtggtgaggagggaacaagagagggccagaccctgcccagccctgtgcctggcacatagtaaaggcacaggacaaggtagcagctgttacatcatagcagggggttaccatgtgaccccaggaagagatgcctctgccctgtcgacccagtgcatctcagtcaccatcccctgctggagagagagctcagaaatggctcctcagtgggcagtgcccactttgagcagatcaggtgtgtgaaactttgagtaatggcacaatccactaccagaggaggcttctctaccaaccacaccagcctgcgggagtcacaggaccctaaaacaggggcatcttgctcataatctaagtgcaatagttaccatatattcagctcttactattctccacgatatgattcctctcattttatagatggaaaaagcaagattcaggcagaaggaacttgctaagcaaagctaggaattcagtctaagttggtctggatgcaaccagaacacagctattgtagaaaacaagaaatgccaacgttcccattgctaattgggattttaaaaaaccttaaaaatgtccaggcatgacggctcgcatctgtaatcccagcattttgggaggccaaggtgagaggctcacttcaggccaggagtttgagaccagcctgggcaacactgtgagaccctgtctctacaaaaaatacaaaaattagctgggtgtggtggcatgcacctgtagtcccagctcctcgggaggctgagttctgaggattgattgagccagaaaggtcgaggctgcagtgagccatgatcatgccactgcactccagcctgggcaacagagcaagactctgcctcactaaaaaaaaaaaataaagtcaaaaatggacataaccccgggactaagtaattcaaattaccaaagatatgatcaaatcaagtgtgcaaagatatattaatgacattcatcactgcattatttataacagcaaaatctagaaactactaaaacgcccagcagtaggagactggccaattaaccatggaatatccatggaagtctaggaatcacttgtgggagaggatttgatgaactacgaaaatgttcacatctattaagttaaccaaaaagcaggttacaaggaagcatgtagaatactgttccttattcacattacatttgcatatctacacatatggaaaacagtggttatcaggggatggagtgggacaatgagtaattttaaattttacctaattttgtgcttatactttccggttgttctgcaatgaatggtattatgtatacaatttaaatctttaaaaatttttaattacagactttgtagaatttaattgaaaatgctgaagcagcgtccactcccttcctccctggaagaatgtgtgatggccgggcttatgcctgtaatcccagcactttgggaggccgaggcgggcggatcacgaggtcaagagattgagaccatcctggccaacatggtgaaaccccgtctctactaaaaaaagaaaaaaaaaaaaatacaaccgggcatggtggcgcatgcctgtaatcccagctactcgggacgctgaggcaagagaatcgcttgaacccaggaggcagaggctgtagtgagccgagatcgtgccactgcactccagcctggcaatgaagcaagactctgtctcaaaaaaaaaaaaaaaaaaaagaacgtgtgatgttttggggacaggacaccactgtagggggaggggtgtcagtctcaccttctcccgaagtctctcctgactcggaatcctgatgcccatcgggctgcgggtgtgggtcccactccaggggcggcaggtgctgctgggccaggcggaagtcctctaggagctcggggctggtggcattgggaaagagtctctcttcttcccagctttgtgaactacttctatccacatccctcttgtcctcggcccaggcccagcgccgccgctgggggcccttccccaggccaggctcagcccagcggatctcagtctccgagctggccattggggctggcctgggcttcacctgggccacttcatcttcaggagacagagctgctgccaggggccccagagtcaccgctggttcctgtcagcatcggccatcctgcctgtgccctgtcagggacacattcaagagagaacattaatcaatcctgatcccctcttttattcggaacaagaagttaccagcaggaactctggaattagccccagttcaactcctggttgtgtcctcccgaagctgtgtcaccttgggcaagtcactctgccttcattttcttcatcaataaagctgggataataattcctctctctctccagggtttttttttttttttttttttttgagacacagtctcactctgttgcccaggctggagtgcagtggcacaatctcggctcactgcaacctccgtctcccaggttcaagcaattctcctgcctcagcctcctgagtagctgggactacaggtgcacgccaccacacccggctaatttttgtattttttagtttcactgtattggcgaggctggtctcgaactcctgaccttgtgatccacccgccttggcctcccaaagtgctgggattacaggtgtgagccaccatgcccggccccctccagggttttataaactagatgagacacaggatgaggagcccagtggccagtgcaccaacgaacaggtgttgaatgcatgctagctagtgttactgcgtactggctcttcgtgtgggcatggggcacaggccctgctcatgggagaactgatggcccaggaggaagcagacgatcaccaggcaactacaaatccaggtgagatgtgctggaggaggcacgggggctgccctgacacaggccagggaagtctggtgatcccagtttagaagccggttcctccaagaatcctctctgacctcactggggtaagaattcagattgagaggtgggggaggatgatgaaaaaagcattccaggccaggtaggagagctcacgcctataatcccagcactttgggaggctgaggcgagtggatcacttgagtctaggagttcgagaccagcctgggcaacatggtaaaaccttgtctctacgaaaaattagccaggtgtaattgtgcacacctgcagtcccagctactccagaggtcgaggtgggaggatcacttaagcccgggaggtcgaagctgcagtgagccatgacagcgccactgcactccagcctgggcaacaaagtgagaccctgtctcaaaaggaaaaaaaaaaaaaaaaaggtagcattcctgtacccaacataattgaaaaacaggtgctcaaatgaaaaggcatgaagtcccaacacatgctacagtatagatgaacctcaaaaacattatgctaagtgaaagatgcgacaaaggtcacatatagtgtgattctatggataggaaatatccaggcaaggtaactccttggagagtgaaagcaggctggtatttgccaggggctgggggagaggagagcgggcactaaatgcttgctgggtatgggatttccttctgaagtgatgaaaatgttttgcaactagatggaggtggcagttacacaacactgtgaatatactaaatgtcactgaactgtttacctaaaaatggttagttttatgttatgtgaatttcacctcaatttaaagaaaacgccttccgagtgaggagtgaggcgagctgggggcggggagcaagcctaccaggggctttcctggacctgggagtggtttcgccgccgatggctggggtattgaacacagggaaagcccatcagaggtgtggtttaaaagttccccttgggctgctctgggagaatgaaccagggaggctggccacacgggggacccgtcaggcggctgctgcaggaacagggtagccagagaagggctcctccgctgccttccctcaaccctctccttctttccctctttccttctccctctcatctccttttgcctcttccttctgacgctcctgctatttccctaagcgcttcctctatgccagcactgagccaggcccaggaagtgcaaagctgacccagagtgggcacggtcccccagggagctccctgccatggagggttcagagaactgcagcccatcagtgcagcggcccccagagcagctcacacaaaggccttcttccacagatggggaaactgggatccagagaggggagaggccttgcctaaagccacacaggggtcaggacaaggcaggggtgaaagtcagcctcctggcccacagtctgggctttctcccctgcatgctgtgttgaaggcagtatgactccaggcctcccaggacagaaggtctgtgtttgtccctttatcctcatgaacacttggatcctgcttgatttgtgtggctgagaaaagtcagcaggcaactatttttggacacaaagttccccagggaacagtgcagcccgggaaaggctgacttctcaagggctggaggagggaggtgcagggaataccattcttccctccttggctgcgactcctgctctgtggatgggtgttcggggcttctatcctctgtccccgcccagtcttcctctctacccccaaatgcagagccctacaatttcctccagatcaccctgtgtattgtcctccagccccacagtccctaccacatgtgaagagcccactcggcgccagcctgggttgaagctttacttttaaattctcaatctgccctcctacaaacatgagggtagaatttggctaagatcacccagctacttcctgccacagcaagatttgcaactgtcaattctggcctagtggtaccccaatatttttttaatcacacaatccatcagtaaaaatatatttgctcgaacacatcacgctaatatattacatgtattggaaagagtattttcaaaagtgatcttctaaaaagatgcaatcgaaaatgggccaggtacagcggctcacacctgcaatcccagcactttgggaggccgaggtgggcagatcacttgagctcaggagtttgagaccagcttgggcaacgtggcaaaagcctgtctctactaaaaataaaaaggaaaaagaaaatatatacaggtgacccttaatgacagtttgaaccacacaggtctacctatatgtgaattttcttctgcctctgccacccctaagacagtagatcaatctcccccttaactcctcctcctcaatgtgaagatgacaaggatgtaggcctttatgatgatccacttccacttaatgaaagtaagtagattttctcttccttatgatttccttaataacattttcttttctctggcttactttattgtaagaaaacagtacataatacatataagacagaaaatatgcattaaccaactgtttatgttatcagcaaagcttccagtcaatagcaggctattgataaagttttgggggagttaaaagttataagcagatttttgactgcatgaggcactcctaacccctgtattattcaaggatcaactgtattttattttattgagacagggtctcactgttacccaggctggagtacaatggcaatcagagctcactgtagccttgaccacctgggctcaagcgatcctcccacctcggcctcctgagtagctaagaccacaggtatgcgccaccatgcctggctaattttaaaaatttttttttgtcgagatggggttttgccacgttgcccaggctggttttgaactccttgtttcaaatgatcctcctgcctcggcctccctatgtgctgggattacaagcatgagccacccacccagctggtcaactatattttaaatagaagctctaatccttgcttctcataccttctgcagggcctgtacccttcttggaaatccctgccagggatcttaagcttcagtgtgcttaagaatcctctaagcgtgcagtttcctgaaacaacctgcagagagcctgactcagtggccctgggatagggcccaggaatctgcattttaaaccagggcctcaggcagggcctgccctttgaagttcactaggcctcctggctcctgctgttatggcaggtggagaagaggctacaatttagctgttgcttttctgattctgaagcctctgctgaggaaggggccgggggaggtgtgcggttttttgactttttaaagggctttttttctagctctgccacagagcagcctgcccaatcacagagccctctgggtgcacaaagaggaacatcctgtcttctgggatgactcagtcgtggcagaaatctcactgtaaccaggggaaggtgcacgtcagaggcagctgcagtgactgactagagtttcgcacttgcccccaggcgcctaaaccagtgagcctttcctgagccaggcctctgccttccatgcgagccatggccctcctcaccacaaagccccagaactggccagtcagctagtcagtcaacaaacacacgttagtgccaactacctgccaacctcaggctgggacgatgctgtgatagagaagcaggctgggcatcaggagacaggtgctagtcctggctgctgttactcactgtgtatagctgggcttgcattttcctcactgtaaaatagagaaagtaccacctgctcttgatatcgcaaggggatatcaccctgctagggtgggttgggaggcagggtatgggactcaaagagctttgaagtccctgattgactcagcttctaagggcaacagcctcagaactgttaacctctctcctcctccctgaggtcacatttcaaagtacaaagatacatactgagcacccagtgggcgcaaattaactttttaaaaaagccctatgacttcctactatataccaggcgctacgtaagatgcaaagaatatagaaaagagtaaaagtgttccaagattttaaacggtggggggtagtacaatacagaagtgttaccaaaggaagctttaaggtgggcttgagaaacaatgaggatttgggggagaagactggggagggcattccaggcagcgggaacagcacggaggcaaaggcacgtaggtctgaaagtatggcctgaccttgaaggagagctatgggcaggtgtccctgcatgccagataaaggcagagttgttccagccagccctcgttagggcagcagggctgctcctaaaaggcagtgagtggggtttggtgaagactccagcagtgtgagctggggagggctatggagttcagggtccccgccatccctggagaaactggccccacaaggaagtagcagccactgcaccctccttctgcacatctccttcttacacccaagccgccactgcccctgctctctcaagggtctaacagacccctgaggtgtctatcttcagttcctgggtgggatggactcttcttccccaccacccacacagggcttctccgcccgctcagtcattccacagccagggacccttccctttatggctcaatccctcagaactgcccagacgcccaggctctcctttgccagcacagctacgcagcccgcacagcctccccgtgccctctgcagccccttcccatccagccagagctgtccagggtgccaccctgcttctacccccacccacaccctgacacctcccagatgaagacactgaggcacagagacatggcctgctctcacaagacctcacagccaggaagcgcagacagaggattcaaagctggggtaccgcaactctgaaaccaaggctgtcagatgtgtcagggagatggggaaggaagaccaccccccaaatcagtaaccagaccttccaaaaaggctcaaccatacccccacccacctgctggcagggcacagacttgctgttctcaaggggttcccaccagctgtgtggactctagtcccacaaggaagcaccagccactccctctctgtgtcctccctgcccccagcccgctccagcagcagaggccgaggagaaagagaaacggtgccctggctgttgccagctctggtcttgccatcctcaagagctgagctgggtctgctggtcctcggactgtccttggctcctctccttgctcttacgcagctggcataaggggccactccttcaatagggaccaccccccggcgccgtcgctgcctcctggcctgctgcccatgcctgcatcgtctctgagaccccttagcaaccaaggacactaactctccaggtgcagacgacgacaccccaggcacagagatggacccgcctacccaagttcacaagagatcagaatcagagctaggactggaatctagcatcctgaggcttgacgaaatcctccttaaatccacccttgccctggaggccgggatcccctaagccaagagaaaagcggtgcagctccagcagctgcaacttcctggctgggctggtccggctgcctggactgtcccggagagtctgtgactggcccgtccagaaggaaagcggcctcccgggccctcctccgttccaatcccttacctctctcgggctccaccaccgtcctgccgacccagtttcaggggacctgcctgtgaattctttgttccaaacccagggagccccctgtctccattgcgccctggcccacctccaggccgttctgccagcccaagctgctgctcacagaccagcatcgctccccacctctccccgcccctgccgtggttgaggccgcctcgcctcggcaggaagcgcccagcctgatttcctacaagtgtttgtcagaaggagggggtttgtctgcgtgcagagcaagagctggaggagcttaaccccttgcaagccctccgcagtcagcgctgcccaggaaaggactcagggaacaaactcctgacgtcctgggcttgggatcatctcagcccaggccctgcaggtacagatggggagactaaagcacagagaaggtcagaggcttggccaaggtcacacagcatgctgtagctcctaccctctaggccctcttcaaccacggcctgaccttagccgaggctccttccctcactaggcctcagggcccatgtgcacggtgagagctcagactcaacaccactcctgcccttccagctctgactctgccaatgtgcaacctgaatctcagggagaccgtggtgattcctgccatctcaacccaccgtcctcaccccgaggtggtcctgcagccagagtgggatgttcggggcagcatggaggtgtgaacctggcggatcaggtaaactttcccttgttgtaagaaccctccaagggttcaccagatgttgggaacagatcgatcctgatggtcagtcgagctatctttcctcaagccccaccatcccattccttcattcgtaggtactcactgagctcctactgtgtggcgggtgcttttaaatcacctgggaatatggcagggccgaagacaggccagtcccctgctctccactctagcagagacatggacaataagcaagcacatgtataatttcaaggagagagctgtgaacaatgagactgggtgacgatccgtgtcccaggccaggtggcactgaagcctggggctcaccccaggccaacagagtcagtctctgggcatcagacattttaagtgtcccaggtgactggccctggtagagaacacatggggccaagagtaatgggttggaggagaagggttataggacggtcaggaaggtctctatgaggaggtgacattcaaataaggcactggaaggaagaggggtcaaaagcaagccacaagaaggtttggggcagagtgttctgggagggcaagtggaaaggccaaggtgggggagccagcgggctttccctgagaacagcaaggcctgtgtacccggggcagagcgagtcaagcgggagaagcaggagcttcacagaaaagcgggcacaggagcacaagaggctcccaacactggccccacccaggacccagagactctgagtcaggaaacaaaaagaaagaggaaaaaaaacaggcctctgtattgtccaaaaagccctccaggtaattctgataagcagccagatttgggaaccacccatgtaggagagaaaaaaatctcagagtcactgtggacctgggttcaaatcccagccccatctcctgctggccctgacctttgaggcttcacgtctctaagcctcagtttcttcatctgtaaaacagggataagaagagtagccaccccacaggggctgctataaagattcaatgacatgatgcctaccaagggtagagcgggggagccagaacacagtcatgtattgagctattttattattgctactacaactattgctgctacttaggtataagtctctggtctcctctaaaggctagatcttaatatctttcctgaagcctggcacactgtttatggctgatgaatgtgttctgtgaatgaatgaatgaatgaatgagtggacgttcccaaggtcagcttgtgaatatctggcgtagccagggctagaaccaggagccctcatcctggtaatcgcccacccctctatcccctttcctgccttttacccacatctgggtggcagggctctccctgtagcccccagccccacatggagcagagccaaaccctaatgaggcccctccctatcagctctggaggccatgtgtgccattgtgcaaggggcgggctcccctgacaccctgtcactcactcaccctccctccctggtcattaacccaggcagcattaacccaggtggctgccattgctgggcatagcctgtggcccctggataaccccaaacccatctcaggggcagccacctaacaccaaggagaaccgcctgcagtgcagtctgttccatttccttgcacccccaagcatgaccaaccctcctccctgcctttgctcatgcactgccccctcttggatcactgtccccacccacaggccaaattctaccaaaccgaagcagcatgtctaagactgagctcctagtattgccaccctccaaacccacccctccttagtttggcccatctttcacccaggtacacactgagaatcaactgtgaccctggacacttccttttcccttacatcccataaccaatccatcgtcaactcccagtgatttcatttcctaaatttcaccagaatctgtccccgtttctgcatccccacgtgggtccctggatcggccttgcctggaaagctctagggtccactaatctgttccccacactgcaccgatgtggtcttccaagataaaagttccaaacaagacccttccatgcttcagacgcacagctagctactatggctctgagaaagaagatgaaactccacaagctggccgctgctgcagcctcttctcccaccaccctctctgcccttgctcagcatgctcctgccatacaggcctccttgcttttcctgggacagatgtgtcctgctcctcccctcacccagtcccacttcttttccctgttaacttctaggcaacctccagatgtcagctccagcgtgccctccttggggactccccatttggaactatatttcatatgtgattatttgattaacatctgtctcttcactcagttgggagctctgtgaggctctcatcatcatatccccaggacccagcacacaggccctgatatacaatagaaatacaataaatatatcctggatgatccactcaacctagctacttgcccaagcctgactcatagccctcataacaacccaatgaggctgatgtgacaaccccatttcacagttgggtaaacagaggcccctagagcccaagcagcttgcccaaggtcacaaaggtgatgagctgcagtagagtttcaaacacacaaagacctggcttctaataaccaagcttggtgctcacaacattgcagcccgcagagataattaatacctgtgcacaataaaatcgagagtggagcttcttaccaactaattgcaattcacaaagccaatgttccaattttatagtgaggccctggttccacacagagccttttggtttcccaaaatgctttcttctcctttatagcactagatgctcaagaacagaacgtttaagtggggagaacacgagtattattccattgtataggtgaggacactgaggcccagagaagagaagagaagagattcgttcctggtcacccagaaaagaaacaacaacaaaaacctctgactcctggccaggtgcagtggctcacgcctgtaatcccagcactttgggaggctgaggtgggcggatcacctgaggtcaggagttcgacaccagcctgggcaacatgatgaaaccccacctctactaaaaatacaaaaattagccaggtgtggtggcaggtgcctgtaatcctccctgtaatacttgggaggctgaggcaggacaatcacttgaacctgggaggcggaggttgcagtgagtcgagattgcaccattgcactccagcctgggcaacagagcaagactctgtctcaaaaaaaaaaaaaaaaaaaaacaccaaaaacaaaaacaacaaaaaaaacctcttactcctactgccagggcttgatgactttcacccttttaccagcaacagtcatgtgcatggctgtgtctgcagaaccctgccagcccttcccacgagcctgaggcacaagaatcacttgaacctgggaggcggaggttgcagtgaaccgagatcatgtcactgcgctccagcctgggcaacagagtaagacgcttgtcaaaaaaaaaaaaaaaaaaatccacagggagtctgagggaaagaggaggcaggtgaggatttccagagtgaaccaagaagaaatgatgaagcctggctagggaagtagagaaccaagttccagcctgagtgaccaggaataagcaccttcctttctctgagctttggaacctgcggcttaatgagattgtctctgaggttatcagagattatcttctaatgctaaacctcctggattctttattccatttgcccacccaggcagaaatgccatgcagacaggaggctgcagagcacaggtgttaaggcacatgggctttgtgggcaaacagagaactccatgttctcccttggaagctgtgtggccttgggcaagctgcttaacctctctgaatcccagattccacatctgtaacatggaccaataattattttactgggttcttgggatgacggatgagactatgtgccaaaagttcttggccccagtgcccagctggcacagaatgactgttcacaaataaatggccttgccttttccgtgaaacgccctacaacctgctccctgcaggactgagtttaattttcctcatccacagcttccacaatatcaaccccaggtctagcgatgagtcctggacacaaaaagggagaagcagttttcccaagtggagggaggtgctgacatttccctgtgaccctcttccctgcgacccttaaaccagttccagggctcactgacccagctagaaactctgtcctcactctgagtagttaaggagcagaacaaacagccccttctcagccaactgagataagggttatgaggagggtgtggccatattgaggaaaacacatacataaattcaaattcatgctcttttcaaagagtcaaacaaaccgtgcacgtgccaggaagggactgctaacagcaaaactatactgaacacctattatgtgtcaaataccttataaaagcctttccatggactcagatctcattatttaatcctcatactaatccaaggagggaaaaattatgatgcccattttattttataggtgaggaagctggtttgaaccaagctgtttgaatctggacagtataatctttttttttttttttttttggagatggagtctcgctctgttgcccaggctggagggcagtggcgcgatctcagctcactgcaagctccgcctcccgggttcatgccattctcctgcctcagcctcctgagtagctgcaattacaggcacctgccaccacgcccagctaattttttttttttttttgtatttttagtagagacagggtttcactgtgttagccaggatggtctcgatctcctgacctcgtgatccacccgcctcggcctcccaaagtgctgggattacaggcgtgagccaccgtgcccggccctggacagtgtgatcttaatcactttgcaactgaaacttgcaataggtaaaatggttggaaacaatagcagtgtcccgtaacaggtgatcattgaaagaaattgtgatagttccactcaaaggaataatattagctgccgttaacagtcatgctattgaagaatatcaaataatgtaaaaattttgttatgttaagtggacaagccagttataaaataatatatatctagtttgagtccacttaaaaaaaaaaacagtaaaatatggaggaagaggaggaggaagaaaggaaggagacaggataggaaaaagaaagagagagaaagcaaaagaaagagaaagacatgctttaaaatgtttacaacaggccatgcgccgtggctcacacctgtaatcccagcattttgggaggctgaggcgggaggatcacctgaggtcaggagttcgagaccagcctggtcaacatggcgaaaccccgtctctactaaaaatacaaaaattagctgggtgtggtgacgtgcacctgtaatcccagctactcgggagactgaggcaggagaactgcctcaacctgggaggcagaggttgcagtgagccaagatcgtgccaccccactccagcctaggcgatgacagtgaaactgtctcaattaaaaaaaaaaaaagtttacaatcattatcactaggtagtagaattataggcaagtttttttgatagggaagtttaccatttttccttttgggtatttttcaaatataacagttgctttaaaaataagaatgaaatgaacatgtactattcttaaaaacaaaacaaacgaataccacctcacctctgtgtggtgcttccttctgaccttgggcacctccgtcttcagttgc

SEQ ID NO: 1473 - DNA, 3469 bp, Homo sapiens
acagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttacctgctggctgtggtcgcacccccactcccagctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctccccccttctccccagatcactggcaagtggttttatatcgcatcggcctttcgaaacgaggagtacaataagtcggttcaggagatccaagcaaccttcttttactttacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggttggctttaatctccaccagactcttgccccgggactgtgatgggcgattggccacttctcctcgataacattactgtttttcttccgccttctggttgactttagccagaaccagtgcttctataactccagttacctgaatgtccagcgggagaatgggaccgtctccagatacggtgagggccagccctcaggcaggagggttcaccgtgggaacagggcaggccagcataaggtgggggctggatgtagagccctggaggctttgggcacagagaaataaccactaacatttttgagctcttaccacgtgctcagaaaaaatccctaagaagacactgagagaattagatgaggaaacataagaacagagacctcaaatagtttccccaaggtcacacagcttataattagaactagaattggaactccaggctggcttcagatctgcctctctctcacgccctctttaagatcctttgcaaaccaatggtagaagcctgtatgttggagaggtggtaccttcaactatgtcccccatcaccgcagaggtggcacatggcagggatctgatggagctgaactgacatcatttagcatcccgagcctcctctctgggcctcattttcctcctctgtaaaacggggagaaaggccctgacagccacagtctgtgtgaggctcctgagatctcatgtacagaaagtgcttggcgtggagctgggcacgcagcaggggctgggcacacggtggcccaaaggagacccgggccttcactgatgggctttgtggccccggacacacctaggactcctcacctgtaagacaggcaccattgtgccatcccatgttctcacccagaggctctttttctcttccagagggaggccgagaacatgttgctcacctgctgttccttagggacaccaagaccttgatgtttggttcctacctggacgatgagaagaactgggggctgtctttctatggtaggcatgcttagcagccccaaactcatgcccctctcaggcctcaccccccattcacccacccctgggctggcccctagaaccccagccctccctggcctcccgccgggccccaccatgtccccagtcagtctccttgctccccctgcagctgacaagccagagacgaccaaggagcaactgggagagttctacgaagctctcgactgcttgtgcattcccaggtcagatgtcatgtacaccgactggaaaaaggtaaacgcaagggattggacagtgcccaccttgtccatggcccaacttgggcagccccagaggcccagagcaggaaagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccacctccactccccgctcatttttaatacccgtgcagtggggaattgatactgtggttttcaatgtcacccacactgcagcacggccacagtcaccatcccgatttttgctacaaatgaaaattactgtataatgagctccttaacacttttctttaaacctgtgtttggaagacttgtgttggtgtggccctgtgccctaatacctgtgaaatcacagcaccgatgagctggttccaatttttaaaatatatacatgcagtacttccatgactattcaaagaaaaacaattccttccatttgccacctgagatgaccaccagggatgtgaactacctcctgccccatccccagccccaggatcctgggacagggcttatgaacgcaaccactgtagtcagctcacttgatccacagcctggcacctccactgtctggctagggagcctcgaatgggtcccaaggccaccctgctcctcagttacatcatctgcatagtagtggtggttgtgaggaattcaggagctgcagcataagggccctgcaggtactatgtgctcagtaaatgccagtggttcttaagggtctgagctcccattgtagaggcaagtaagctgaggttcagagacagaaaatgacttgcccaagatcacccagctgggaagtgacagtgccagggttggagccctggttgagctggttccacaggccagagctcattctgccctctccccggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaa

SEQ ID NO: 1474 - DNA, 147439 bp, Homo sapiens
cgtcagcttgggggtgccttcgtcgcgcagccttgcgtcggcccggcccggccaggccagcgggcagatgccccgagctgccgccgccgccgccgccgactcggccggtggcggtgtgggaggtgggcgaccagcccggggccgctgagtgtgacggacgcaactgggggcgccgggggctccgcacggaccatgtattttctgagcggctggcccaagaggctgctgtgccctctggggagcccggccgaggcgcctttccacgttcagtccgacccgcagagggctttcttcgccgtgctggccgcggcccgcctcagcatctggtacagccgagtaagtagagccgcccgccgcctttcgccgctgcctccccggcctcccggcgccgtcccacccccaacttccacccagagcctaggactcctgccccttcgtgccagacccacctgccttcgcagtccgcgtcctcgttccaccgaattggccgcaggtacccgccggctgcaggcacgtcctccagccggcggtccggggtggatgaagtcgctgctgccgaaaatccctgagcctccccgcgttggaccgacggccgcggcgtgcagactccgcacgctccccggccgagcccagacttgttcttctctcccttcccccattccccgagggacaaatttgtttaaactttccacaattagaaatccggccgctgtggtgccccaaccctcccttactttaaaggtcgccgttttggagttagggaaagcctcttgggctttacccagcgccagactttacaggcctgtaataacttatttctacaaactacagcctgaattctttattcttcactaaaggtctggttatttaactcccctctttaaccccaacatcccttccccactttcgagttggtctttttctttgctgctgctcttggactcttcggaatagggggttaaaggagcggaagtagaactcaaatctgtccgcggaactcccagttataacacctggaaataataaggcttgggaggagcatggaactgaattctgtttttgctttaagtcctggttatctttttctttcttgtattgaattactgagtagatatgagaaagaaataagtggtggatgggatactccctactctctgcaaacactgctataactttgtctatgagaacgacagagttcagagtataaaaatgctttttttcctccccaaagaaggcagtaccaatcgatgtcagagtgaagtttttctcctttccaagttaatttgaccatgtggggataggttgtgatcttgtccttattaggtgttcgtgaaatactggttttagtttgttaaaatccccaaatctttgtgtgttgctgttccattacctgtaatgcccttgacagtcctcacccacttccctggtaatactggtgatgggatttagtgacgggtaattctggtgtctcctttgactgtcatagttgggctgtaaatcagactatttgccatcaagttttggctgatctaattttcaaatgcaaatcagaacaaaacaaacttataaaatcgtaataccaacaatatgactattttgtctagtgcctgattgtattttgaatatatatgtatgtatgtgtgtgtgtatatatataaacatatgtgtaaatatatataaagtatcatctggttcctaaatgagatattcgtttacaatgtatatgccagttgaataatttttaatttgtttaggtgtatataactcaactttaaagcacatgcagaaaaaaatagaacttgaatttaaattgtcttttgaatttaatacataattccttttgaatgtaacaaatttagactttcgtctaaaatttaacttttcttacctttaaaaaggcagacctaacttaattttaaataaaagtaaacaatatgacctatgaattgaccagaagcctgtaaaccactttattcccccataagagaagcataaacatatgctttaatttagggacattgtgaatattcttaagcatgtctattgtttggttttggagttacatacgacatctagaaatccaaggcagttctggaatttaaactattcatactcttctttcaaattcccacctcacatgcaacttcctttttccacagaagtccagggacccctactattaagttctgttgtgcaaaagttaggctgtagggaacccatgggtttagaggtctggagtgaaatgaaatgcaggaataccttagaggaggctgtatagtactgtagtatgagtggttaaccttggtctctgggcaccagctttgttgtcactgaaaaaaatcagatattcacgaggtcaagagatcgagaccatcctggccaacatggtgaaatcccgtctctactaaaaatacaaaaaaatagctgggcgtggtggtgcacgcctatagccccagctactcgggaggctgaggcaggagaatcgcttgaacccaagaggcagaggttgcagtgagccaagatcccaccactgcactccagcctggcgacagagcaagactctgtctcaaaaaaaaaaaaaaaaaaaaatcaaatattgaaccaagtgattataaggtgtatgattacatgcctaggtgagtgggatacatatgctagactccagcttccaatcttctcttcctgggatatgccctttcttactctgtatgaaagttttcattttgattttctaatttgtaaacttcctgaaagtatgtaagttaattaggttaacaaacttcatttaaaagtgaaaatgcctttaggtaaattaaagggctatcagttatacttccataatttagagtgaattggtttaaaaagttctcatggagctgctaaaagctttgatttttgagaggctgtagatacaagtagttttataataatatgtgaagatctacaggattttacagagttgaagtcttacagctgcttgagggcatttgaaggcagggagacatgctcgtagagatgataaaacaagatttgcttacctgaaattttgttagggctcacttagtaaatcaggctctcttaggagtgatatattttaaaaagagacaactagccttgtggaagggacagtcgtttagtagtctaagctggttgtttcaatgttcaaaagaattgtggaaattgtatgtgtacagtgataattcataagactgaatctctattaaaatctctaactgtacattatatgggtcttctaatgaacttttatgtactacttatacctactgtcctctattctaagtaggtattcggaattccactgtttagactcatatctcttcagaattatttcctaccccaaatttgagaaatacagtatagtgttgtttatgaacaaaagagcctctagatagttacttagcttttttatattggagccccaatattatattttggagccccccaaatggtgttaaaaaaaggctcagtatgtgtaggctagattggggtggtagaggtagaacttgactgggggcagttggtacatttctgctaaggttattgtaaaaggactagtttcagctttgaggatgaaactgttgcataaggtaggttatgatttatgattgacgtaggtgtagtgtgagatgaattacattttgtactgtactgagggcccagaattattcctttaatatactaactgtgactatgaaagtctatatatgtgaacatcagaatggtatctttgaatttagccattctaaattagatgtatagacattctcgtttttcaggtcaccgactttaaacatttaaattagcttcagaagtatttttgaacatcaactgtaaaagacagatgtgtataaaagggatgaagagacatgttatatgttagtgtgttagatgttagtgtgttaatataaatcttgtgagatatcactgttgtaggtagctaataaaaagctgaaatgggcaaataattactaggcttataaaataaattatatgtcgtttagtaatcctgagcaaaaacttagttcccattggtatgtgctaatcatggaaaaaaacaatgatatgtcaaaagaaccaagctttggatcaggtatgtgattaactgtgttgacctcaggaagaccattttatttgtattttcccagcattcccatttctcacccttttaactctattactttctccagagagccttctttataaattcactgctctgaagtcttctagggttcactgttgatgaaagaatggagttcaaactccttagtttgatatcacagacactcccttcttggaatgctctcttgcctcatttctgcctgtcagagtattatctatcctttaactgctgttgaaatcctttctttatgagtcattctttacctaccgtaaccataagtgttcatttttctgatgaactactgcttccccactactgccagctttgttgaggtataattgacaaataaaaattgtatatatttaaggtgtgctgtgcgatacttagatctaccctgtgagttgataatcacaatcagtctaattaacagatccaccatctcacacagctccctctttttttgtatgtgggatgagaacacttaagacctactctcttagcaaatttcaagtatacaatatatgttaattatggaaataaatgtcattattaacgatagttactgggccatgcattaggtccccagaacgtattcatcttatacctgaaaatttgtacctttgactgaaatactcccatttcacccacctcccagcccctggtaatcatcgttctattctctgttcctatgaatttgacgtctttatattccatatatgagatcatgaagttgttttttgtcttgcttacttagtatactgtccttaagttttgtccatgttgttgcagatggcaggatttccttgttttttaaaggctgaataatattttatgtgtgtatgtgtgtgtgttacattttctttatccattcatctattgacagacacttaggttgtttctgtatcttggctactttgaataatgctgcaatgaatatgaaagtgcagatatctctttgagatactgatttcaattcctttggatatatacctagaagtaggattgttggatcatgtggtagtcctgtttttagtttgaggaacttctgttttccatcatgactgtaccattttgcagtcccgtcaatagtgtacagggaggggatcccttttctccacgtctttgccgaccttgttatgatttaacttcttgataatagatatcctaacaggtgtgaggtatcttatggttttgatttgcatctccctgatgattagtgtattgagcacctattggccattggctgttttttggtaaaacatctgttcagatctcttgtccatttttaaattaggttatctgttttgtttttttctcggtactgagttgtatgagttccttacatatcttgaatattagcccccttttagatgtatggtttgcagatattttctcctattccataggttgcttttttatcttgttgattgttttctttactgtacaataacttaatttcatgtaatcctacttgtttatttttgcttttgtcacctgtgctttccatgtcatccaaaataccatcgtgaaaacagatgtcagggtgtttttcccctgttttcttctaggatttgcatggtttcaggttttacatttaagtctttgatccttcttcttattttaatttttgtgggtacatagtagatctgtgtatttgtggggtatatgggatattttgatacaggactatagtcaccctgttgtactatcaaatactagattttattcatcatcatcaccattattattttgagacagggtctcactctgtcactctggagtacagagtcatgatcatggcttactgcagcctcgacctcttgggctcaagcaattctcccaccttagcatcctgagtagctgggagtacagatgcatgccaccatgcctagttaattttttgaagagatgtggtcttgctgtgttgcccaggccggtctcagactcctggacacaagtgatctgcccatctcagcctcctaaagtgctaggattacaagcatgggccaccacacccagtccttattcattttttctattttttgtacccattaaccatccttccttccccctccgtctttaatccttcttgagttgatagtgtaagataagggtccagtttccttccttagcatgtggatatccagtttttctaacactatggtgttgaaaagtcagtgttgcaagatgtgttttctccattcttagcactttgtgaaagattgactatatatgcatgcgtggttttatttctggactccattctgttgcattggtctatgtatctctttttatgtcagtaccatactattttgattactatagctttgtaatatactttgaaatcaggttgatatggtttggctctatttccccacccaaatttcatctctaatcgtaatcctcataatccccatgtatggagggcaggacctggtagggggtcattagatcatagcgggagttttcctcatgctgttcttgtgatagtaagttctcacgagatctgatggttttataagtgtttgactgttccttctacacgctctgtctctctcttgcctgccagcatgtaacaagtgcctgcttccccttctgccatgattgtaagtttcctgaggcctcaccagccattatggaactgaatctattcaacctttctttataaattaccaaatctcagggaagtttgttatagcagtgtgaaaatggactaacacacaggtaatgtgacacttccagctttgttgttctttctcaagatggccttggctattcatgggctattgtggttttgtataaattttaggattgtttttctgtttatgtgaaaatatcattgaaattctgatagagattgcattgaatccatagattggtttggatagtagggacattttaacaatattaattcttccaatccatgaacataagatatccagccatttatttgtaccttcttcagtttatttcatcagcattttatggtgtttagtggcggttaaatgtattctaagtatttagttttttggagctaccataaatggtattgttttctttttctttttctgttttttttagacaaagtctcgctcttgtcaccgaggctggagtgcaatggagcgatctcaactcactgcagcctctgcctcctgggttcaagcaattctcctgccccagcctcctgagtagctgggattacaggtgcctgccaccatacccggctaatttttgtatttttagtagagacagggtttcaccatgttggccaggctggtatcgattcctgacctcagttgatctgcctgcctcagcctcccaaagtgctgggattataggtgtgagccaccactcccagccatgttttcttaatttattttttagatactcattgttcttgtgtagaaacacaacttattcttgtatattgattttatatcttgcaactttactaaattcatttcttagttctaaattttttggtggtttttaggtttttctaaatataagattatgtcatcttcagagacaattttgctttttcctttgaactactgctttatatcgtaagttttgcacttatgctttatttctccagctagattataagtttctggagcacagaaactatcttaatttgtattatctatagtgccttgtacaaggaagatgtttaataaacatttttaatattaatgaatttaaggtatttgtcatacgtgtggcacagcaatttttttttaagttttagtgttttgatttttgtgagaacacagtaggtatatatttatgatttttttgtttgtttgtttgtttttgagacagggtttcacttcagttgcccaggttggagtgcagtggcacaatctcagctcactgcaatctctgcctactgggctcaagcagctgtcctgcttcagcctcccaagtagctgggactacaggtgtgccccactgcacttggctaatttttttttttctgtaattttttatagagatgggatttcaccatgttgcccacgctggtcttgaactcctgagctcaagtgatccatccacctcgggctcccaaagtgctgggattacaggcatgagccactatacccagccatgagatattttgatactagcgtgcaatttgtaacaatcagttcatgaaaaatagggtattcatcccctcaagcatttaaccttcatgttccaaacaatccatatgtactcatagttattttaaaatatacaattaaattattttgactgtagtcaccctgttgtgctatcaaatactaggtcatactcattctctttttttgtacccattagccgttcccacctcccttcctatccccccagttacctttctcagcctctggtaatcatctttccactctttatcaccattagttcaattgttttgatttgtagatcccacaaataagtgagaacatgcgatgtttgtctctctatgccttgcttattgcacttaacataatgacctctagttccatccatgttgttgtaaatgaccggatctcattttttttgtaactgaatagtactccattatgtgcaagtaccatgttttctttatccatccatctgttgatggacacttccagtactgtgttgaataacaatagtgaaggtgggcatctttgtcgtgttccagatcttagaggaaaggctttcggtttttacatactcagtatgatactagctatgggtctgttatatatggcttttattatgttgaggtatgttccttctatacccagtttttttagggtttttatgaagggatgttgaatttttatgaaatgctttttcagcatcagttgaaatgatcatatagttttggtccttcattctgttgatatgatgtatcacattgattgatttgcatatgttgaaccatccttgcatccctggaataaataccacttgttcatgatgaatgatctttttaatatattgttgaatctcattagcttgtattttgttgagggttttcacatcagtgttcatcagaaatattgacctgtagttttctttattgatgtgtctttgtctgggtttggtatgagggtaatcctggcctcatagaatgagtttagaagtactccctcctcctgtatttttcagaacagtttcagtagtattggtgttcttctttaaatgtttgttggaattgagcagtgaaaccactaggtcttgggcttttctttactgggagactttttattacaggttcaatctcactgttgttagtctgttcaggttttgaatttcttcatgattcaatcttggtaggttgtatgtgctagggatttatccatttcctctagattttccagtttattggcatatagttgctcatagtagtttgtgatgatcgtttgaatttttgcggtatcaattgtaatatctcctttcttatctctgattttatttattttggttttctcttttaaggtttgtcaattttgtttatcttttctaaaaagcaactttatgtttctttggtcttttgcattattttcttcatttcaagttaatttatttctgctccatctttattatttctgttactaattttgggttgtttgctcttgcttttcttgttgtttaagaggcatcattaggttatttatttgaagtttttcttcttgttttctgagacagggtctctctttattctccaggctagagtgcagtggtgcaatctcgtctcactgtagcctcaacctcccaagttcatgtgatcctcccacctcagccccctaaatagttgggactacagttgcatgccaccgtgcccagctaatttttgtagagacaggatttcaccatgtttcccaggctgttctcaaattcctgagctcaagcaatctgcccacctcggctcccaaagtgctaggattcaggcatgagccactatacccggccatttttcttcttttatggtgtaatacttatagctataaatttctctgttaatactgcttttgctgtctcccataacttttgatatgttgtgtttccattatcatttgtttcaataaagttttcagtttgcttcttaatttctgcactgacccattggtcattcaggaacatattgtttaatttccaagtgtttatatgatttccagaattgttcttattgatttctagtttaactctattatgagagaagatgcttgatattatttcagtttttttgaatattttaagatttgtgacctatcatatgagcaatccttaagtgatccatgtactgagggaaagaatgtgtgttctgcaccctttggatgaaatgttctataaatatctgttaggtccatttgttgtatagtgcagattaagtccgatgtttctttgttgagtttctgtctgggagttgggttcagtgctgaaagtgaggtgttgaagtctccagctatcatattgaggtctagctctctctttagccctaataatgtttgctttgtatatctgggtgtgttgggtgcatatgtacatatgattgttatattctattgctggattgactcttttctcagtatataatgacattctttgtctcacaatttttgtcttgaaatctattttgtcagtatttatataattactcctgctcttttggtttccattggcatgtaatatctttttcatccccttattttcagtctatgcatacctttgtatgtgaagtgtgtttcttgtgggcaacagatcagtggatcttgttttttcatccattcacccactctctgtcttttgattggagagtttggtccatttgtattcaatgctattattgataagtagggacttctgccattttgatatatattttctggttgttttgtggtcttcgttctttctttacttgctgtgttccttttagtgaaggtggttttctctggtgctatgatttaatttcttgctttttatgttttgtgtatctgttgtgttttttgatttgagtttactgtgagacttgcaagtactgtcttataacccattattttaaactcacgacaacttaacactgattgtataagcagtcaaacacacacaaagtgtttaaagtgtaattaaaagtgtaattaaaactctacactttaacttcatccctctacactttaacttcatccctctgctttttaacttttttgtttgttgtttctccttatgtcttactgtactatgtcttgaaaagttgtcgttattctttattggttcgtttcatcagtctttctacttaagagtagtttacacactacaataacacttataaaataagaatcattgttaggttatttatttgaagttacagaataagagtgtaattgtgctgtgtaaactactcaagtagaaggagttatactcttctgtgtttttctgtgtgcttactattaccagcgagttgtaccttctgatggtttcttcttggtcattaaatactcttttctttcagattgaacaactccctttagcatttcttgagggcagatccagtgttgatgaactctctcagcattttttgtctgtgaaggtctttgtttctccttcatgcttgaaggatattttcactggatatactgttctaaggtaaatgcttttgtttgttttttttgtcagcactttcaacatattgtgccactctctcctggcctgtaagatttttactgaagagtctgctgtcagagatattggagctctattgtatgttatttgtttcttttctcttgccgtttttaggatctttctttatccttgataaagaaactatcctttgagagtttgtttatagatgccataaggtagtcttcttttttttttttttggacggggtcttgctctgtcacccaggctggagtgcagtggtgccatctcagctcactgcaagctctgcctcctgggttcacgccattctccagcctcagcctcctgagtacctgggactacaggcgcccaccaccacacccggctaattttttgtatttttagtagagatggggtttcactgtgttagccaggatggtctcgatctcctgacctcatgatctgcccgcctcggcctcccaaagtgctgggattacaggcatgagccaccgcgcccggccgccatgaggtactcttctttaggttaaatctgcttggcgttctgtaaccttctcatacttgaatgcagatatctttctctaggtttgggaagttctctcttatccctttgaatgaactttctactccggtctctttctctacttcctctttaaggccaatacctcttatatttgcccttttcatgctattttttaggcatgcttcactgttttctattcttttttcttttgtggtctcctctgactatattgtcaagtagcctgtctccaagcccactaattctttcttctgcttgatcaattctgcttttcagagactctgatgcattcttcagtttgttggttgcatttttcaactttagaattgctgcttgatttttaaaaatttaaatttctttgtttaaaatgtgatagaattctgaggtccttctctgtgttatcttcaatttctttgactttcctcaacatagctattttgaattcctgcctgaaaggtcacatatctatctctgtttttccaggattggtccctgccttacttagttcatttggtggggtcatgttttcctggatgatcttgatttgatgcttgtagatgttcattggtgtgtaggcatcaaagaggtaggtatttattgtagtctttgcagtctgggcttgtttgtatctgtcctttttgagaagtctttccagttattcgaagggacttgggccccaagcccaataatgctgaggtttttgcagactcagaggtactgccttggtggtcttggataaaatctggaagaattatttggattaccacgtagagactcttgttcttttctgttactttcttccaaacaaatggagtctctctctgtgctgagtctcctggaactagggatgtgttcatgcgttgatgcaagcacccctgttgccaccaccactgaaactaagctgggttagacctgaagccagcagagcactgggtctcatccaaggcctgctgtcaccaccacctggctaccacctatgttcactcaaggccctaaggctctaccatcagcaggtggtgaagccagccaggtttatgtccttcccttcagagtgtctcattccccaaaccccaggccagtccagaaatgctgtctggaagccagggattagagtcaaaattcttagcaatttgtttgatattctgttctgttgtggctaagcaggcactcaaaccgtaacacaaaattcttcccactttttcccctgtccacaggcagaggagaatctgcctctgtggccaccactaccacagggccatagtgggttctgcctggccactgccgggcagtcatcttcaggtgtttatgaatcattaacataatccatattatagttaaatatttatttggagtttactgtggactaggtattttacatcatagtaagcaaagtttcccaaatttaagttctttttatttctcattcatgacttttggcctgttctcatactacctattcattgtaacttttaaacttgaaagtctctttcaaaataaatgaatttatacttttaccataaatggaaatctagtaccatttttatgaatagaagatattatgaaggaatacaataaaaacaattttataagtctgggcatggtggctcacacctgtaacctcagcacttttgggggcctaggtgggaggatcacttgagcccaggagttcaagaccagtctggacagtatagggagacccccatctctataaaaaataaaaataaaaaaatcagctggccatggtggtgcatgcctgtggtctcagctaatctggtggctgaggtgggaggattgtttgagcctgggatgtcttgattcataaacacatgaagatgactaaaatctccttttaaatttgtttatactgctttttcttctatggctttctttttttcatagatcatgtcaatataaacacatactgagaaccaggagtttgagtgattctatatgaatgactgtatactatttaaattttgatgaactacagagtagtttgagcctaggaggttgaggctgcagtgagccatgattgcactatggcaacccagccaggatgacagggtgaaaccctttctcaaaaaaaaagttatgaaaaatatggtttcctgccaaactcataattactcctttattaaaaagggcaattagccctttttatgcaaggtgcttaaaaataaactagcacctcatttagatactctccttacgtaaataaaaaagattgaagaggagttgaaaaaagatttttttcctatgtgattgtttacttcagtatttgtatgtcatctaaaatggtgatataggacctgcattaaagtgttccacctgtattagtttgttaggcaatttatttaatcagaaaaaataaaataaatttacaatttaaaaatattttggaatttacacctgccacaaaatgagacagtttcttcgttcagatttcttactcatgagcaggcatcaattggttggaatcagagaggtttcttacctttaagttacaattgctttcctttgagttgctgtcacaaatctactgtcccccaagtagtttaccttatttcaaccataaatcatacaaaaatttacctatgaaaatttggatattattgtagataatactgtagaatttgctatggtttaaatttttaagagctttgaggtgcataaaaatacatctaagtgtacattgatttttagtaaatttatagtgttgtgcatccataatcacagtctagttttagaacatttatatcagccttaaaaagtactatgcccatttgtcatcaacctcttctcccattccagccttagaaaaccttggcctactttttgtccatttgatttagctttcctagaattttcatatcattggaatcatatggtatatggtcatttgtgtttggtttttatttagcataatgtttttgaggtgcatccaggtcataatatttcttttttcaaaatgtgtgtaaactaagggatacaagtgcagtttttttacagggacatattgcacagtggtaaagtctgggcttttagtgtaatcatcagctaaagaatgtgcattgtacacataagtaacttcttatcctttatccccttctcatccttctgagtctggtatctgttattccacactctatgtccatgtggtagtattcctttttgttgctgaatatttttccattatttgcatatgccgcatttctatctccattcaccagttgacaggtatttgagtcattgtgaataatactctcattttgaatgattgtgagtaatactgctgtaaacatttgtatacatgtctgtgtgtggataaatgttactcttctagagagatacctaggagtgcaactactaagtcatatggcaagtttaacttattggtaaagtgcaaaactttgttccaaagtgactgtagcattttacaaccccaccaataatgtatggaagtttctgtttctccacacccgttctagagggtttgtagtggtgtcttatttgtggctttaatttggtgtttttctaatgactaaaaaatgtttggcatgatttcatttgcttattagctatttatatatcttattccatttatatatcttattagccatttcgctatacctatgtagttaattatctattcaaatcctttgtccatttaaaaaaaaaacagtgatctgatcttgggtcactgcagccttgaactcttgggctcaagtgatccttccaccccagcctccctagtagctgggactacagatgcccaacagcatgcctcacttatttaaaaattttgtagagacagggtctccataagttgcccaggctggtcttaaactcccatcgtcaggctatcctccgaaagtgttggaattacaagtattagccatgatgcccagaccatttttgtttaagtggaatatttctcttattattcagttgtaagagttctttatatgtcttgatacaaattatttagcagatatatacttcgcaaagttctgcagcattaagtacattcacattatcatgtaaccattaccaccatcagtatccagaactttcattttcattttcccaaactgaagcttcgtaccctgtaaatggtaattcctggttttctcatcccatcagtccctggaaactactattgtattttctgtctttatgaatttgatttgtgtgggtacctcagacaagtggaaccacacactatttgtctttttgtgattgacttattgcactcagcatgtcttaagttttatccatgctgtagcatgtaccaaaatttccttccttcttaaggctgaatgatactccattgtatatgtacatactgcattttgttttattcattcatctgttgatggacacatgggctgcttttacctcttggatattgtgaataatgctgctgtgaacatgggtagacaaatatccagatccctgctttacttcttttgggtacatacccagaagtggacctgctgtttcatttggttattctataggttttttttttttttgagaaattttgcttttttttttaatgttaagaaattgccacatactgtgtttccacagtgtacatcattttacattcttaccagcaatacagtggttccagtttcttcacatccttgctagtacttgttttctgttgttttgatgattgccattccattgggtccaatgtggtatgtcatggttttggtttgcattttcctaatggttattaatgtcgagcatcttttatgtacttgtaagtcatgtgtatgccttctttgaaagtgtccgttgaagttctttgcccattgtttttcttgggttattttttgttgagttgtaacgcttcatgtattctgggtataatcctttatcagatatgtggtttctaatacagttatgctccatgtaatggcagtttgagatgttcctgtcaacagactgcattatatgatggtggccctataaaattctaatggagctgaaaaattcttcttgcctagtgacaatagaaattttatatagtgtaatgcattactttttctatgtttagaagtatttagatatagaaatatttaccattatggcacaattgcttatgtattcagtatagtaatatgctatataggcttgtatcctaggagcaatagggtataccttatagccaaggtgtgtagtaggccataacgtctaggtttgtgttaagtacccactgtgatgttcacatgatgacaaaattgcctagtgatgcatttcttggaacttatcccctcttgttaaagtgacacgtgactgtattttcttctgtttcaagggttacatttttactctctttgtagtagccattgatgcacagcattttcaattttgatgaagtctgtcttacctatttttttttgttgcctgtgctttcagtatcatatccaagaaattgttttcaaatccaaagtcatgaagtttttggcttgtgttttcttctaagagttttatagggtgaggtcttctgtttagagttttgatcactttgagacaatttttgtatatagtataagataagggtccagctttatttttttacatgtggatatccagttttcccagcactgtttgttgaaaagactttctttccttttcccctttgaatggtctaggtagccttgtggaaaataatttgactatttatgcaagagtgtatttctggactctgtgttttattctgttggtctatatgtgtatccttgtgccagtacgacagtattttgattgctgtagtcttctagtaagttttgatgtcaggaaatgtgagacgtccaactttgttattttcaagtttgttttgtctattcgaggtctcttgggaatccatatgaattttaggatggatttttctgtttctgctaaaaatgctgttaggattttgaaaggacttacattgactatgtagattgctttgggtagtattgacatcttaacaatattaaattttctaatccatgaacagaggatatcttttcatttatttgtgtctaatttctttcagtgatattttgcagttttcactgtagaagtcttttgcctgcttggttaggtttagtcctaagtactttattctttttgatgttacggtttgctgatttttctgtgttgattttgtattctgcagttttcctgaattcattcattctaacaggtttgttgttgttgtggaatctttagagtctttacatataagatcatgtcatcttcaaacatataattttacttattcatttccaagttagatttattttatttcatttccttgctgattgctctggctagggctttaggtattacgttgaatggaagtggtaagaatgggcatctttgtcttaattctgacctttgaggaaaagctttccatcttttcaccattgagtttgatgctggttacaagttgttgttttgttttttgtttttgtttgtttgttttttgtttgtgtgtgtgggggtgggtggtggtggtggtggtggtggtggtggtggtggtgatggtggtggtggtggtggtagtggtagtggttttttcttgctctgttgcccaggccggagtgcaatggtgtgatctcggcttactgcaaccgccacctcccgagttcaagcaattcttctgcctcagcctcccaagtagctgggattacaggcgcccgccaccatacccgactaatttcttgtatttttagtagagacagggttttgccatgttgttcagactggtctcgagctcctgacctcaggtgatccacctgtctcggcctcctgaagtgctgagattacagctgtgagccatcatgcctagccaggtataggttttttatatatggcctttttattatcttgagatagtttgcttctattcatagttttttgagtatttttagcatgaaaggatattgagttttatcagatgttttttctgactcaattgaaatgattatctgttggtggacacttaggttgattccatatctttgctaatgttaacagtgtggctatgaacttgggggtgcaaatatccctttgatgtatttattttgtttcttttggataaatacctaacagtgggattgctggatcatatggtagttctatttttacttttcgagaaatcttcatactgtttttggtaatggctgtactaatttatatttccaccacaggagttcccttttctctgcattctcatcaacatctgttatgttttctttttaataattgctattctaactgggttaagatgatatcttgtggttttgattttcattttcctgatgattagtgatgttgagcctcttttgatgtacctgttggccatccatatgtcttttgaaaaaatgtttatgtcttttgcccactttttaatgggaatgttttgttttaactgttgagttgtttgagttccttgtatattctggtttttagtttcttgtcagatgcatagtttgcaactattgtctaccattcaaaaggaaggttatttctttactctgttggattgtttcctttgctatgcacaaaacaagtctcaaaacattttaaaactctgggaggctgaagtgggagaatcatttgagccagggaggtaaaggctgcaatgagctatgattgtgccacttcactccagcctggcaacagagatagaccctatcttaaaaaagaaaaaaaaaattaaactcaaaactatatcaagtgtcttcttagaccacagtagaatcctcaaactagaaattaataccaagaggaacttagaaaactgtctaaataaatggtaattacatagaatactcctgaatgtccattggttctttttctgctcctttgatcttgtctttgccttctgtaacaccaaaaattcaaatagatcactttatggtgtcccatatgtcatgtaggctttgttcattcttatttattcttgttttgttttctgagttatttcaaaaatctgaaattcattcttctgcttgatatcatccattgctgaagcacttgaatgtattttttattccacttagtgaattcttcggtttgaggatttctgtttggttccttttttatgatatctatctttttggtgaatttttcattcatatcttgaattgtttttctgatttctttgtatttttgtgttctctatctcactgagtgtctttagtattattttgaatcctgttgctggcatttcataaatttcttttttattagaatctgttgctggggaattattgtgttcctttggagatgtcataatttcttgttttttttttttcacattacttgtatacttacaagttgatgtctgtacctctggtgtaacagttgcttcttccagttttttagattggctttcagagaggtagactttttcctgaagatctatccgtggtgttggttgggtagggcaccttgtctttgattctgggtgtgtgcagtagtgtatttttcatatgacctttttagccatatatagcattagtggtgtctgtgatttcctcagtggtttagggtgcaattgttagcagaggctgaggtgaagttctcctgggcagtgggatgctaggtaggccagtccttgggcaccagtggtggcagcagcagactgtgtgcctgtccttcggccccagggtacacaggcatggtgttagcaggtttaattgggttgattcttaggcctccatatggcttgcttaggtgctggtggttgcagtggatgaccaggtgagtgggtaggtccttggatccctgggcagtgcatgtggtatgggctatggcagtagttgtgatggtagcatcaggctgggtgggctgactctcaggcttccctgtaggagtgcgtatgtgtgagtggcagacagggtgaggcaatctctatgctccaatctctatgcttgggcccttgggggtatgtggtgccaggccaggtgggcctgtcttcaggccccctggtagagtgctcaggtagcaacagtggatagagagagccttgcctcagggcatgtgcatgtccactgtggccctgctactagaggggatagggttggtgtcggtgtcagtagcctcacaccagaggctggggtggggcaggtatggtatgctttgctccaagcagtgtcaggaacattgacactggcatgctgggagattctgtcctcaggacatgttcaagtgtgctgcagtcttgctgttagtggagatggggttactgtcagtggcagcaaccccaggctagcagggtttaggctctcagaagtgtacgctttggctctttttgtccttgtgatagcctccccagtataccctccccagtgcattgcacttgcctgttctccacagtgtaggattttatatatgctttaataccagggactctgccactctgctgggtccaagtggcattgcatcactgtaggcccccaggtggatgcagggaatgttagtagggctttactaatgtggaaatgcagggactcttgtgctcaagggcaggatgcagcctgttaagagctggactgaaaatgacaccatgctgtaactgtttaggtctcatgcaggtggtacaggacccagtgtgagctctctctctggagcagtgtcatcacatggtctctaagaagttctctatgctagtctctggaccccctctctgtaagctagggttgcaggagtccgtggtgggagtgtgagctgctgggtatctctcatttacctttcccccacactggagatctgctctgtgctccaggtcgataaaggccaagcaaacaaccttgcttccctcttcttccttgctttaggtgtttcctgtcacttctctgctaaattccagtgttgtgtcttagatgttctgttgaaagtgtgactcctccctgtttgggttttttttttgtgaaggaggcaagggctgatgtctctagtcagctatcttgaagcccctcctctatttttgctgttgttgcctgtgcttttcaggtcttatccaaaaaattccttgctcagaccaatataatgaatcatttcctttatgtttttcttccagtagtttcatagttttgggtcttacatttaagtctttaatcttttttttttttttttttttttattgagacagtctcaccctgtccttcattcttgagtgcagtggtgtgatctcagctcacttcaacctccacctcctgggttcaagtgattctcctgcctcagcctcccgagtagctgagattacaggtgcatgccaccatgcccagctaatttttgtatttttttttattagagatggggttttgccatgttggccaggttggtctcgaactcctgatctcaagtgatctgcccacctcggcctcccaaagtgctgggattacaggcatgagccaccgcacctagcctctttaatctattttgaaatgagttttgtgtatagtaagataagggtctaatttcattcttttgcatgtggctatccaggtttcccagcaccatttattagattatcctttctccaatgtgtgctcttggcacctgttttttgaaaatcagttggctgtaaaagcatggatttatttctgggctattttgttccattgttttatttgcttttattgccagtaccatggtgttttggttaatacagctttgtagtatattttgaagtcaggtagtgtaattccactaactttgttatttttgttcaagattgctttggctatttgaggtcctctgtggttcagtatgaattttaggcttgtgttttccactgctgtgaggcatatcattggtattttggtagggattacattggatctgtagatcactttgggtcatatggacaatttaacagtattaatttttccaatctataaacatgggatatctttccatgtatttgtgttttcttcattttattactgtttcatagttttcattgtagtgatcttttacttcttcaattaaattttttgttctttgggtttttttatagctattaataagtgggattgttttgttgatttcttttttcagctaattcactattagtgtatagaggcattactggtttttgtatattgattttgtattctacaactttactgaattattttgttctaccacttttttggtggcatctttagggtttctatatgtaagattgtgttacctgcaaatagtgttaatttgacttctcctttccaattaatttggatactttttattcttttttttttcttgcctaattgctctggctaggatttccagtactgcgttgaataaaagtggtgaaagatagtatccttgtcttattccagattagaggaaaagatttcaacttttccttattcagtagtgttagctatgggtttgtcatatatggcttttattgtgttgagttacattctttctattcttaatttgttaagagttgttgtcaagaatagatgttgagttttgtcaaatgctttttctgcctctcctgaaatgatcatggggtttttgccttttattctgttaatgtaatatatcacatttattgatttgtctgtgctgaaccatccttgcattcctgggatcagtcctacttgatcatgatgaattgttgaatttggtttgctaccattttgttgaggacttttgcatctgtgttcatcaggtatttatttttgtgaatgttgacgtctagttgtttgaatactattcattgcaaagactgtcttttctctgttgtacttcctttccttgtttgttaaagatcagttggcatatatttgtgtgtgtctatttctgggctctctattctgttccattgattgatttgtttattattttgttaataccacactttcttgactactttagctttatagtaagtcttgaagtcaggtaatgccggtcttccaacattgtcttctccagtattaagttgctagtcttggtcttttgcctctctgtatcaactttagagtgactttgttgatagccagaaaataaattgctgggaatttgattgagattgtattaaatctgtatatcaagttgggaagaactgacatattgtgacagtattgagtctttgtattcattaacatggtatatgtctccatttatttttttctttctttctttctttctttctttttttgagacggagtttcactctgtcacccaagctggagtgcaatggcgcagtcttggctcactgcagcctccgtctcctgggttcaagtgattctcctgcctcagcctcccgagtagctgtgactacaggtgcacaccactacgcccggctaatttttgtatttttagtagagatggggtttcactgtgttggccaggttggtctcaaacttttgacctggtgatctgcctgcctcagcctcccaaagtgctgggattacaggcatgcacaaccacacccagcctgtctccatttatttagctcttctttggtatctttcattagtgttttgtaacttttttctatagataaacgtattgtgttacatagttttttaaaaatgctttttacattttttatgtttttgagacagcatcttactctatcacttaggctggagtgcagtgacatgatctcagctcactgcaacctctgcctcccaggctcgagcaatctcccacttcagcctcctgagtagctgggactacaggtgtgtgccaccatgcccagctaatttttgtattgttttgtttgtagagacaaggtttcaccatgttgcccaggctgcaagtgtgtattttttgtttttgtttgtttggtttcttttttttggaggtagagtctcactcttgctacccaggctggagtgcaatggtgtggtcttgactcactgcagcctctgcctcccgggttcaagcgattctcctgccacattctcccgagtagctgggattacaggtgactgccaccatgtccagctaatttttgtaattttttagtagagacggggtttcaccatgttggcgggctggtctcgaactcctgacctcaggtgatttgtctatcttggcctcccaaagtgttgggattacaggcgtgagccactgtgcccagctttgtttttgtttttgagattcagtttctgttgcctagggtggagtgcagtagcgcagtctcagctcactgcaacctgtacctcccaggtttaagcagttcttctgcctcagcctcctgagtagctgggattaatttttgtatttttagtagagatgtaaccacacctggctaatttttgtatttttagtagagatgggtttcaccatgttggccaggctggtcttgaactcctgaccttaagtgatctgcctgccttggcctttcaaagtgtagggattacaggcatgagctactgcgcctggcctgcaaatgtgtttataatgacaaattccacttttttattgctggtatatagaaaatttattgacttttgtatattaatcttggatcctgtaaccttgctatagttacttattctaggaggatttttgggtcaattctgtcaaattttctacatagatgatcacattatctatgagtaaagacagttttatttattccttcccaatctctttaccttttattcctttttgtggtcttattgaattagctgggacttccactattctgttgaaaagctgctgtgagtggagacatccttcccttgttcctgatcttagcaggaaagcgttgagctgtaggtttctcatagatcttctttatcacgttgaaaaaatttctttctattcccgagaggtttttttaaaatcatgaatgagtgttgttctgtagtttgctcagtgttttttgtttatttgttttgttttatggagacagagtctcgctcttttgcccaggctggagtgcagtctcacaatctcagctcactgcaacctccacctctcaggttcaagtgattctcctgcctcagcctcccaaatagctggcattataggcgcctgccaccacaccgggctaatttttgtatttttagtagagatggggtttcaccatattggccaggctggtcgcaaactcctgacctcaggtgatctgccaacctcagcctcccaaagtgctgggattacaggcatgagccgtggcgcccggccttgctcagcgtttttatcttggttgttagatttgttaagtgctttttctgtgtttattgaaataatcatgtgatttttctgtagcctgttgatgtgatggattatattaattgagttttgaatgccgaaccaggcttgtatttctggggtatatcgtatttggttatggtgtttaattttttttaataccttgttggatttgatttgctaatattttgttgagaggttttatatctatgttcataagagatgttgatctgtagtgtttttttgtttttgtttttgagacagagtctcgctttgtcacctaggctggagtgcagtgttgttgtgatctcggctcactgcaagctctgcctcccaggttcacgctattctcctgcctcagcctcctgagtagctgggactacaggcgcctgccaccacgcccagctaatttttttgtatttttagtagaaacggggtttcactgtgttagccaggatggtctccatctcctaaccttgtgatccgcccaccatggcctcccaaagtgctgggattacaggcatgagccaccgcgcctggcctgtagttttcttttcatgtaatatccttttctgattttggtattaagggaatgctggactcaaaattaggaagtactcctgcttctatcttgtggaaggctttgtaaagaattggtgtaatttctcccttaaacgtttggtagacttcacctatgaacacatttagtcctggttctttctgttttggatgattattaattattaattcagtttctttaataatacaggcgtaggtttaggtctttgttttggttgatatgcttgcaatgttgaaagccgatagtttaatatcaatattgtcttttattttactgtaaaaatactttgaatactctgttatcttaaattttatttgtgtatttttatgagatattgataaaaaatacaacttttttttttttttaatcacacagcctagtgtgttaattgtaacctacaaggagcctgcaaaatcatctactcagtttggatcctacaagcaagctgaatggaggccagatagtaccatgatagctgtatcagtaagtagattttaccgctaaatagtgttttcttatgaaatcattacatcgcatttaaatttgattctcttagatgactttctttcagtcttttgcactcataagtatttattttattctgataggaattgctttactgattattctatgtggattactcctactatagcttttcttctgactctgctacttccttaacaaagcacctatatccctaaacatagcacctgtatccttttctgtttgttgttctcactttactgttttgcccttgaagtctaactgctttactaattattctgtgcgtgttactcctactatagcttctgttttgactctgctgcttccttccatccctaaacatagcacctatatccttttctgtttgttgttctcactttactgttttgtccttgaagtcttatctagttttttaaaacatattcacatgatattcttgaatttatatttaaattcctcccttccattccaaaagatattccagaaaataataagctttatgtgcatatgttatactaaaatttccatatccatttggatctgtttctcctttttttcttctgttctattaaacgtgcctagatatgtttaattttaccttttcagttcatgtttcatcactgtctaaggctgtcattatgacttaatatgcattagcagtaatatatgtggttaattaacattattgagcacctcctatccgatgagtacaattgtaatcagtttacatggatcatcccatttaatctttagataagtgctttgaagtagatattattatccttcataatggatgtgtaaattgaggatctgaaaaattgtcttatccaaggttacatgcgtagtgtatattagagagataaggtataaacttagctactcagcttccatttactatatccttatatctaatttatctctttgcgttggtccctttctagtccatactgtatataacactgactaggttaatagtctgaaatgttcatatgatgaaaaatactgagtagttctacgcttcctatagcaggagtttgcagatgactgaccatgtaccaaatatgccctggtgcctgtttgtacacagaccataatgtaagaatagtttttacatatttaaataatcaaaacaagtcaaagaagaatatttgctacagttgaaaattatgtgatacttaaatttcagtgtccataactaaaattttactggggcacgaaaatcctcactgatttatgtattgtctgtaacttctttcaagctacaatagcagattgaattgaagttcttacagcaagtgtatgtggtgctctcattgctttgctcttctgttcaatgcactgtgtagtaacacagttgtaacttcataacatttcaagtgtacacatattgccattctgtgacattttatattatttttattctagtacatactcatgtcaaaagaaccaaagaagacaaaaagactttgttttgtttttaaagcacactgtagtgtggtttcttttattattgaattagatggcaaaatattgtatttattattcaatggcactatagctatgccaaaagaatataagctgacatcactagactaagcacttatcagaatgtactgaaggttaagttagaagaattaaaaaatttagcacagaacagctcaccacaaaattccttcacaaaaataaaatatgaaaatgaaagtgcagtaaaagtaagtttgcttagtttttgataaattgacagatgttataatactgctcagttgtaaatttcagtggtccatgtgaagtatgaattgactaagaattactgtgaatgacctgcagaacaattccagatgaaaaaaattctcaaaggagttgagaaaatactaattcagtacaacccgaagtagaatctaagaagttgtattaattgatagtagtaaaaatccacatggagcagcaaaagacttagttggacagatttacaaagtttgtgaaaatataagacttttaaaacctatggttagtgtaagttttttcagagatggaagcaggaatatcttgaattgccctcctccacagctgttatggcttgggtagtgataaaagtttattggaaagtttttttgtttttttttttaccgagactgacttttttttttttctttacttgaaggaccaccatctaccacttaacagacactaaataactttggaaaatagcttttgctgtattagaaaatgttttcaaatatgaattatgtaaaatgtcattaaggaccagcattaatagatgaaaatttgcactcaattttgatgatagggaaaagtactttaaaccccaatttaccaaaaaggttatttccacaaaaagaatctaattctcattagtggatgtatattaccaaaaaaagttgtactttatgttaaatgttacagtacaatatgttaaagaactattcttttcccattgaacggtcttggtagtcttgttgaaaatcaattggccattggtatttggggttatttctggatgctccattctgtttcattgttatatatgtctgtccttattccagtaccacagtttttaaattactgtggctttgtagtaacttttgaaatcaggaagtggaatcctccaattttattgttgtatttcaggatataagtcatgtcaacccattgtcaacccattgtaagttgaaaataccataagtaaaaaatttaacagccccaaacatccatcataatgtcgtaagttgaaccatcataagttcagtatcatctatagttttgactattctgagccagtccctaagatgctatatgactgtttgaactggttttctatttctgtaaaaaataccattgggaatttggtagagactgcattgaatctgtagttctctttgggaagcattaatttaagtcttccagcctatgaacatgcaatgtcttatcaattatttagaccttcaatttctgtaaggagtgttttctggtgttcagtatgcaagtctttttcctgcttcattaaatttatttttaagttttaaatttctttttgatgctattgtaaatggaattgtttttaagtttccttttcagttgttcattccaagtgtgtagacatatatctgattttttccaacttaacttcagggtacatgtgtaggatgtgtgggtttgttgcataggtaaacatgtgctatggtggtttccttgcacagattatgccatcacctaggtattaagcccagcatccattagctattcttccagatgctctccctcatcctgcgccctgcccctccatcctctaacagaccccagtgtatgttgtttcccccatgtgtccatatgttctcatcattcagctcccacttataagtgaaaacatgtggtatttgattttctgttcctgtgttagtttgctgaggataatggtttccagctccaaccatgtccctgcaaaggatatgatcttgttcctttttgtggctgcatagtattccatcgtgtatatgtaccacatttcttttattcagtctatcatcgggggacattcaggttgattccatgtctttgctattgtgaatagtgctgcagtgaatatatgcatgcatgaatgtttgtaatagaatgatttatattttggggggtatacccagtaatgagattattgggtcaaacggtatttctgcctctaggtctttgaggaattgcctactgtcttccataatggttgaactaatttccactcctaccaacagtgtaaaagcattcctttttctccacaacctaaccagcacctgttgttttttgactttttagtaatagccattctggcttgtgtgagacggtatctcattgtggttttgacttgaatttctctaataatcagtgatgttgagctttttaaaatgtatttgttggccacatttatgtcttcttttgagaagtgtctgttcatgtcctttgcccacttcttaatgggattttttttttcttgtaagttattaagttcattgtagatgctggatattagacctttctttgtcagattaatagattccaaaaatttgctaccattctgttgtttatctgctcactccaatgatagtttctgttgctgtgcagaagctcttcagttcgattagatcccatttgtcaatttttgcttttgttgcaattgcttttgtcatccttgtcgtgaaatctctgcctgtgcctgtgtcccaaatggtattgtctagattttcttcctgggttttacatttaaatctttaatcaatcttgagttcattttcctttagggtgtaaggaaggggtccagtttcaattttctgcatacagctagccagtactcccagcaccatatattacatggggaatcctttccccattgcttgtgtttgtcaggtttgctaagatcagatggtgtaggtgggtgttcttgtttctgggttctctattctgttacgttggtctatgtgtttattcttgtgccagtaccatgctgttttggttactgtagccctgtgttacagttttaagtcaggtagcatgatgcctctggccttgttctttttgctttgattgccttggctattcggactctttgttggttccatatgaattttaaaatagcttttttctaattccgtgaagaatgtcagtggtagtttaatggggatagcattgaatctataaattactttgggtagtataaccattttcacaatattgactcttcctagccatgaacatggaatgtttttccatttgttcgtgtcatctgtcatttgtttgaaagttggtttgtagttccccttgaagaggttcttcacctcccttgttagctgtattgctaggtattttattcatttgtgaccaactgtgaatgggagttcattcatgatttggctgtctgcttgcctgttgatgtataagaatgctaatgatttttgcacattaattttctatccttagactttgctgaagttgcttatcagcttacaaagcttttgggctgaggcaatggggttttctaatataggatcatgtcatctgcaaacaaagatagtttaattttctctcttcctatttgaataccctttatttctttctcttgcctgattgccccagccagaactgccaatactatgttgaataggactggtgagagagggcatccttgtcttgtgccttttttcaaggggaatgcttccagcttttgtccattcattatgatattggctgtgggtttgtcatatatgactcttattattttgaagtatgttccttcaatatctggtttattgagagtttttaacctaaagcgatgttgaattttattaaagaccttttccgcatctattgagataatcatgtggtttttgtgttcagttctgtttatgtgatgaatcacatttattgaattgtgtatgttgaaccagtcttgcattccggggatgaagtctacttggacatgatggataaactttttgatgggctactggatatttgccagtattttgttgagaatttttgcattgatgttcatcaagcatattggcctgaggttttctttttttttgttttgtctctgccaggttttggtatcaagatgatgctggcctcatagaatgaattaaggaggaatccctaattttcaattgttttggaatagtttcagtagaaataataccagctcttctttgtacctctggtagaattcagctgtgaatctgtctgtcctgggctggtttttttttttgggttgctaggctctttattacttctcaatttcaggactcattattggtctattcagagattcagtttcttcctggttcagtcttagggagggtgtatgtgtccagaaaagtatccatttcttctagattttctatttaatgtgcattgatgcatttatagtattctctgatgattgtttgtatttctttggggtcaggatgatatcccctttatcatttctgattgtgtttatttaaatcttctcttttcttctttattaatctagctagcagtctatgtattctattaatttttttaaataaccagctcttggattcattgatcgtttgaatggtctttcatgtctctatctccttcagttctgctctgatcttggttatatcttgtcttctgctagcttttgggtttgttcttgtttctctagttctcttagttgtggtgttaggttgttaacttgagatctttgtagctttttgatgtgggcatgtagtgctataaatttccctcaacactgctttagctgcatcccagagattctggtacattgtctctttgttctcattagtttcaaaggacttcttgatttctgccttaatttcattatttactcaagtcactcaggagcaggctgttcaatttccatgtagttgtgtggttttgagtgaatttcttaattcttctgagtgaatttttttgagtgttgtggtctgagagactgttatcatttcagttcttttgcatttgctgaagagtgttttacttccgattatgtgatcaaatttagagtaagtgccttgtgatgatgagaacaattagtttctgttgttttaggatggagagttctgtagatatctgtcaggtccacttgatctagagctaagttcagatcatgaatatctgttaattttctgtcttggtgatctgcctaatattgtcaatggtgtgttaagtctgctactattattgtgtgggagtctaagtctttttgaaggtctctaagaacttgctttaggaatctgggtgttcctatactgtgtgtgcatatatggaggatatttggcgcttattaaattgaaccctttatgtaacgccctttgccttttttatcttttttcatttaaagtctgttttgtgagaaactaggatcgcagtccgtggttctttctgttttccatttgcttggtaaattttcctccatccctttattttgggatgtgtgtctttgcacatgatatgggtcttttgaagacagcataccgctgggtcttggttctttatttagcttgccattctgtgtcttttaattggagcatttagcccatttacatttaaggttagtattgttatgtgtggatttgatcctgtcatcaagatactagttggttattttgcagacttatgtggttccttcatagtgtcactgatctgtttacttcagtgtgtttttgtagtggctggtaatggtttttcctttccatatttagtgcttccttcaggagctcttgcaaagcaggtctgatggttacgaattccctcagcgtttgcttgtctgaacaggatcttgtttctcctttgcttataaagcttagtttcgccagatatgaaattctgggttggaaattctttactttaagaatgtttaatattggccaggtgtggtggctcacacctgtaatcccagcactttgggaggccaaggcgggcggataacgaggtcaagagatcgacaccatcctggccaacattgtgaaaaaccccatctctactaaaaatacaaaaataattagctgagtgtcgtggcgcatacctgtagtcccagctactcaggaggctgaggcaggagaattgcttgaacccagaaggcagaggttgcagtgagctgagattgcaccactgcactccagcctggcaacggagcgagactctgtcaaaaaaaaaaaagaatgtttaatattggccccaatctcttctggcttttagggttttcactgagaggtctattgttagtctcatgggcctccccttcgtaggtgacctggtctttctgtctgactgcccttaacatttttctttcattttgaccttgcagaatctgatgattatatgtcttggggttgatcttctcagggaatatcttactgaggttttctgcatttcctgaatttgaatgttggcctgtcttcctaggttggggaagttctcctggatgatatcctgaaatatgttttccaacttcgttccattctccccatctctttcaggtaccccagtcagtcttaggttcagtttatttacataatcccacatttctcagaggttttattcattttcattcttttttctctattcttgtccgcttatcttatttcagcaagatagtcttcaagctctgagattcttttctccacttggtctattctgctattaatagttgtgattgcattgtgaagttcttgtagtatgtttctgagctctaacaggtcggttatgttgctctctaaactggctcctcctagtattgtcagtggtgtgttccagtctcccactattattgtgtgggagtttaagtctctttcaaggtccctaagaacttgctttgtgaatctgggtgttcctacattgggagcgtatatattgaggacatttagctcttcttgttgaattgaaccctttattgttatgtaatgccctttgtcttttttgatcttgtagtgtgtttctcagctctaataggtcagttaacttcctctctaaactggctgcttatctctcacattgtcagtggtgtgttaaagtctcccactattattgtgtgggagtctaagtctctttgaaggtctctaagaacttggcacgtcctgtattgttttgtcatgtttcttactttgcattgggttaaaacttgctcctttagctcagtgaagttcgttgttacccaccttccaaagcctacttctgtcattcagctttctcagcctcagcccagttgtgagcccttgctggagaggtgttgtggtcatttggaggagaataggcactctggttttttgagtttttagcatttttgcattgattaatttcttatctttgtgggcttatctgcctttgatctttgaggttgctgacctttgaatggggttttttgtagggtcttttttgttgatattgttgttttctgtttgtttttcttttaacaggccactcttccatagaactgctgccatttgtgggggtctactccagaccctagttgcctcgatttttcctgtacctggaggtatcaccagggagggctgcaaaacagcaaagatggcagcctccttcttctttggaagctccttcacaggggggtactgacctgttgttagctcagatgtgcctggaggaggtggctggagacctctgttgggagatgtcacccagtcaggaggaacgggatcagggacccacttaaagaagcagtctggctgcagcaggtgtgctgtgttggggattccttcagccccccaattggtatgggctctccaggacccacaggctggactgattgagaagcctgaatgccagtgtggcagcctaccccaccactcaggtatactccgtcctggggggaaattagagctctgtctaattgggggtggctcaagaccccagctgggaagacccactaccccatgaggaggagtggattgaggtctcacgtaaagaagcagtctggccatgatctggcagtgtggctgtgctacactgcaggaaacctttctcttccatgctgtatggatatatgtgatttttgtgtattgattttatatcctacgactttgctaactttattagctctaataatttttgtgtgcattatttatacatctctgtggtctgatttggatgcctttatctcgttttcttgtttaattgctcttggtggaactttcaatactatgttgaattaagtggtaaaagtgggtatccttatcttgttcttgttctagcgggaaggctttcagtctgtcaccattgagtataatgttggctttaggtttttcatatatggtctttattatgttgaggttatttacttctgttcttagtttctggcatgcttttattgttaaaggtgttaaattttgtcaaatgctctctttgcgtcaattgagaaacgtggattttttcttcatcctgttaatgtagtgtatttcattgattgattttcctacattgaatcatccttgcattcagtgaatgaatcccactttgtcacgatgtatgaagtatttgctgaggacttttgcatctgtattcacacaatatattgatttatattgattaccaaaactcaagtcagttttggtagattgtatgtttttagaactttgtcagtttcatctggcttgtctgatttgttggaatacaactctttattgtattctcataatctctgttatttatgcaaaattactggtaatgttctttctgatttttgtgatttgaatcatctcccttttttcttaacttacctagaggtttatcagttttgttgatttttcaaagagtcaacttttggctggatgtgatggctcatgtctgtaatcccagcactttgggaagctgaggcgggaggattgcttgaggcagggagttacaggggagcctgggggacatagcataatgccatcgctacaaaaaataaacttagccaggtgagttggcacatgattgtagtcctagctgctcaggagggtgagtcaggaggatcacctgtgcccaggagttcaaggttaccatgagttttgatcttgtcacagcactccagcctgggcaatagagcaagactccgtatcaggaaaaaaacaatttttgttaaagtgtattttctttattgtttttccattctctttttattttgctctaacttttattatttcctttcttctgctagcttcgggattactttgctctttgttatttagttattttatgtgcacatttaggttatttatttgaaatgtccctccaccgccaccttttttttttttttttttgagacagcttcctgttttgttgcccaggctgaaatgcagtggcatgatcatagctcactgcagtcttgatttcctgggcttaagtaatcctctccctcagcctccctagtagctgggaccataggcacgcaccaccacgcctggctgattttgtttaatttttgtagagatgtgatctcactacgttggccaggctggtctcaaactcctaggctcaagcgatcatcctgccttggcctgtcaagtgctgggattacaggcatgagccaccgcactgggcctgagatgtgcctttttaagtgtggatgtctactgttccaacctctgccagttacccagctccaaagttgcttccacatttttgggtatctttatagcagcaccccactctctgcagtaccaatttactgtattagttctttctcatgctgctataaagaactgcccaagactgggtaatttataaaggaaagaggtttaattgacttacagttctacatggctggggaggcctcaggaaaattacaatcatggcagcaggggaaacaaacatgtccctcttcacgtggtggcaggagagaagtgctgagcagagggagaaaagccacctattaaagtaccatcagatctcgtaagaactcactcattatcacgagaacaccgtgagggtaccacctctgtgattcaattacctcccgccaggtccctcccatgacacaggggattatgggaactacaattcaagatgaaatttggttggggacacagccaaaccatatcactgaggaacccttatatttgataagctgcttctctgttaatgttttcaaaattctgtcttttggtttcagcagtttgattctagtgtgtctcagtgtgggtctctgagtttatcctttttggaatttcttggatttgtatattcacggatttcattaaggctcctgacattttcaaccatttctctttcctccatacttctattcctatattatgtatgttgttgtgattaatggtgccccacaggtcccccagactctgcttatttttctttattcttctttttgctccttagattgcataatttcaaatgtcttattttcaagtacatttatcttttccgtctgctcaaatttgctattgaatttctgtagtgaatttttcattttagttactgtactttttatcttcagaattttttcagttcctttaaaaaaaattttcccttttatcgatattctcattttgtttagacattgttttcttgattttctttagttttttgcccatggtctcctttagctcattgaacatatttaagagtgttgatttaatgtctcagattaataattcaaatgtctgggcttccttagggatggtttctgccatattctttattttctatgactgggccatacttttctgtttctttttatgtgttgtaatttttcattgagaactggactgagtattatgttgtggtgactttggaaatctaattctcctagccctcagagattgctggggttctgctccttgattactgaagagttccttttatgattttttgaaactctttttgcatagtatgtatttcttctgatgggtggtctctgaagtttctcttttgttttctctgttgccagccagtcatgtaagatttccttatcctactcccaagagaggggagattttggtgcacccatcacccaagcagtgtacactgtgtacccaatttgtagtcttttatccctcacccgcctcccacccttttccctgagtccccaaagtccattgtatcattattatgtctttgtgttctcacagcttagctcccaattatgagtgagaacgtaggatgtttggttttccattcctgaattacttcacttagaataatagtcttcaattccatccaggttgctgcaaatgccattattttgctcctttttgtgactgagtagtattcgatggtgtatatatataccacattttctttatccacttgttgattgatgggcatttgattgtcatcttgcccatatgacatcaaaattcagcagatgtcttgagggtaaaattggtgttaaagaaaaaattatcgaataatacttgttgaaacacagtaaggaaaacttttttggggactatcgcagtatatatagggaacactgcagtgggttcttgcagtggcaaagagagattgggctcacttcttcagcatgggcaagtgggaatttatagccaaggagcagtgtgggagtcaatggatagaaaattaataagaggaaacatcaggggtaatggggattctggctaaaacaacaggattcttgctgaagacagaccagggtgatcagacatcacttaggggagattggaggatgagccacctaatcagatatcaagtgtgggggtcttgctaaactggattttataaggaaatgcacagatggacctaagagaagaaggttcaggagcctgactaaagtttgactaagcacagaatctttgtcactggttatgtgtttgaggcacatcaggtctccagttagtatggatacctgtgcatctcacaaatacaggaaattttactttgcctgtatgaagtttgctttcgagcccttgagccccttctgcagcttctaagttcagcagatgtcttgtgggaaaaattggctgtggagttgaggcatttcaagtctgattatttcttcaaccctatgtaactgccaagagctttgctgatttttctttgctccagcaggcgtctgcctgaactaagtctgctgctttcttagcctgtgcccagaattggtgaatgctcttaggggaaaaaaaatcagcttacttctgaacagccctcctactatgaattttaatcagtctaggccttattgattccatagcttgcctgatgcctttaaaaatataattttttatgttttctgcctttttctagctgttgggagagttggtctgccatgacctacttattgtatattactgtgcagtagaattcttaaccatgtaatataaaattgccttaatactccttttatgattttttgagtcatttcatttttatatataaaatccaaagcattatataaagatggaatgagcccagatatatccattaaaactattgtaactgcccaacagtttcgttttgcctgctgcctgaatacaattgatttatcaagacagaggaattgcaatagagaaagtttaattcatgaagagctggctgaacagaagcgccatagttttattattcaaataagtcttccccaatatttggaggctagggtttttcaaggatagtttggtggggcagggaatgggtgctgctgattggttagggaggcagtcagaggtgtggaaaatggtcttcatgtcgagtccacttctgagtaggaccacaggaccaggaccagttggtgggtccacgtggagccctccgccgtcagaaatgcaaaaacctgagaaggtatctgaaaaggccaatcttaggttctacagtagtgatgttacctgcaggagtaattggggaagttgcaaatcttgtgacctctggaataatgactggtaattgtttacatttacactttagcagaattcaggctcctctcctcctcctaatgtcttgctaaacagatgatacaaaaatatcagtgacctttctaaactattaccaaataatacagagatggctctctgtattatttattttattattattattattatttttttttttttgagacggcatcttgctctgtcacccagactggagtggagtggcgcagcgcaatctctgctcactgcaacctccgcctcccaggttcaagcagttctccctgccttaccctcccaagtagttgggattacaggtgctcgccaccaggcccaactaatttttgtattcttagtagcgacagggttttgccatgttggccaggctggtctctaactcctgacctcaggtgacccgcctgccccggcctcccgaagtgttgggattatgggcatgagtcactgcacccagcctgtattattttatatcataatgaaagaaatgaaaataaaaaagaacctgttttgcaggcagaggctacaaaaactttgaacaactagtagaaatggtttaagttaatttctaaattctgagaagatagaaggactaagcccccattcctaactcctctcctcttctcaggagtataaacatgagcctaaagtcagaatcatcaagatatcaagttctttagggaaagaataggtgctgaaggaccaggcagagggaaaggtttgctttgccactccttaaggcactgagacaggatctgagatttcacagttctctaagtgagcttaaaaaagtggaatcctgtggtttcccttcagaaaagggaggactgtgtctgctcctggaagtggacattagcagggcttcccataaaactctgttaactgctgcggacttagagtagaggttgcacaggtgaactcagttgctgccacacctcatggtctgaggaagccggcccttctactcagagacagtgcctgagaggagactgctgaagcctcagctcagcagtatgtgagcttgtctgcctctgcaaactgtcactttatccagcatctgtaggtttgcattgccagatacccacatcaaagcctaacctctacaggtggctaatggaacacagcaaagaaaaaaaccactaagggagctcattaactttacgatgtaagaccaaactaaacaagtaaaatatgtggctcctattgatgagccacagggatgagacagaagaatgtagtaaattaagaaaaaaattactaagaactttcagaaaatgtaattagaacataatcaggatttttcagagctaaaaatttcctaagagaaaaattcaacagatgaactgataaataaccccttgtgagagctgaatcttttgttccagaagatcaaatagaaacaatttcatgatgtaaggcatatagaaataaaattatttttgaaaagataagagacctgcaggagcaaattcaagaggtttgggaatgagtgttatagaaagaaaacaagacagaacaagtattagtttaggaaataatagaagaaacttacctagtttagaaacattgaaggttgtcagattgaaaaggctgagacttagatacatttgattgcgggtggggctatgtggaaaaagtttaatgaaaaaacgtacatatctagagataatgtgcagaaataactgaatttcagtcatgagaaaaatcattcagagaaaagggaaagagaatcacattgacaatagacttctcactactaaccctggaaacttaagggaacattagaacaacatctcatagccatgaaaaaagaatctctaacaatcctgtacctagacaggatgtcctttatctcggttaagtaacggtatgttcggataatttatttcgtttaataagggaatgccttggtattggagctacagtgaacaggacaagcaagtggacatgtaactaattcctaggttagtgagagataggtgataaacaagtttagacaagaaaatgaaacgtgatgaccataccatccatgttaggtatatgcaatgcttagggacaattattatctgtattaatattcatattaataaaaacttcctatggaagaccatcctattgaaaaatggacgaacaaggcaacttgcagaaggagaagtatgaagagccaataaaaatgaaaagataagcatcactagcaaggaaacaaatggaaattaaaataagaccatttttcaccaatctaatgcaggcataaacaggaattctaggaacaagtagagtgttactgggaattaatgtaattttttggataaatttggcaatacatattaaaatgaatgtacatacatacactttgacttggcaatcctacttaagggaaggtaccccacaaaatatatatgcaccaaaacataaggagatatatatatatatatatatataaataaatgttgattgcagcattgtctgtagttgccaaaggtccatcaagaaaagaatagcaaagtaaataagaaacttccatactttggaatatcacacaaatactaaaaatagtagtaagtgtatctatgaatgtggaagaacagtcagaaaacactaagtgaaaaaaatcaaattgcatggtaatgtgtaaattaagattccaattttgtgtgaaaatgataaaagttcctgtatatatttatcagtttaaaaatttactcatttctgagttagaatccaatgcagacatttaaaatcaagttacagaagaatgttaagtttatacaacatttgtgataaaataatgtcataaaagcagattataaaactgtatgatagctttatataaagaaaaaaattgtattttagataaccctctacttaagaaactaacagatttatcaactgtgctcgtcataaccagttacattagcaggcatttacagtatcatcagtttggatttaaaaacagacttcagcagaagtctaatatgctgtaaaatataagagtttgtgcaaatgtccctggaaaagacataaggactacataaaaattgataatgattatctgtgaatggtgaaactattggcagtttatttttgttactttctgtgtttcttgggttttcttcattgaacatggagaaatttgtcattcataaaaaaaaaatttaacaaaaattcatttatgatcctgtatgaattttaaaattcatataagctaaaatgttaattcatgttttaaatagcccaagtaaggatgaattaaattactagaagcaggtcagcatttactcaatatatttaatataagccagattactatgactaatattatatttatcttaacatctccacaaagttctagaaataagacggtggtgaaaggataataaaaactcaggaccccaattcaccactccaaaagggaaaaaataagctgaaagcccagtcatgcaagaaactgcctttccttttgttcctgagctgataactacagataaaaggttaggttacctactccacaagtagctacttatgttcaccatatcttatgtaaagtgcctgtttaatgatgccagacgaatacataattgactattcccctacctgctcttttctcttggaacttgtggattaccataccctccttctctcccctccagcccacttttcccctttaaagattgaagccctcaaattcatctttggagaaaggcacagatcacagactgtcactgtgattctgtttttttgttccgggcatatgcttaaccttggcaaaataaacttctaaattgattgagacctgtctcagatacttcttggtttacaactatgttctaaataaagtgttggtgccacaaaagaaatagcactcaaatataaaattttctttttaattctcagcaaggcagtgtacttctatagaggggtgcgcccttacagatggagcaatggtgagcgcacacttggacaagggaggggaaggggttcttatccctgacgcacgtggcccctgctgctgtgtcgttcccctcttggctagggttagaccgcacaggctaaactaattccgattggctaatttaaagagagtgactgggcgagtggtttggcgggaaaaatggttatggcagagcaggaaattggaatgagtcagggtggagaatgagcaggtaatgggaacgagtcagggtggagtaggtaatcggaatgagtcagggtggaggaggtaatctaaaaagattgctttatgaggaagttaagtttaaaagtagaaggcaaagaattgaacttactgacatatcgattctttgaagagaaacttagaactcctatctaacaactataagtaataaataagtgaaataaaaattagattttcagtggccaaaaatattaaattattttgttactctttatgtactttatttcttcaacttacgacaagtataatttcttctaacttctttgttgtcttaatatttagcgtaatataaaaggtagtcacttaataaattaatgtgaaattatttctgatataaaaataaagctatcagactgttccctctgtactgtctagtgggaattttaggggggaaaaatgtacatacaaaatggcctacaaataacatggaggaatcatatgtaaaaactaatgtaccagttgcttaaactttcactaaactcttcttcctttgaaagatgaggaagagttttaattatatactgaatataaaaattatgctattcataatatgcatacagcacatttgcagtcagtggtaaattattgatcttgaaaccacctttgcaaaaataacaatgagaaaattatgacagtaaaagaaatctaatctaacccccatcttgcctttaacctcccaactgcccttggtcattcctgggcctaggccatgctaactttaggagaaatttatagtttaaatgataatggcccttccccaaaactaaaccacctttgtaaagctaacgaaagacgaggtcttgctgtgttgcccaggctggtctcaatctcctggacttaagtgatacgcccacctcagactcccaaagtgctgggattacagatgtgagccactgcacctggcctggataagcaaactttctaggtaaccaaagctttatcagattctgaaacgttactaatttaatgattcttttcctcaaatgtattctatagttttttatccttgtatgaaatatattgaatatgaattaacggtgtacttgaagattaaattgtataattataatagtaaattttgggaggtgtctatgttctaggcactgttgtagtgctttatgtgtattaaaattaatttgttattcataacaatcctctcaaggtagatacttttatattcccatcatacagttgagcaaactagggtacagagaggttaagtaacctgctcaagaatacatggctaataatgaaatgttagtaatattttgaaagctctatttctgcatcattattagagccataggcatctccttatcaatttgtatcttaaaaagaaatctcactggcacttttttaatggggtttaaagaaaaaaattgctctactgttttaagaatccccacctctctcaaaaccaacgactgatctgctttttgtcactgccaattactttgtgttttctggttttatataaattaagtcatacactgtatacttattttttctagtttctctcagcatattttgagattcatccattttgtcgtgaatcagtaattcattatgagtattagtttacggatttctcacagttggtttatccattcatctgttgatggacagtttgacttgtttcccgtttggggctgtaacaaacaaaactacatgaacattgatgtacaagtctttgtatggatgcgtatttccttttctgttgggtaaatatccatgagtggaacagctacattatatggtagaagtatatttgacttttaaaggaaatgtgaaacttttctgaagtagttataccattttacattcccgctagcagtgtatgagaatttctattttcctctatctttgccaacatgtggtagggtatgcctttttaattttagtcattctggtagtggtgtagtgatatctcattataattttaacttgcatttttctaataactaatgatgttgaacatttttctcatttgtttatttgttatgtgtgtgtcttatttggtaaaatgtgtgttcaaatcttttgcccatttttttagatgggatccttgatttcttgttgttaagttcatattttgcatcttgatatctgttccagtacaattggttgaaaagattatcccttctacacagcatatcttttgcacctttgtcaaaaatcagttgtctacatatgtgtgggtttacttctatatacttcattctgttccatgatctatttgtatatatttaacatcattttgattactctagatatataataatttttgaaatcacacagtgttaggtctccaactttgttcattttcaaagttgcttttgctattgtaggcctttgtatttccatattttatgttcatctcaatttttttttgtaaacattaaaacacaggaaaagaattagagcatagatataagggttatttttacttatagcattatatgtaaattaaaactacattgttttgaaaaaacttccactgaacaaacatttttctcaccatgtttactctttttttttaaattttattattattatactttaagttttagggtacatgtgcacaatgtgtaggtttgttacatatgtatacatgtgccatgttagtgtgatgcacccattaactcatttagcattaggtatatctcctaatgctatccctcccccctgcccccaccccacaacagtccccagtgtgtgatgttccccttcctgtgtccatgtgttctcattgttcaattcccacctatgagtgagaacatgcggtgtttgtttttttgtccttgggatagtttgctgagaatgatggtttccagcttcatccatgtccctacaaaggacatgaactcatccttttttatggctgcatagtattccatggtatatatgtgccacattttcttaatccagtctatcattgttggacatttggcttggtttcaagtgtttgctattgtgaatagtgccgcagtaaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaactgttcctatttctccacatcctctccagcacctgttgtttcctgactttttaatgattgccattctaactggtgtgagatgatatctcatagtggctttgatttgcatttctctgatggccagtgatgatgagcattttttcatgtgttttttggctgcataaatgtcttcttttgagaagtgtctgtttgtatctttcgcccactttttgatggggttgtttttttcttgtaaatttgtttgagttcattgtagattctggatattagccctttgtcagatgagtaggttgcaaaaattttttcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtataaggaagggatccagtttcagctttctacatatggctagccagttttcccagcaccatttattaaatagggaatcctttccccatttcttgtttttgtcaggtttgtccaagatcagatagttgtagatatgtggcattatttctgagggctctgttctgttccattggtctatatctctgttttggtaccagtactgttttggttactatagccttatagtatagtttgaagtcaggtagtgtgatgcctccagctttgttcttttgacttaggattgtcttggcaatgcaggctcttttttggttccatatgaactttaaagtagttttttccaattctgtgaagaaagtcattggtagcttgatggggatggcattgaatctataaattaccttgagcagtatggctattttcacgatattgattcttcctatccatgagcatggaaagttcttccatttgtttgtatcctcttttatttcattgggcagtgctttgtagttctccttgaagaggtccttcacatcccttgtaagttggattcctaggtattttattctctttgaagcaattgtgaatgggagttcactcatgatttggctctgtgtttgtctgttattggtgtataagaatgcttgtgatttttgcacattgattttgtatcctgagactttgctgaagttgcttatcagcttaaggagattttgggctgatacgatggggttttctagatatacaatcatgtcatctgcagacagggacaatttgacttcctcttttcctaattgaatgccctttatttccttctcctgcctgattgccctggccagaacttccaacactatgttgaataggagtggtgagagagggcatccctgtcttgtgccagttttcaaagggaatgcttccagtttttgtccatccagtataatattggctgtgggtttgtcatagatagctcttactattttgagatacatcccatcaatacctaatttattgagagtttttagcatgaagggttgttgaattttgtcaaaggccttttctgcatctattgagataatcatgtggtttttgtctttggctctgtttatatgctggattacatttattgattttcgtatgttgaaccagccttgcatcccagggatgaagcccacttgatcatggtggataagctttttgatgtgctgctggattcagtttgccagtattttattgaggatttttgcttcaatgttcatcaaggatattggtctaaaattttctttttttgttgtgtctctgccaggctttgatatcagggtgatgctggcgtcatcaaatgagttagggaggattccctctttttctattgattggaatagtttcagaaggaatggtaccatctcttccttgtacctctggtagaattcagctgtgaatccatctggttctggactttttttggttggtaagctattaattattgcctcaatttcagagcctgttattggtctattcagagattctgcttcttcctggtttagtcttgggaaggtgtagggtgtatgtgtccaggaacttatccatttcttctagattttctagtttatttgtgtagaggtgtttatggtattctctgatggtagtttgtatttctgtgggattggtggtgatatcccctttgtcattttttattgcgtctgtttgattcttctccgttttcttctttattagtcttgctagcggtctatcaattttgttgatctttccagaacaccagctcctgcagtcattgatttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccgattttttttaaggtttttttgtgtctctatttccttcagttctgctctgatcttagttatttcttaccttctgctagcttttgaatgtgtttgctcttgcttctctagttattttaattgtgatgttagggtgtcaattttagatctttcctgctttctcttgtgggcatttagtgctataaaattccctctacgcactgctttgaatgtgtcccagagattctggttatgttgtgtctttgttctcgttggtttcaaagaacatctttatttctgccttcatttcgcaggagcaggttgttcagtgtccatgtagttgagtggttttgagtgagtttcttaatcctgagttctagtttgattgcactatggtctgacagacagtttgttataatttctgttcttttacatttgctgaggagtgccttacttcaaactatgtggtcaattttggaataggtgtggtgtgttgctgaaaagaatgtatattctgttgatttggggtggagagttctgtagatgtctattaggtctgcttggtgcagtgctgagttcaattcctggatatccttgttaactttctgtctctttgatctgtctaatggtgacagtggggtgttaaagtctcccattattattgtgtgggagtctaagtctctttgtaggtcagcaaggacttgctttatgaatctaggtgctcctgtattgcgtgctcctgtattgggtgcatatatatttaggatagttagctcttcttgttgaattgatccctttaccattatgtaatggccttctttgtctcttttgatctttgttggtttaaagtctgttttatccgagagtaggattgcaacccctgcctttttttgttttccatttgtttggtagatcttcctccatccctttattttgagcctatgtgtgtctctgcacctgagatgagtttcctgaatacagcacactgatgggtcttgagtctttatccaatttgccagtctgtgtcttttaattggagcatttagcccatttacatttaaggttaatattgttatgtgtgaatttgatcctgtcattatgatgttagctggttattttgcttgttagttgatgcagtttcttcctagccttgatggtctttacaatttggcatgtttttgcagtggctggtaccagtttttcctttccacgtttagtgcttctttcaggagctcttttaaggcaggcctggtggggacaaaatctctcagcatttgcctgtctgtaaaggattttatttctctttcacttatgaagcttagtttggctggatatgaaattctgggttgaaaattcttttctttaagaatgttgaatattggccctcactctcttctggcttgtcgagtttctgccaagagatcggctgttagtctgatgggcttctctttgtgggtaacccgacctttctctgtggctgcccttaacattttttccttcatttcaactttgctgaatctgacaattatgtgtcttggagttgctcttctcaaggagtatctttgtggcgttctctgtatttcctgaatttgaatgttggcctgccttgctagattggggaagttctcctggataatatcctgcagagtgttttccaacttggttccattctccccgtcactttcaggtcaggtacaccaatcagacatagattttgtcttttcacatagtcctatatttcttggaggctttgttcgtttctttttattcttttttctctacacttctcttctcgcttcatttcattcatttcatcttccatcgctgataccctttcttccagttgatcgcatcggctactgaggcttgcgcattcgtcacgtagttctcgtgccatgggtttcagctccatcaggtcctttaaggacttctctccattggttattctagttagccattcgtctaattttttttcaaggtttttaacttctttgccattggttcgcacagagtaatttgattttctgaagccttctttcaactcgtcaaagtcattttccatcaagctttgttacattgtttgtgaggagctgcgttcctttggaggagaagaggcactctgatttttagagtttccggtttttctgctctgttttttccccgtctttgtggttttatctacctttggtctttgatgatggtgacgtacaggtgggtttttggtgtggatgtcctttctgattgttagttttccctctaacagtcaggaccctcagctgcaggtctgttggagtttgctggaggtccactccagacgctgtttgcctgggtatcagcagcagtggctgcagaacagtggatattggtgaacctcaaatgctgctgcctgatcgttgctctggaagttttgtctcagaggagtacccggccgtgtgaagtgtcagtctgtccctactggggggtgcccctcagttatgctactcaggggtcagggacccacttgaggaggcagtctgccggttctcagatctcaagctgtgtgctgggagagccactaccctcttcaaagctgtcagacagggacatttaagtctgcagaggttactgctgccttttgtttgtctgtgccctgcccccagaggtggagactgctgaggaaggcgggcctccttgagctgtggtgggctccacccagttcaacttcccggctgctttgtttacctactcaagcctcgggaatggcgggcgcccctcccccagcctcgctgccaccttgcagtttgatctcagactgctgtgctagcaatgagcgaggctccgtgggcataggaccctccgagccaggtgcgggatataatctcctggtatgccatttgttaaccctgttggaagagcacagtattagggtgggagtgactcgattttcctggtgccgtctgtcacccctttctttgactaggaaagggaattccctgaccccttgcgcttcccaggtgaggtgatgccttgccctgcttcagctcacgcacagtgcgctgcacccactgtccggcacaccccggtgagatgaacccggcatctcagttgtaaatgcagaaatcacccgtcttctgtgttgctcatgctgggagctgtagactggagctgttcctatttggccatcttggctccacccccccccccccccccccccccccccgccatctcatcaatttatacagaaatgtctgctgggagtttgattgggattacattgaatctttggatccatttggggagagttgctatcttagcaatataaacaagatgtatttctccattgaagtatttttactttcagcactgttttctagttatcagtgtacaagtatttcatctcttttgccagatttatccatatctcacaactttaatgttactgatttttttcattttctaattgttcttattagtatgtaaaaatgcagttgatttttctatatttgtcttgtgtccagcagtcatactaaactcacttattatagttaattccattaggagtcctatgcaaatgaccatatcaaaaacagttttactttttctccccaatttatataccttttctttttcttgtctgaatttactgcctagagtctagacagtgttgaatatgatgaaggcattcagtcttttaccattaagaatgatgttataaatattttataaatctctttcatccagatatggaagtttcccatttcttcctaatttactgagaatttttaatcaggaatggatgttgaattttgtctaatgcttttaatgcaatgtattcagactgtcatggttttccttttttagtttgttaataaggtaaattacatgtatttaattttgttaaaccccaaccctgcattcttggataaacctcatttggttgtgatgttttttttttataaggttgaatttaatttgctataattttgtttagaatatgttaatgagggaaggagaactacaaaccactgctcaaggaaataaaagaggatacaaacaaatggaagaacattccatgctcatgggtaggaagaatcaatatcgtgaaaatggccatactgcccaaggtgatttacagattcaatgccatccccatcaagctaccaatgagtttcttcacagaattggaaaaaactactttaaagttcatatggaaccaaaaaagagcccgcatcgccaagtcaatcctaagccaaaagaacaaagctggaggcatcacactacctgacttcaactatactacaaggctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatttaataaatggtgctgggaaaactggctagccatatgtagaaagctgaaactggatgccttccttacaccttatacaaaaatcaattcaagatggattaaagatttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatgtaattcaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaacccatcaaaaagtgggcgaaggacatgaacagacacttctgaaaagaagacatttatgcagccaaaaaacacatgaaaaaatgctcatcatcactggccatcagagaaatgcaaatcaaagccactatgagatatcatctcacaccagttagaatggcaatcattaaaaagtcaggaaacaacaggtgctggagaggatgtggagaaataggaacagttttacactgttggtgggactgtaaactagttcaaccattgtggaagtcagtgtggcgattcctcagggatctagaactagaaataccatttgacccagccatcccattactgggtatatacccaaatgactataaatcatgccgctataaagacacatgcacacgtatgtttattgtggcactattcacaatagcaaagacttgaaaccaacccaaatgtccaacaatgatagactggattaagaaaatgtggcacatatacaccatggaatagtatgcagccataaaaaatgatgagttcatgtcctttgtagagacatggatgaaattggaaatcatcattctcagtaaactatcacaagaacaaaaaaccaaacaccgcatattctcactcataggtgggaattgaacaatgagatcacagggagacatgaaggggaatatcacactctggggactgtggtggggtggggggaggggggagggatagcactgggagatatacctaaggctagatgacgagttagtgggtgcagcgcaccagtatggcacatgtatacatatgtaactaacctgcacaatgtgcacatgtaccctaaaacttaaagtataataataaaaaaaaagaatatgttaatgagggatcttggcctgtagttataatgtctttgtctggttttgttatgaggcctcataaaatgagataggaagtggttccttctctttggtgttctggaagagtctgtattcaactgatattatttatttcttaaagagttggtagaatttaccagtgatgctgtctcagcctagaattttctttgtggaaaggatttgaattggaattataatttctttaacagacattggcttttcagggtacagatttcttttcagtgaactttggtggtttgtgtttatcaaggaatttgtccatctcatccaagttgttaaaattattgtcatattaataatgtgacctcattattcttttaatacctctagaatttgtagtgatatcacctctttgatttctgttagtggctcttttttgcctgatcagtgtgaccagaaatatgtcagttttagtgatcttctaaaacaataacaaaagaaccccagatttttattcattgattttatttttctgttttctatttcattgattaccactctgatctctgttatttgcatgcttccccaccctccaccacttgctttggatttcgtttgctctagtttaatttgtttctagtttaaggtagaagcttgtcattgatttgagattttcctttttttctaatataagtattttaaggctgtaaatttcctctttagtactgctttagcagcatcccacaaattttgggatgatgtatttttaaaatttccctttttctcctttgattcatgggttatttagaagtatgcagttaagcttcaaaatatttgtgggctttccagaattttttttatttgtttctagttttgttctattgggatcaggaaacatatattatacacattttatttttacacacggtataaaccccagcatacactgctattattcttgttttaaagcctgttatcttttaaagaaatttaagtgaagcaaatgaaatttgaatttaattaaatattttttttctgactcttacccctgtcatgcggagactctgtttatatgtatattgggctacatgaagttgttcctcaattcactgattttgtttctgttttattttgggtttttttgtgtgtgtgtgtgtttcattatggataatttttattgctgtgcttttctgatcattgtctaacctgtcattcatccagccaatgtctttttcatctcagatattttagtatttctgtttctagagttttgtttgagttttctatattgcctaacctttggaacatacagaatatagttcacatttggaacattatgaaatatagcaaaaggttttaatgtccttttgtgctaattttaacatctgattgagttatgcattgttttgattggttgatttttcattatgtctcatgtttgtcttactcttcctggactcttcagcttcttctcaactctggaagtctgccaggctttgtcttagtgcgccttctaagtgtgctgacccagaaattctcacaaggcagtaagctgggtaagagtaggagggtcacttcagttgtttcttatctctcaaggatgactggccttcattgcttgatgccagtgttttgaaaagtatttcatagattttgtctgtttttgttgttgttgttgttcttgtttttttatgtgtgaaacctttgttatgatttgatttgaagccattttccttttgcttccatactctccatattgcaagaacataaaattgcacataaagaattagaaagatgatcttatctgaagaattttcacccttttgtttttgtatcttacagtgttgaaactctagtttcaaatacattataaaatagtaaagttaatggtcaaaaagaaagcaaaccacctggttttgctgaagaaactaagtattttcttggtcattcctttgaaaaacaggaagccagaattagaaagtaatttgaaaccttggataatttcttggttttctttggttctactttgagtacatgcccacctccctctaaaatgataggaattcagtattactgtaaagtagtttgggcaaaacactgccacttcactctgttaggcgtaaaaatgtttggctggaaacagctaaatataatattttgtacttacagaaatgtaaaatggttgtttgaacttcacaaatgtatgtatgtcatgacgcagatgtatgtcatgatcatgtaatagcactgtttttaatacaatttcttttttttttttttttttttttgagacggagtctcgctctgtcgcccagcggggagtgcagtggcgcgatcttagctcactgcaagctccgccttctgggttcacgccattctcctgcctcagcctcctgagtagctgggattacaggcgcctgccaccacgcccggctaatttttttgtatttttttagtagagacagggtttcaccacgttagccagaatggtcttgatctcctgacctcgtgatctgcccgccttggcctcccaaaatactgggattacaggtgtgagccaccgcgcccggcctacaatttgttgttaaaaaatattttgttaacttagaaaaatgaactagctgatactcaaattttggaaattaaaggtttgctctgttttatgtctgtatctggggctatattttgtagtaaatcagagaccaaaagattgtttttgaaatatataaatatgctgttctgaagttaatactgtgtaaattttgagtagagtaagcgttttgtcttaaaggtgtaataaagccataaagtggcattgttgctttataaacttagaataataatttgccatattagtgcagagttcaaaaagtactatatattttgcaaaatagtcacttactcattattgaataatgcagttacttgagagtatgcatgtctagaatactttatgaagtactgatttcactgaaagattttgaaatctgtaaaaaccctttttttcaacatgggttatattaaaaagtcgcttctatttgcataattaggctataattctccaagggagggtattggagaataaattttttttcgaagtaagaatttataaaattaaaattcagggttacagttatagccttactctttaattcatgattaataaaatttctctttcagacggcaaatggatacatcttgttttttcatattacatctacaagaggggacaagtacctttatgaaccagtgtatcccaagtaagtttgttgcctttcattcttttaatatgtgatttgcatactttatattcagaaaaacattacagttttgagttgtctgtagtgattagaataaaactaaaccagcatttcccaaatagtatttaaaaaattaccaggtctttgaactgtcatttcttgaataaagaattctttaagtctgggaatcttgatgataaactatatcaagactattttcttgggtattcagaatgactgttaatatattccaggtctagcatttctcattccttattagggaagagctaagagatcatgagaggaagagttgaaatgttggtaagttacaggtacttttgcatgtgcttttgtatatgcatagaaaaaaaagaacctcagacagttattacctcttggtttaaatttgggaaaaacgtggacttttgccctttacactgtgtagttatgtatattttgcattcttttccttatagcaggccttaacttttgaaataaaagaacatacaattgtaaagcattccatctttttttttttttaatcaagccataaagccagataaaaatataagagcatttatcacatttctagatggtggaagatatccaaagtttaataggtatataagaaattagaaagacagattttactgtgtgaaaagtttaaatttttgaatattaacagaaaaaaagaaaaacattaacagcaaataacttgggaaaaatatttgtggtaaatagggccaagtcttactacttttatataaaagagatatataaattgccaataagcacacagagattccagtagataaatagggaaagtagtctcattaaaggaaatactgtaactaacaaactcaagagaaagtatttagacccagtagtaacccaaataaaataaacgttaaataaaataaacccaaataaaataaacattaaatataaccatttttattttttaataattaaagaattattactgctcgcagaggtataataaaagttgtgttgcacacttctgatacacaaaggtgtgataatagggagctggttaacaagttaactgtggtacatccttctcttatagtgatatgtagtcattatgtctcagaaaaatgtataaacttaagaacttgaccatattataatgccaagtgaagaaacaagtcacacaaaattatatatgtaatatgaccatgactgtataaaacaaaacaacgcaagtcatctaaagacaaaatctagagcaatacagtacaaatatttatagtaattgttcctgaatggtagaactgtagtgattcttctgcttttcaactcttaaattttcaactagttagattttcttgatgctatagccacttgtttttgtaacaagtatagtgctaactgaggtattcggttttggaaatctttaaagtacagacttttttgatgatgggattcaatttaacttgtttatttttcaataaaaatatttagtgcaaaaatttttgacacataaatatagtgcaaaatgataggaacatcatgatgtatttagaaattttaaattcagttttatgggtaaaactgaaaaaagaatttttttgcattctaagtgataattttgtgattcttttgaagaactgttgtaatcaatgactaaaattagatttactggtgcattttaaactactatgtttgttttattgcttaatttagacatgttcctataaataaaaagcagtaatcagaaacaacaatttaactccattaatttatgttcctgtgggcatggtagagaaataacttctcttgaaacagtgaaaattctattttctttatttcagttcactaataccattacatgtttatagtgttttggaatagtattttgagacccactttttgtgttccagaaaagttttaagaaacagtttctttcttttctgattctaaaactgcaagagacaccagttaactaagtagtcctgacaatgcgtgaactttgctgtgtttgactctatgtgttaaggcagagaactaaataaaaaacatactctctttcttaatttgggcattcttttactatattgaaagttttaggtttcagtggctggcctcaataaaatgtgcattgctttagagcagttcgaataatagttaaagatacaggctttggtgtcagatagacctgaaattaaatgttggctgtgccacttttcagctatatgacttctttcaagttatttaataccaccaaaaactttcctcatctgtagagtaggataacagtagtaatcatctcataagattaaatgagatcattcatatttaatgcttaggtaagcacctagcttatgggataattaataaaggacaactgttattatcagtaatttttttcaccaagtgtttacttcatttctaagcttttaagtaatttttaaatatatacatatatatctacttgatattttacttctttgccagagtctaacttctagtaactgctacctaaaatctcttatatgaaaatagttctgcagattaaagtcagcctgttgtgtatttgtgtgcttgactgttctagttatgttacttagtctagtgagtttcttggtttttctgcagaacccatttgtacaatgggaataaaaataacttctttcattgttaagaggattatgtgaattcatattcttaaaacctgaaaaatagtggttatataaggttttgaggaaagtaaagtttggttttgacagtggtatcttcattgtcatctgtgccattataaacccttctgtagtttgagacactgttctaagcattttttaatacgtatttaatccctttagcaaccctatgaggtagttaggtataactgttttacaaactgctgcacagagaggcagagtaactcacccatagtcacacgcgaataagttgtacagctaggattcagacataagtgttgtagctctaaagtctgtgctattaatcagtaatatactgtctcaaccctgtttatgctccatccagctactactttggggtttatctgggagtagagaatggaaaaaggagaaatgatctggagtggtttctaatagtcctgaagaatagaggcagtataattactgaggccagtggttaatcatcctcttctcacttagttatagaaatactattgtctctcgtttctcttctgtaaatcttacaagttcatcacaggagtttttctagagtatcttaacttccctgtattatgtgacagcatcttaacctcagactgcatatccttttccactatgctccatctgagaacacagttcagatgcctcatgatctttcctagtttccacctagtgttgtttctagcatccttctatagatgttgggagtcagtctataacaatggtggcagtcttattaagtgactctgtacctcaaagatcatttattctttggtgaatgaattttccattttagaaatcttagattccattgtatattacattatctcttcatattagttacacagaccagtggaccagactagttgaaggttgtctggacattttattttatggcttggaaattttagtgaaattaatgaaggaaacttccagggataagtcagaaataatttgtgtttagctttaaaatgtgttcatatgcttatgtttaaatagaagtttagtagatttctaaattgcacatcatgtttaatttcagcataatgaaaaaaatttaaacaaatatgtcatcatcatgtatactttgttgagagcagagatttttttcccccttcttcctgtcttttcactgctactattaccctcttttttgttagagactagcatttttgaggctgagtttctttaaaaaaaaaaaaagtttctgtactgaaattcagtacatttaattattatatagtaaagatactggtctttttcactgaagaaaaaaagtcactccaaaatataatcaaatctccttctcctcttccccctccaccctccccatataatttcatcagatggcaatacttcttaccagctcactgctaatgaattagtgccagctggaaaggaagaagagcatagctacctgaggttagcaatttttaacttcaacacaacttgccccttctaaaatccagcttctttgcagaagaaacctacagtaagggacagaagcatctaaatcgtatcaaatttaaaggtgacaagagatctgaattagttacagactcatgaaagtttccctcaatatatgtttctttttgctaatatgttgtgagtgttctttttctagagaggaactttagccactttttccccgtatttctaataataaaccttgttctacattcagtttataaacttgacaaagtatgttagtgatcttgatgttttttgttctgcttgagcctctgaaaacatcccgtgtctaatttgatttcagtgtgtttatattctgtaaatgtacatgggtgaccttttactactgaactttgcatattacatgcatccattacttcacattatagttgcatgagcacttattaataggattggcaacagtgttattatataagttctggatagtgaaaactcccttattggccacacttccaaggatggcacctgaatccaaagaatggtaggactgcccaaatcagagagccctgcacattgtttctgtcagactggaggctgtctcaatgtgtgataatataaacgataagcagttttggtttttggtggcttttttttttttggttctatgaaaagtctggtgaaagggtactacgtctttcaaaaaactcttctgaaaattattttcatccatctgtctatccatttaaaaagtattgaattttgtccagctctaggcactgttgtagatactagagatctaacagtggaaaaaaacaacaaaacaaaaagccctgctgatagatcttgttattcttctagtagagggtgataagtaaaatacattatgagttaggtgatccactctatggagaaaaattaagcagggtaagggaatagagagtggaatatgacttaaaatagtggtcagtgtcttcactgagaagatgacatataaaaggatctcaaagatgatgaggtaacaaaacatatatccaggggaagacaattctggattggtgagatttagcaggtatgaaaattcataagaagataccgtgaataaattttaggtcctataataatttatagttagtaagaaatgatgaactttttttattagctgtaaaaatgaaaatacagtctgatttttaggtaactgaatcctgggaaagtcaagagcgcacccgcttttttcttccagtaaatggcaccaccgtgtatttgagtttattcactcttcctgcccactaacatcaatagccagtctatatccagtctagtatattctaccttgtatgtcatttcttttccctcctcgtaattcccaatgacactagttcagtttaggtcttgtcacttttctcctggattattattatatctttttttttttttttttttgagacagagtctcgctctgtcgcctgtgctggagtgcagtggcgtgatcttggctccctgcaatctccgccttctgggttcaagcgattctcatgtctcaatcctgagtagctgggactacaggcatgcaccaccacacctagctaatttttgtatttttagtagagacggggtttcactatgttggccaggatggtcttgaactcctgacctcaagtgatctgcctgcctcggcctcccaaagtgctgggatttcaggcgtgagccactgcacccggcctattatgtcttcttaatgtcagattcatgtctaaacctcactcacttaccccctgccaagccaaacatgctattgctttgctaaacttttttgcagttaccatcatcttttgtacgttgtatgaggtagaaaacctttaattctttgtttcttcctctggattgtttcttcactttacatatttgttcagtcatcaaattttactgattgattagagttttccagtgcctctggaattcatttaactctattttactctcattggtctttttaggggccctcatgtcctcctccttgtctattaaaaaagcttattcactaactcatttctcttcccctagtctctttcacctacataatgaagtttatcatttgcattgataacaatttttttttttttccaaaacgaagtccaagctctctggcctggcatttagaacctactttctccatatcttgaacacatcgaacccacaattcctatttaatgcctctattcctttgttatttgctctattcagtatgactcccctgctatctttttttatgtaagaaatttatctgagttggttttcaagctcaggtcagacatctgttgtactctataaaccttctgccctcaactctcctatatccgcccctgtacccaataaataactgatctggcatgtgcattcccatagtatgttttaaaaatttacactactaattcatcaataccttcttacttaaaaaaaaatccaacaatgagagatctataaagataaaaagtaaaaaaatgtgaactttgcttttttagattctaatctcatttcactctccagttgtcctgtatctcttgagtaaataaatacctaggaatagaattgctgggtcatatcacatgtctagtaatttcagattggatgttagatactgtattacattatccattgtctgatttttgtccttttcctttaaagagtattgaaggttgttttgggtggcaggtaagctgcttggagatcttactgatcttttgaggctttttgtatgtcttttaggatggatttaactgttaagctagcttagcccttctgaagtccactgaatgtcctaggtctttaagaaggtctctccattctggctagtcagaaccgaaatgtctcccagtcctatatgaactgggtagccaaaaaccctagtagtcattctttgcctgtatttgtggagtgtcactatgtatttggatagtattcagtaagactcgggaaacccctgcaggtttctagagcttttctctgtgtggctcccacatcactggtgctctgcttcacaaatagctgcttctgcttctctgaactttaatctttttctcctcaacttaacaaggctgccatactatgcttggtttctctcactctacatgatggacaaaaccttaagaggttagatggtgacttctgccagaaaacctgtttgttttccttccctcatgatatcagtcctgtgctgcctgctgtctcatgtctgaatatggttggttgatctattttgtccagttctcttgtttctgggcactagtttggtaccaggtactctattagtagaataataaaatgaccatctgtgtgtccatcagtcagtttgaacaattttcagtctttttccactggagtatatttaagcacatccaagatatcattatttcatttcatccaaaaatactttttattattgtaagcattccagtaaacaatgatgaatgcaaatgatgaaatatgaggcctggagttttaggaaaagaaatcgttctgagcctttccagaattatggttggagaactaaagcctcttagtcccagaatttacataggactgccagaactttctagatcaagccttgcacatttcagaatcatctcaaatggattcatcctcatttattgtatgcctgctatctgtaaaacacttgctatacactgctactgaagatgctaatgaataattgtttaaagttaatggcaatataaaataacagattgccaggtaaatatcttgaaaagtcataatagcatttcagggtaaagtgattagttgtcaagggaagttttgtagataaggagacttgagttctatacttgggagagaagtcaggacttaggtaagttatgttgcaaggaaaaacactataattaattgcattcttgaagtttctgttcccccacaccccaaatctattaggttatttgccacattattcttttctttagctggcacttaaagcatttggtatctcctgcacagaagaatttgctcaaagaaatggctgttgaatttgtgaatcagttttctgtatcacctgatctagccctcaaagcatacttgacatgctttaaaagcagtcttcttttcttttaagacttctgtgtagtttttatgctacacttggtattgtggtttgatttttggtttttaccaatttgatgagaaattactccccgctcagtgtcctgggaagtttgactagtggttgacccatcccatagaaacattttatttttttcatggccctttaagggccactcattaacatgaatgccttatcattcattggaatagaaaactgggaggctttacttttagttacaaaagttaatgtatggaaaatacattaataaaaccggcttagcttcatttttcctactttcttgtgatatttttcttagacttgctattgatacctcagataaatatccagcagtttagagatgtggaaaaaaatatggcagttggaatcagagaggcccaggttccagttcagattctgctttttcccaagactttggaaaagccattttctaaagttgctttctgtgctgtgtgtctataaaatgagaaaaatgagtgattagattcttaataagttgcaactggtattgttgtctaggttgccttctgaattatgtaaatataatgtgcctccattgcatatttatgacaatttataagtgtttaaaaaagaaggggattctagttcattaactgcgaggttttagagtgaactagaatttgaagaatgacaaaactttaagaggttgccaaaaaatacaggtgtacttgttcaaaagcaagtctcagattgagtcatgtatcaaatgtaagcaataacagacttgactcctctggggaacttaggcagagtattcatttatacaatacttgaaaattccaagtattaacaaagatagcttctttaatatagcgagaaactccttacatcatatccttgaataatgtcataacatcgatgagggaaaaaaattgatccctggccagggccactgtcaatatggaattttcatattctccctatgtctgtgtagtactgtagtttcctcccacatcccaaagatgtacgctttgggtgaatcagcatctgcatggccccagtctgagcgagtgtggggtatgtgtgtgagtgcgccctccaatggaatgacatctggtccaaggtgggcttcagctttggccccaagctgctgggatgggccgtggccacctgcaattctgaactggaattagtgggtaaatgtttttattcatctttcttaaatgtatgtatagcttacatttatttcaatgtctttttttttttttcaaaaaactgtttgtatattgcatatataactaaaatataaaagcaacattttataaaactttctagagagacaaattccacacaagtggtaagggcaacctagtgtctctagatttgttctgtttcataaattggattttaacaaatcctatgtaaatcaatttttgtaaataaaatgtaattgttggatttttcacatgttagatttttgcaataatctgagatttacaacactttctgatgtatgttcactctgattctgaaactaaattatattattggatttcatatacagtattaaaattagtggtggtttaccaagattaaactttaaagcatatctgaaagttatctatctgtaaataagacaaattgtctacagaattagttttatatagtcagtgatgtgtaaacctcttggctttaagaaccacaacaactttgaatgcattaagaaaactgtcacacaattgatccgaaactgcattaagaaaaaaattcctacttttttttttttttttcctttcactggtttcttgtctctcagggtcatcgttccatgggctgtccccacccaaccccaccaagtttccttcattgacatttctgttctttccttcacaaattctgccatggcttgtagggagagcacctgattaaccaatactgagctgggaatgaccgacacttcttagctagttctataaattttgttagtttgtttttgttagccccagttaatctcaaatagatagaaatttagaacattattgaggggattataatgggattaatcccttttgcctatcccataatgtattcagctgtttcatttctttttgttcatttgtgattttgtgttttcaaagtaaaaaatctgaatatttatttagagtttactttggattaaaaatattcaatttattagagcttcaaaataataactgtagctcaaacttttaagttccatctacaaatcttaaaaatctattcgtaaatctagcaaatttcaacacttttagaggggaatcttacaaattaaattctcttacgtatattaatgtatatttataaatatgccttataaatatataataaattatatattttgtttcttcttaaaatacttgaattgtctaacaagctttgtaccatttcatgagcaggtatttttgccaaagcatgatatatgcattgtgtaaacaccttcattctgcacaagtgcacactaaaaacaaagcttgtgggaaaatcgttggaacagatcacttaaaacttcctataactttgaactagaggagtcacaaataataatcttaataaaagttagaaaataattaaattttttcttttccatgtagtttcacaaagacaactgcaagttataaatattttttttcaaataagtataatttcctactgcttccctactcttcacattcttttccccagttagcttacctagcttttagttcagattcttctcagaatcgtatggtcaaagtctggtgtttaatttcccttcatgtttcttctcaaaatttatcaaaactatcactatgacttaagttggctgggttctatttcattagtgcaagtaaacaataacttgttatcacccatttgtggtaaaactgtggtatagctggctcttctgtttgagacctatagaaaagctctgaatgttttttttctttcatgagtggatgtgtacatagcactcctgatggagatatttatcttttttatgggcatctatattgaatcctttggagtatatcgatttaaatgcaaagtgtagcttagaaataaatgtttgggctgggtgaggtggctcacgcctgcaatctcagcactttgggaggcccaaggcgggtggatcacttgaggtcgggagttcaagaccagcctgaccaacatagcagaacccccgtctctactaacaatacaaaaattagctggtgtggtaatcccggctactcaggaggctgaagcaaattgcttgaactgggaggtggacattgcagtttgccgagattgcaccactgcactccagcctgggtgacagagcaagactccatttaaaaaaaaaaaaaaagaaaagttcagttacattttctcttgaaaattcaggtttttgttttctatccatcttccttaccttgtatagtttaacttaacttttgctctgtataattcgtactataacattagtatgaatatggtaggtagtgcatgtcaaatctattatctgttcttccaaacaattttgcttttagtgagaaaaccatcataattaaaatattgaagctggttagtttctcaagcacatgactgggatcaaaagcaaaggagtaactgttaacatttaatacactcaaaatgtcaaaaaacatacgtgcatacatcccacttatgcagggatccacgtattaaacatcatcaattgcctggaatagctaagactcaggaaataaggcctccaaggggacactcatctttactcatttaagacatttgttggttttgggctatatacaaggcaatggtgtgaattagagttgattttttcccagtctgaagctcatagtttattaaggggacaaaagctaaattcagataatatcaaatatactgtaaaagtgatgtgtactctaaaggagctacagataaatagctttgggaggcagtttagaaagggaatatactttcagtgtattattgaggaattctttgtaaagagagtagcatctgagctgagtcatgaggtatattagtctattctcacactgccataaataaacacctaagactgggtaatttataaagaaaagaggtttaattggttcacagttccgcaggctatacaggaagaatggctggggaggcctcaggaaacttacagtcatgacagaaggagaaggggaagcaggcacctcttacacggccagagcaggaagccggggagaggtgctacacacttacacactttttttttgttttgttttgtttttgtttttgtttttgtttttgtttgtttgtttgtttgagacagagtctcactctgttgccaggctggagtgcagtggcaccatctcggctcactgcaacctccgcctcccgggttgaagcaattctcctgcttcagcctcctgagtagctgggactacaggcacacgccgccatgcccggctaattttttttgtgtgtgtattttagtggagacaggctttcaccctgttgcccaggctggtctcgaactcctgagctcaggcattctgcccgacttggcctcccaaagtgctaggattacaggcgtgagccactgcatgcaactgagctacacacttttaaacaaccagatctcacgataacttactatcacaagaacagcaccaaaggggaaattgccctcatgatccagtcacctcccaccaggccccacctccaacgttggggattacaatttgacataagatttgtgtagggacagagacccaaaccatgtaattccacccttgtcccctgccaaatctcatgtctttctcacatttaaaatacaatcatgccttcacaagagtcccccaaagtctgaacccattccagcattaactcaaaagtccgaagtctcatctgagacaaaactagtctcttctgcctatgagcctgtaaaatcaaaaacaagttaataacttccaagatacaatgggaatacagacattggttaatactcccgttccgaaagggaagaatcagccaaaagaaagggactataagccccgtgcagatctgaaacacagtagggcagtcattaattcttaaagctccaaaataacctcctttgactccatgtctcacatagcattaagtacatttacagtgttttgtacaactatcacaattacctagttccagaacttttacatcactccaggcagaaaccatggattcattaagcagtcattccctgttctcttctgctctcagcccctagaaccatacatttgtttcttgtctgtgtctctctggatttgcctattctggatacactatataaatataatacagcatgtaccttttgtgtcttatttaattgctggatactttgtataaatggaatcacacactatgtaccttttgtgtcttcttaatgtaatgttttcaaggttaattcgtgttttagcatgtatcagtacttcgtttcttttatggctgaataatattttgttatatggatttaccacagggtgtttatccatgaatcaggtgatggccattgaggttgttttcactttttggctattggaacagtcctgctatgactaggagtgttcatagcagttgttcatgtacaatttgtatttgaacacctgttttcaattatttttgggtatatacctggaagtagaattgctaggttacatggtaattctatgtttaactttttgagaaactgccagactgttttcccacaagccatatgtgaaggttctggtttctccatatcctcatcaacatttgttattttctgggtttttttttttattatattagggtcatcccaatgaatgtgaaatagtatctcattatggttttgatgtgtatttccctaatgattaatgacattgaacatactttcatttgctctttggccatttgtgtatcttctctagataaatatctattcaagtcttcttcccactgtcttttttttttttatttttttaaagaaagcttcttgctctgtcttccaggcagtgtcacaatcatagctcactgcatccttgatttcttgggctcaagcaatcctctcacctcagtcaccagagtagctgggactacaggcatgcaccaccacacctggctaattttttgatttttttgtgaagttgggatctcactacattgttcaagctagtctcaaactcctgggctcaagcaatcctcctgtcttggccccccaaagtgctggaattacaagcatgagccaccatgccctgcctctcccttctttttaattggtttgtttatctttgagttataagaattatttatatattctggatactacatccttttaagatacatgattttcatattttttttctcattgtctgggcttttcactttcttggtagtgtattttgcacaaaaaagtttaattttgatgaagtccaatttatatatatattttgttccttacagtttttttatatctagaaaacaattgccaaatgcaaggccatgacaatttacgcctatattttcttctatttttttaagaatagttttagctcttatatttagagtttttattcattttgaattattttttacttatgatgtgagataaggatccaacttaattctttcgtaaatggttattcagttgtcttagtacagagaatgttgtttcccctgttgagtgcacttggcacctttgccaataatcaattgaccataggtatacaggtttattattaggctcttaattccattccattgatctgtatgtctgcccttgtatcattaccacactgtgttggttactgtagctttgcagtaggttttgtgatcaggaaatgtgaattctccaactttgttcttcttttcaagattattttggctcttcggggttccttgcctttctgtatgaattttaggatcagctttcccatttctgttttttttttttttttttttaaaagaacattgggattttggtagaaattgcatttaatctatagctgtttgggaagtattatcgtaacaatattaaatattccattcatgaacataatatacctttccaatttcttagttctcccttaatttatttacgcatacaactcttactcatccttgggtcagtttattcccaagtattttattcctttttgatgctattgtaaatggagttgttttctgaaatttttattgctagcgtagagaaatatatacgatttctgtgttgatcatgtactacagctttgatgaatttattagctctaataactcttctgtggattctttagaattttctatatatactatactattatgacatctttgaataaagagagtcccattttttccgtttctgttggatgacttttctttttcttacttgattgctgtctagaatgtccagtattatgctgaacggaagtagtgagagcagcattcttgtctcatgcatgatcgtagcgggaaaactttcagtcagtaaacagtcatttactgttgagtaagatgttagctgtgcgctttatcatatatgtcctttatcattttgaagaagttcccttcctttcctcatttgttgagtgtttttatcttaaaagattattactattttttcagatgctttttctgcatgaattgaaatcattctgggatttttccccttcattctattaatatgattacattgtattacattgattttcatgtgttgaaccaccattgtattcttaggctaaagcccacttggtagtggtggataatccttttaatatgctactggatccagtttgctaatattttgttcaggattttttttacatctatattcataaggtatattgagccatggtttccttttcttgcagtgtctttgtctgactttggtatcagggtaattctggcctcatagaatgaattagaagtccggggatggtggcttaacgcctgtaatcccagcattttgggaggccaaggtgggcagatcacgaggtcaggagatctagaccatcctgaccaacatggtgaaactgcatctaaaataaaaaaattagctgggcatggtggcacatgcctgtaatcccaggtactcgggaggctaaggcaggagaattgcttgaaccagggagtcggaggttgcggtgagctgagatcgcaccactgcactccagcctagcgacagagcaagactctgtctcaaaaaaaaggaatgaattagaaagtgttccctcctcttacctatttttttttaataacatcttgagaaggatgaatgttcattcttatttaaatattgtataggtcactaattaagccatcttgttttgggttcttctttattgggaggttttttgattagtgactcaatttcattacttattataggtctattcatatgttttatttcctcgagtcagttgggaaatttgtgtgtttctaggaatttgtccatttaacataggttatctaacttgttagcattcagttgtttacaatattctcttataacccatactatttttttgtatgatcagtaataatattcccactttcatttcagacttataaagtcttctttttccttaggtttttcaattgtattgatgttttcaaacaaccaacttgctttaattgatttttctctgtttttctattctcgatttcatgtatagccactctaatttttatcacatccatccttctgccagctcttttactagttccataaggtataaagttaggttactgatttgaaatctttttcttaatataggcattttacctataaatttctctctgaggacttcattcactgtatcccataacgttgcatgtttgttttcattagtttcagagcatttcctgatttcccttttggttcttctttgagtcattgattgttttacagtgtattttgaatttccacatatttgaattttctagtttttcttttactgatttttagttatattccatttggttagagaagatactttatgtgctttcagtcttttaaaatttattaagacttttttgtggtttaatatccattctgtcttggagaatgttccatgtgcatttgagaataatatgtattctgctgttgggtggcatattcagtatgtgtcttaggtctaagtggtttatatagtgttatttaacttctctatttccttattttctgtccagttctatccattattgaaagtggggtattgaagtctccaacattattacacatctatttttcccttcagttttgtgttctttcttcatatattaatattttgtggctctgatgctatatttgaatctctttataggtgtggtatcttcttgctagattgactgtttgatcattataaaaatccttctttgtctcttgtgatagttcctaaagtcttttgtttttttgtttgtttgtttgtttgtttctgattttaccacagccaccctactatttgcatggaatatatttttccttccttccaccttcaacttgtttccttggatctaaagtaattttcttgtagacagcttataaatggactcatttggtttattcgaatccattctgataatgcttgccttttaatgaatgcatttaatccatttacattaaagtacttactgataaagaaggatttctgccattttgctatttgttttctattatgtctgtatcttttttgtcctgggttcctccactgctgcctttttgttgttgttgttgttgtttttattgttgttgttggtttgatttttttgcattgtaccatttcaactcctttctcatttccttttttgtacatgttttagttattaatggttaccttggggattaaattaacatcttgcatgtacaacagcctagtttgaagtaataccaacttagcttcaataatatctcaaaactatgttcccgtacatctccctctctccctttttatgttgttgttatgacaaattacatctttatacattgtgtaactgttaacatagatatataattactgttttatgcacttgtcttttgagtcatatagggaaaaaaaggcagatttctgaaccaaaaatactgctggcttttatatttacctatgtaattacttttatcagtgttctttattttcttacatgggtttgagttattgcctcttgttttttcaggctgaagaacttcctttagcatttctggtagttcaggtctacttgtgacaaattccctcaactttttgtttatctggaaattcattaatttcttttttgtttttgaaggataatttttctagatatttcagcacttgaaatatgtcatcccactgttctctggcctccatggtttcctatgaaaagttggctgtcagtcttacttgggatctcttgtatgtgaggagtcacatacatctcttgctgctttcaagattctcttcgtttttttgacagtttgaacatgatgtgtctctgtgtgcatcttttaaaatttatcctacttggagtttcttggaagaaagactcttggctttctcagatttggaaagtttgtaaccatgatttcttcatatattctcttttctctctccttgcctttggacttccatcatacagacaggcgttggtatttatgatgttgttcccataagtctttaaactgggtctatttttttttcattcttttttcctatttcttggattccatagttaatgaaatcactcatgtcgaatagtcacaaactgttaatttgttgagttttacaggacaaaaatctaacaattgttagttacttgattttgtacactatattagtcagcatagcttaaatcatcacagtagaggattaaaaacaaaacatgtaccaagtgttggctcttaaatcttctgttcagaaatgacacaaatcacttcccctcatattttataggccaaagtaaatcatgtggccacacctaattttaagaaggcaggaaactgcagttctgccgtctgtccagatacgaaaaacattaacatttacagtgtgtgttcccttccctactccatccccaatccattccttagcattcattccattatttctacgtgcagacagaggttactgtgttagtctctttaactctaattttcagttgcttagagccttaaatattagagtttgattatcagctcccttactttcttagctttgtgatcaagagcaaagttctcaatatttgtacgtttcagttttctctctgaaaaagtggagataattcctgtctcaaaagattacaaatgattggttgagaggatgtgtatagaacgttttgtacactgtttcatacatagtaaatgctctattcctattctcctggcattcagtgctttcataatctggcttcaacttattcttctagcctcatcttctgtgactctcttccagtcatctgatgctgtaccttatcaaattatagttgaattctaagtaataatattttttatgagaaagtcagaatttttttgttactgtaattttttaaagtttgctctattttagtatgtttggaagacaggatggaaactttcctgcgagatgtatctctaattttataatggaagtcatgaagaaattagaatttacttaaatttgctttaaagttcttgtaatactttagttgtaataaatgagaatattcatataaagaaaaacacggtttccagttttaagataggtaatgtggtttcaattctttctcttgataatcaccaacagaaaaaaagctgaaataaaattcccatctttaatttaaactagaggtatctccaacccttgagctaaaaatccaaagagaaagataaataactaaggaagagcatcaaacttgagcgcttaagaacctacaggatactgataaaaagcaccttgttttacctgcaaactcagaaaggcttagagcttagaaggactggtactacagaatataggagtgaggcaggggccatcaacatagagattgcttgaaaacactgaataaggattcctatgttcccacctcacaggaaatatactgtctggtttaacaatatgtattatatttaacagaagagtgagatgctaaagttgtcatagtgcctctttaccctgcttggctccagacttctgtctttcacgctttgatatcccaggcaggtttgagggatccttcctggagaaatggaaccactgaagaaaaactgctcaacaggtactagtatttgaagacctcaaaaaagtgctggctggccactaccctgctgaagtccaccagttgacagcctgcagacacgtagtcacctttttattgttaacctctaaaataagaacaaaggactaaacattgttagccattttaggaaagtttccagtgtaacttagaaacacataccagaaaaaaggaacttaaagtaaacagatacttgaaggaatgaaaacagtttgaggaaataattaacaaccttagacagattttggctaatcaaacaaggtaggatggtttaagaaaacggggggagtggatgagaaaattctcagaatgaaaagtacaatagtagaaatatattcagtaaaagcattgaaagaaacagttgaggaactttccctggatatagaataaaagacaagaataagagagaaaagagaaaattagagtttaatatgaggtttaatatctaactgactaggagttgtagaaagagagaacagggaatggagaagcttattattatattaaggaaacaaaacatgtaaatttcctagagtttaaactaaatacatcagtagattgaacaggtctaccaggtgctcagtgcaatgataaacattcacatacttgtagaaaaattaattattttgaaatttcagaacccatcggatatataaaaagaagatcctaggtacttcagaggaaaaagagctagtctgtgaataggaatgtcattgaactccacagccacacttgagaatctaaaaggacatgtccccagtgtacttatctcccagattcaaaagttgtcaacatccccctctccccatgcatgcatactttttaattattaaagcaactttcatatactatatcattcaaccctaaatgcttctgttttgtctgtaacaggtagacattttaaggaaaccaaaccacaatattattacccaacagaattaatagtttattagtgtcatcaaatactcagtctgtgttcagttttcccattttaactcagagctgttattttaggagttggtctgttcaaatcaggacatacgtcttttttgtttgttttcctttttatctttattttatatatatatatatttttattatactttaagttctagggtacatgtgcacaatgtgcaggtttgttacatatgtatacatgtgctgtgttggtgttctgcacccattaactcgtcatttacattaggtatatctcctaatgctatccctccctgctgcccccaccccacaacaggacctgatgtgtgatggtccctttcctgtgtccaagtgttctcattgttcaattcccacctatgagtgagaacatgcggtgtttggttttttgtccttgcgacagtttgctgagaatgatggtttccagcttcatctatgtccctacaaaggacatgaactcatccttttatatggctgcatagtattccatggtgtatatgtgccacattttcttaatccagtctatcattgttgaacatttgggttggttccaagtctttgctattgtgagtagtgccgcaataaacatacatgcgcatgtgtctttatagcagcatgatttatattcctttgggtatatacctagtaatgggattgctgggtcaaatggtatttctagttctagatccctaaggaatcgccacactgtcttccacaatagttgaactagtttgcagtcccaccaacaatgtaaaagtgttcctatttcttcacatcctctccagcacctgttgtttcctgactttttaatgatcaccattctaactggtgtgagatggtatctcattgtggttttgatttgcatttctctgatggccagtgatgatgagcattttttcatgtgtctgttaaagagcttctgcgcagcaaaagaaactaccatcagagtgaagaggcaacctacagaatgggagaacatttttgcaatctactcatctgacaaagggctaatatccagcatctacaaaggactcaaacaaatttacaagaaaaaaacaaccccatcaaaaagtgggcaaaggatatgaacagacacttctcaaaagaagacatatgtctttttaagtttccactgaaaggagtctacctctgtgttgttttctgtcttaagctttctagccctatttgaattttaacttctgtatatatattactttggaaaataaaatttaactttaaaaccagatatattaatacatcgaagacatctcagtaaatcatcacagactgtgtgttcagcagtttaaatgtgactcctataaactaattactttcatgtcctttttacaggctgtcacatcagtcagacatgttagttgaacacgaacctgtatggttaaacattagctagtttagtcatttagacttagaaggaattaagtaagtactccagttcatagtagtagcaggatagaatggtaataaatcaccacaaaactttataagaaaaatagtctgtaacaaaaaaataagcaaaaataagtaagaaagaaaactaaaaaaatgagcatcaaaatatatttcccaaagccaggaactttgaaagctattggacttgtttgcctctttgtgcatattttaatagtatcgacaaattataggaatgtacttgactggaaagggagagatgacatcagcaggctaattgttgccacaagtgatagctgatggtgagagacagataactgttaaattccagcacaggcactgaagaagatactggtctaccatgccatgtggagataaagaatacaaaacaacctgtagtcctttgaagggtcgtgtgtgacagttcagttaagttggcattgacccagcactctactgcagctatttgatgccagggatttaaaattttaggtatttagctacttattactaagtaacttgtgaaacatctcctaattgcacccttgaatttcaccttaattctgattcacacccaaagaataggaatgaaggataaggtgtggagtaagtaaagatgaagccacacgatttggatcactgggacagatactgtatagaatgatacttttttccatagttgtccaccttagaaagggccctcaggaattttaaacaaaatgcctgttggttctctttagagttagttcacttttatttcaagtgggtttttttctcagattctctgctcttcttcccaccctcctaacacaaattacattggtcaaacatttatttccaattgataagtagataatgtctgctataatagaatttaagtctgtttttcatttgagaatctgaaggatgaatacctgatttgtaagttttatttcatttactttatttgattgtatgtgtattagccacagaatggaggcaaattcagcatctttctttaactctatgctgtttgttttagaggaagtccacaaatgaaggggacaccccattttaaggaagaacagtgtgctccagcattaaatttggagatgaggaaaatactggatttacaagcacccatcatgaggtacagtactttggttaaatttgacattgtgtgatgacagtagacaatgtagttcgtaaatcccatgaccaacaggaaagttagtttaatttcttttaattcaagataacttcttagttctggaaatgcttgattaacccttataagacaatggaagttttacagatggcacttaatacttaaattattataataaaattgaatataccaactataatcttattttgaaatttatattttataaggtctagaattgtttgattgagtgataacagtccatatttcccaaaacaatactgatgaaagcacacaagttgaggaaaagagaaagtgcctttgtttccaaagttgccataagcttctgggaagtttatatacacttggaagaaagttacactttttcatccaagtatgaataaaggttttatgacaaagtggccagaaataccagaataccaaaaatctattttatacccattggtagaaaaaatcttacctacaatttggctttatttctttaattgttgttccactattgatgttttagttgtcacttagtttagctgcatatcttttccattgtgtagatataagaaaatttatttaaacgatacgcagctgtaaaaacattgaggacattctttatggaaaaaaatctttccaaatatgttgttgggtgaaaaaagcaaaatgcttatgttgctaatgtttgtttttaaaagggagatgaggtatctccatcttgtttaaaagagagagcatgtatttttctggaagaatacataagaaactggggatgagaactgagtagctatgggacaggtttgggggaaaagctttttattgtgtactcttttttaatattgaactatgtaaatgtattgaattatatgaatgtcatgctacttttaaaaaaatccctctgactcacagttctaagtaaaggtttatttcaccatttctcttgttagagtactgtacagaatgatactgaaacattaaaactatgcaagtggctgggtattgtcttgccttgtttggtccatccccttcatatcttattctcatagaaaagaacacaattattatttgcttaaatgtaatcagtgttacagaagattgagttcaaagttactcatcgccttggtcacaaggttattcatcacttcacattttatttatttcagcatgggaatcgttttcaagaaagtaacttgatacataaggaattctgagtgtctgtaggtaccaagaaaaggtggaattgtacaggcttggctttctacctccacctggtgggaaaccttgtatggtgcatggaaatagaatagaaaaagagccaaaaagaaaaaaaaacaattctgccatcttgtccaagtttaacctgtcaggtgctaggttttaatctatgaatttaggtggttggaaatctgtaaggtttctctcaaaactccagtgaaataactgcatttcagaacaaagttatcagcacctgaaacacataactgctggaaatttgaaatttgctatagattttaaatcgagtgagaagacatgaaacttagatttttataaccaattattttccctcctgtcaccacaaatataagtcagataaggctaggatattggttatgctgttgcttataggggtaagagtactatctcatcttttatttttgatttgaagaaaaaatattaatgttaagcatctaacttttgttattaattgaggatagagaatgtttagaaggtaaaaacataattttaatgagagtttcccctcccctcccttcccctcccctcccatccccttccctacctctctccccactcctccgacagggtctcaccttgtcacccaggctgaagtgcagtggcacaatcacagctaattgcagcggcatgatcacagctcactgcagcctcagcctcctgggctccagtgatctcacctcagcctatcaagtagctgggactacaggcacacgtcacagcacgctaattttttgtactttattgtagagacaaggtttcaccatgttgttgaggctggtctcaaactcctaagctcaagcgatctcccctccttggcctctcaaagtgctgggattgcaggtgttgagccaccacacccagccaagatcctaaatttaaacatacatttaacacacacgcacacctgggataccacatagctctcataaaattaatgaagtcaatgattgaagaggctctctaaggatataacttagagtgtatttacctaaatttttaaatgtactcattaacagttgtgatattaaaaatatttcagaaccaggctgggcacggtggctcatgcctataatcccagcactttgggaggccaaggggacagaagggcagatcatgaggtcaggagtttgagaccagcctagccaacatagtgaaaccctgtctctactaaaaatataaaaattagctgggtgtggtggcacacgcctgtactcccagctactcaggaggctgaggcacaataattgcttgaacccgggaggcagaggttgcagtgagctgagattgtgccactgcactccagccagggcaacagagactgtgtctcaaaagaaacaaaaatttaagaaccaatacagcatgaaaagacatgggttattagttatcgaacagggttctgacatcgccctactacgccaataatgaatccttcagttggccagatttttctgagggaggggagtcagttgtagcaaacacttaggtgacttggggcaaggtctatttaccaacatttatagaattattagtattttaacaactgacaccagcttttttatttctaaatttttttagaggtggtagtctcactgtgctgctcagttggtctcgagctcctgggctcaagcattcctcctgcctcagcctcctagtagctgggattataggcacaagccaccacgcctggctcagcctttgttttaacaagtttgtccactttcaattaaatgagaaggatatatctatctcttcctgtagattatttattatgtctgtcacagtttttaaaaagcctatctgctaattccaatatcaagattatctataagtctatttatattgatggatttttctcttgactctaggttacattttcctgtttattcacacatctggccagtcatttgtttgttgcagcatcactgattatcatgttatagagattatgaactcttaattttgtcagacgattgttgagttttgtctagcaggtagtcagattactggaggataactctgttgtatacagtgattttctagggagatagggttaggggagagggagaatgtagtttggaataaacgatgctgactccttccaaggaaaatcactggtaaaccagtgactactctgctaaattgcctctcttgacattgtcaacttgaagtaatcaaaaggatcagattctggaattaatgcaagcagaaagctgaccaatccgggagaacagacttcagaaaatggggtcagtgttccaaagttaaaagttcagttcttgcaggccaggcacagtagctcacacctataatcccagcacactgggaggccgaggcgggtggatcacctgaggtcaggagttcaaaaccagcctggccaacatggtgaaaccttgtctctaccacaaacagaaaaattagctgggcgtggtggcgcatgcctgtcatcgcagctactcaggaggctgaggcaggagaatcccgggaggcggaggtttcagtgagctgagatcgcgccactgcactctagcctgggcagcagagtaagagactgtttaaaaataaaaaaaaaaaaagttcagccaggcgcagtggctcacgcctgtaatcccagcactttggaggccaaggtgggtcgatcacctgaggtcaggagttcaagacgagcctggccaacacggcgaaaccttgtctctactaaaaatacaaaaattagctgggcatggtggcgtgcgcctgtaatcccagctactagggaggctgaggcaggagaatcacttgaacctgggaggcagaggttgcagtgagctgagatggtaccactgcactccagcttgggcaacagagcaagactccgtctcaaaaaaaaaaaaaaaaaaaaaaaaaaagttcagttcttgcttatataggtggaaaataaagtttagtaggattataatgttttctatacaaggctggtttatgagttacaatttagttacagtttgttttctttatggcttgtctttacagctagttttcatttccaatttaaaaagagtgtatttaacattccattttaagacaatgtgatagccatgaagtctttgtgtaagaaagataagagggaagttaatctaccatgaagatcaacagtgaagagggaaggggtcttccctggagccctttagtcatttacagcatttataaaacaatacagtaaggaagaaagctaatctataatcagagaaagaaagatgacagctgcctagattatagctgcctattgtgtgactcaggccccataattacatttctttaaggctcaaaagtaattcagatttccaacagcttagattttgaattacatattttcatagcatatagtagtgcatctaaaacataaactttttatactctacccaccaaatgatacacatagattttatcactgaaatataaatttgaaattaatatataatgctttaaaaagtgaaatgtctaaaaactgggaattttaattgattacaaatggctgtgaagttcaagaaatagagctgggtaaagaaacatctgtttctgatctttttcagtatttttatagttggggaaaaaacagcaaattctacattagctgaaatctttggagtatgagtaattgaagtcaactttccaaagaattaaaggtttagtttaagaattaaaatactaaaagacatttttttcatcattatggattaaaatatttcagaaatatgctcttaagtatgaaaaggaatttaatagtatttaatagggtatatataatatacacataacattttttgtttttccttatatagtatttgatactttgaacactctttcttaaattcatcttacttccttggctttcttgatatcagtttctactggtttccctggttgtctttttctttgtgccagtacctttgcggtctcatttatgggttcctctttcctctaaccctttccctcttcttgcctcctttgcacaaatatttagtgacagatttaactaacactgcccttggggctgtgcatacagaggtgagcaaaacaggctatttccccattaaagaagtaaatgctgaatatcttcataaatattgataagtgatgagatcatgctatgtaactatttttgatttcttgcctgagaagtcctctgaagacggagaatattttattcatcctcgaatatccagcacacagtatagcacctgtcacagaggataggctcagtaaatgtttgtagaaggaatgaacaatgtgagacttgctaatacctaagaaatatattggcctggaactatactccaatacagtagccactagtcacacatgaatttatttaaatttacattaatgaaaagtaaataaaatttcagttattttattgcactagccatatttcaagtgtatagtcaccacatacagctcatagctactgtttacagatagcacagatatagaacatttccatcattattcaaagttttattggacaagtgccagagcattgttacctctacacttaatggctctagattgtcatactgttattagttgggtttattcattttatggtttctctacctctttttctttctttctgctatcacttctgtttccatcttctaatttgctgtttcaatatttgtagtttttaactagttttatcagttatcaagtttgtgactgtgagtgcccatagtctttcatttctttcaggatttctgattctagattgaaatatacatagataaagttgcagataaatggagatgttttgtaaatggtttcatgatcatttttgcatgagtattctctaaagcagttttaatattcatacacattgctttcccagtatgctctcttaaaaattaattgattctacctacagtttgcagtctgtgttggaagatctcctggttgctacttctgatggacttcttcatcttattcactgggaaggaatgacaaatggaaggaaagccattaatctttgcacagtacccttttcagtagacctgcagtcatctagaggtagctatactttctacatgaggttgaaccagttgtttaatgtttgatgtctagttaggtatcttctatggatgaacacttctttggaattacttatgcaaggggagaggtgggcagagtatgagaggcggggtgagagaggcatttaataggaaaggacagtttaattatttagggttgttaggtcattatttttacccttttaaacttacaggtttttctggcaaaaagtgagagagtaatttattatattcttaatcctatttcatgtgcttatttttttcatcagtaggttcattcctgggcttcacagacgtacacatcagagacatggaatactgtgccacacttgatgggtttgctgttgtatttaatgatggtaaagttggatttattacaccagtgtcaagtagatttactgcagaggtatgacttatttactttgaagggttttttgttattgtgtacttattttattctttgttatcaaattcttctctattttcatcattcatgtaagattttaagggttgttaattttttaatcaaaccaaacatataaatagtataagtagacaaaattctcttggacatgttaaagaaaaataatgattcctgttctcctccctgctctcctcatgcctaattttccacttttggaggcaactacttgttattcctttactggttattttgatttttaatctccactactctgaatatttcctttaatttttagttcttaggctgtgtttattgacttcttactgttgaaagtgaccatttacttccctcttccctgcttccaccatacttatattcttctcatgttcccattatagttattgtgattttgattaggttactattaattgtttatatttttatcaatatgtaagccccattagtaccgaaaccatgtggtactgacgcagaagtttttgctccttagtttagctaaaagcaggttcttgtcacacagccaggaaagattaggcatgcagacatactgaaaggtgaggagagcagaatttattaaaagcaagctctcagcaaataaagatgatgtcctgctaacaggctcccacttcacagattgattaccaaaccccagcacacacgcgcgtgcacacacacacgctgaagagccccagggtcctacccgctgaacaaggcgtgaacttaaccccattctcctagtgcgcttgtgggcattattcagaaagaatcactcaggaaacggcaaacgggcagttatttatccctctggatcaccagtttcatctgggacaaggagtcccatctttcagccttcaggcactttttgggcttgaaagtgggttttcactggggacccttggccaactcctgtctctgtcagtataattatttttcctttactgcagatttttcctcctgctaggaattaatgattgccttgttctttacatttgcttaatttttgtgtacttatctcttactcaacccaaactgtcagttgtgtaaatatcctcccagctttttcaaacatattagctgttctgttcatttcatcttttttgttttcttttttttttttttgagatggaattttgctcttgttgtccagactggagtgcagtggcacgatctcggctcaccacaacctccgcctctcgggttcaagcgattctcctgcttcagcctcccgagttgctgggattacaggcatgcaccaccacgcccgcctaattttgtgtctttagtagagacggggtttctccctgttggtcaggctggtcttgacctaccaacctcaggtgatccacccacctcagcctcccaatgtgctgggattacaggcgtcagccatggtgcccagcccatttcatcttcttcttctttttttttttttttccacagtaccacaaaacaatttaatggaggaagagatttttttttttttttttttaccccgaggaactatatcacttaaggatggcttacagaaggaatgagcttgcaaaaactataagagagagagagtgtgtgtgtgtgtgtgtgtgtgtgtgtgtgtgtacctatgcagtgtatgtgtgggtctataggtatgtatcacacgtccacatgcatgttcatagcctccatgcacatgtaaatatttcttcacataaacttttctgactttaatactagaaagaacttacactggttttctgaagcccactgtgatatcagagatccctttctaaatctatctttttatttacttttttaagttctagggtacatgtgcacagcgtgcaggtttgttacatatgtacacatgtgccatgttggtgttctgcacccattaactcgtcatttacattaggtatatctcctaatgctatccctccccccctcgccccaccccacgacaggccctggtgtgtgatgttccccaccttgtgtccaagtgttctcattgttcaattcccacctatgaatcagaacatacggtgtttggttttttgtccttgcaatagtttgctcagaatgatggtttccaacttcacccatgtgcctacaaaggacatgaactcatccttttttatggctgcatagtattccatggtgtatatgtgccacattttcttaatccagtctgtcattgatggacactgggcttggtaccaagtctttgctatttgaatagtgccacaataaacatacatgtgcgtgtgtctttatagcagcatgatttataatcctttgggtatatacccagtaatgggatggctggatcaaatgatatttctagttttagatccttgaagaatcgccacactgtcttccacaatggttgaactagtttacagtcccaccaacagtgtaaaagtattcctatttctccacatcctctccaggacctattgtttcctaagtttttaatgatcaccattttaactggtgtgagatggtatctcattgtggttttgatttgcatttctttgatggccagtgataatgagcattttttcatgtgtctgttggctgcataaatgtcttcttttgagaagtgtctgttcatagccttcgcccactttttgatggggtggtttgatttttttcttgtaaatttgtttaagttctttgtagtttctggatattagccctttgtcagatgggtagatggtaaaaattttttcccattctgtaggttgcctgttcactctgatggtagtttcttttgctgtgcagaagctctttagttgaattagatcccatttgtcaattttggcttttgttgccattgcttttggtgttttagtcatgaagtccttgcccatgcctatggcctgaatggtattgtctaggttttcttctagggtttttatggttttaggtccaacatttaagtctttaatccatcttgaattaatttttgtataaggtgtaaggaaaggatccagtttcagctttctacatatggctagcccgttttaccagcaccatttattaaatagagaatcctttccccgtttcttgtttttgtcaggtttgtcaaagatcagatggttgtagatgtgtggtattatttctgagggctctgttctgttccattggtctagatctctgttttggtaccagtaccatgctgttttggttactgtagccttgtagtatagtttgaagtcaggtagcgtgatgcctccagctttgttcttttggcttaggattgtcttcgcaatgcaggctgttttttggttccatatgaactttaaagtagttttttccaactctgtgaagaaagtcattggtaacttgatggggatggcattgaatctataaatgaccttgggcagtatggccattttcacaatattgattcttcctatccatgagcatggaaagttctttcatttgtttgtgtcctcttttatttcgttgagcagtggtttgtagttctccttgaagaggtccttcacatcccttgtaagttggattcctaggtattttattctctttgaagcaattgtgaatgggagttcactcatgatttggttctgtgtttgtctgttattggtgtataggaatgcttgtgatttttgcacattcattttgtatcctgagactttgctgaagttgcctatcagcttaaggagattttgcgctgagactatggagttttctagatatacaatcatgtcatctgcaaacagggacaatttgacttcctcttttcctaattgaataccctttatttctttcttctgcctgattgctctggccagaacttccaacactgtgttgaataggagtggtgagagaggacatccctgtcttgtgccagttttcaaagggaatgcttccagtttttgcccattcagtatgatatttgtgggtttgtcataagtagctcttattattttgagatacgtcccatcaatacctagtttattgagactttttagcaggaaggactgttgaattttgtcaaaggccttttctgcatctattgagataatcatgtggtttttgtctttggttctgtttatatgctgtattaccgttattgattttcgtatcttgaaccagccttgcatcccagggatgaagccaacttgatagtggtggataagctttttgatgtgctgctggattcggtttgccagtattttattgaggatttttgcatcattgttcataagggatattggtctaatattctctttttttgttgtgtctctgccaggctttgatatcaggatgatgcaggcctcataaaatgagttagggagggttccctctttttctattgattggaatagtttcagaaggaatggtaccagttcctctttgtacctctgatagaatttggctgtgaatctgtctcgtcctggactttttttggttagtaggctattaattattgcctcaatttcagagcctgttattggtctattcagggattcagcttcttcctggtttagtcttgggagggtgtatttgtccaggaatttatccatttcttctagagtttctagtttatttgcttagaggtgtttatagtattctctgatggtagtttgtatttctgtgggatcggtggtgatatcccctttatcattttttattgcgtctacttgattcttctctctttacttcttcattagtcttgctagtggtctatcaatttcgtcagtcttttcaaaaaaccagctcctgcattcattgatttttttgatggtttttttatgtctctatctccttcagttctgctctgatcttagttatttcttaccttctgctagcttttgaatgtgtctgctcctgcttctctagttcttttaattgtgatgttagggtgtcaattttagatctttcgtgctttctgttgtgggcatttaatcctataaatttccctctacacactgctttaaatatgtcccagagattctggtatgttgtgtctttgttctcgttggtttcaaagaacatctttatttctgccttcatttcgttatgtacccagtagtcattcaggagcaggttgttcagtttcatgtagttgagtggttttgagtgagtttcttaatcctgagttctagtttgattgcactgtggtctgagagacagttggttataatttctggttttttacatttgctgaggggtacttccaactatgtggtcaattttggaataagtgtgatgtggtgctgagaagaatgtatattctgttgatttggggtggagagttctgtagatgtctattaggaccacttggtgcagagctgagttcaattcctggatacccttgttaactttctgtctctttgatctgtctaatgtttacggtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttagcattatgcaatggccttctttgtctctattgatctttgttggtttaaagtctgttttatcagatactaggattgcaacccctgcttttttttgttttccatttgcttggttgatcttcctccatccctttattttgagcctatgtgtgtctctgcacgtaaggtaggtctccagaatacagcacaatgatgggtcttgacactttatccaatttgccagtctgtgtcttttaatcggagcatttagtccatttacatttaaggttactattgttatgtgtgaatttgatcctgtcattatgatgttagctggttattttgcacattagttgatgcagtttcttcctagcatcgatggtctttacaatttggcatgtttttgcagtggctggtaccagttgttcctttccatatttagtgcttccttcaggagctcttgtaaggcaggcttggtggtgacaaaatctctcagcatttgcttgtctgtaaaggattttatttctccttcacttacgaagcttagtttggctggatatgaaattctgggttgaaaattcttttctataagaatgttgaatattggcccccactatcttctggcttgtagagtttctgcttagagatctgctgttagtctgataggcttccctttgtgggtaacccgacctttctctctggctgcccttaacattttttccttcatttcaactttggtgagtctgacaattatgtgtcttggagttgctcttctcgaggagtatctttgtggcgttccctgtatttcctgaatttgaatgttggtctgccttgctaggttggggaagttctcctggataacatcctgcagagtgttttccaacttggttccattctccccgtcactttcaggtacagcagtcagacgtagatttcatcttttcacacagtcccatttttctgggaggctttgttcatttctttttactctttttttctctaaacttctcttctcacttcatttcattcatttgatcttcaatcattcgatcaaatcggctactgaagcttgtgcaggcatcacatagttctcgtgcgatggttttcagctccatcacgtcattttaggtccttgctacgctgtttattctagttagccatttgtctaatcttttttcaagattttttgcttctttgcaatgggttcgagcatccttctttagcttggagaagtttgttattactgatcgtctgaagccttcttctctcaactcatcaaagtcattctccatcgagctttgttccattgctggcaaggagctgcgttcctttggaggtgaagaggtgctctgatttttagaattttagcttttctgctctggtttctccccatctttggttttatctgcctttagtctttgatgatgctgacatacatatggggttttggtgtggatgtcctttctgtttgttagttttccttctaacagtcaggaccctcagctgtaggtctgttggagtttgctggaggtccactccagaccctgtttgcctgggtatcactagcggaggctgcagaacagcacatattgcagaacggcaaatgttgctgcctgatccttcttctggaaggttcatcttagaggggcacccagctggattgaggtgtcagttggcccctaatgggaggtgtctcccagttaggctacttatgggtcagggacccacttgaggaggcagtctgtctgttctcagacctcagactccgtgctgggcaaaccactactctcttcaaagctgttagacagggacatttacgtctgcagaactgtctgctgccttttgttcagctataccctgcccccagaggtggagtctacagaggcaggcaggcctccttgagctgcggtgggctccacccacttggagcttccctgccactttgtttacctattcaagccttagcaatggtagacacccctcccccagcttcgctgccatcttgcagttcaatctgagttgctgtgctagcagtgagcaaggctccatgggcatgggaccctccaagccaggcgcaggatataatctcctggtgtgctgtttgctaagaccattggaaaagcgcagtattagggtgggagtgtcccgattttccatgtaccatctgtcatggcttcctttggctatgaaaaggaattccccgaccccttgcacttcccgggtgaggtgatgccctgtcctccttgggctcacactccatgggctgcacccactgtctgacaagccctagtgagatgaacctggtacttcagttggaaatgcagaaatcacccatcctctgcatcactcatgctgggagctgtacactggagctgttcctatttggccatcttggaacctcccatttcatcttcttaaagaaatttctctgggagccttctggcctgctccaaattagactgcttgcttactataatctttaacacagctgttttttggccttctgtcataattatcctgagattccctttactcttatttgtgtcggatcttttaatagctaatagctaattaatatatggatttggctgctgtgacagagacctaaaattaaaataatttattgaaaactgtgaattttggttcgtttggtttactatgtcctttaccataggatgagctgactgagttatttacttgggggtcctcctacctttagagccatacccttccctctgtccctcccttctgctcccctctcccctctctgtctccagtgttccttggaaaagagtcctgcagtcctttctagaggatatatacttggctaccccagtattctgggatttgagttacagaagagttaagctagcgggtccaaattcaagatgtgaacctttattttctatccctgttttcagtgtggtccataggcctctggtggaggtggtaggggtgggggtgttttgttttgtttttctccaaagaaaaatatccagttttccgtaggagtggaggtagggtatttattggctgctcagctttggggaagtgctctgggaggacctggttgcttctttaagtaggttttgaaccacttctactacatttaatttagcctttcaaagacccctgaattcccaagcctttcgtgtaccctacaacttaaatttagacgtttctcagcattcttccctgtcagttaaggattctactcattgatatgctttccagcttctaaaattttctaatgccgcctcctattatttttgtctttgctgctttatgtttttttaaacaaaaactcttttctcttctagaagttacagttttaggagtccaagaagctaaatatttatattcagtcatctctctttaactggaaaggaatttaagtttttaatggccttttttaattgttgtcattctgtttggtatcaactttaatattcctatctactatcttccgttatcaactttattcagatagtaaggtactaaataatgtatttgtgatcacctgtgtcagaacataaataagaataaaaataaacttttgatgaattagaaaaaactcttttttttttcctataaggtgcatatatatttgtaattatctttgggacttaaatgtttagactggaaataaaaatattagagctgaaaaagtgattgactcttttccaagtactttagagttagtacaaaatatattctcagtgtttattagtatgtaattaaataattttttctaataagttaaggatttaaaaactaatgaaaagcagatgggcattactaaataaggtatagatagaaaatacaaattacaagaaaacagtacctatgtattaatggtaatagggaaataactaaatgacatttaacagatgtgttaaaatgtgattatgtcagtcctctgtggagactcattcagtaggactagattattaggacagaacctcctgaggactaaaagagctggagaaaaaatatattttttaatatgcttgaagcccttagagagcaaacaagacagtaaagagttgccagactaagggaggccagcaatccagtgagctaagcccaatatttaagcctacaatgaacatgaacaaattaggctatatgcaacaacacagatagatcttacagacatggtaagcaaaaaacagctagacacaaaggaatacatgctatgattccattttaggtaaaaattaaagggcaaataatgtaggcatttctaaattagagtatatatgggtgcatgtttaagtggtaatgatttaaaagaaagaaggaggtgattaccatgtaaatctggatattttttgttgtaggggtgtgaggatacagtgattgggaagggcactattgggagacttttgggtactcatgattcttggcctgagtagcaattccacaagtgtttgctttgtgatattgagatgtacatttcattttcatgtattctttattataattcatgacagaaaagtttaaaaaatttgaatattcttcttctatataacttgaagaaaaagccaaaattcttatggtggccttcaaagccctaattatctgacctcctgttacatctcttaccacatatactactttcctttcacaacccatccacttcactctatccacacaggcttctttgctggtctttgagcatgccagaaatgctcctacattagggcttttacacttgttttatttctttgaggactttcctcaaaaggcatccttatagggaaacctgtttaatattacatccttcccctgtactccctcttcaccagcattgcttaattttttttgtatagtattttttaacctccagtattcaatatacttttttaacttgtctgtctcttgactcaaatgtaaagcaagcatacaagtagagattttggtgtgctagtatagcctcagcacctagagcagtgcctggtgaatggtaaccacctagaaaatacttattgtaggactgaatttcagtctaagcagcagttcagagaaataatgctcactgctgtctttaccatttgtgacataaaatgtccagttttattattaaaattaaaagatacaattcctactaaagcaaagattccgtgtttagatagtagattatatagctgattgtggaattaaatgaaatctgtaggattctagttcatatagttgtgattatattgtatctttaatgtttactattaggatcatccaaaaataaagtgctatattatagtgtgccactttttctgctaactgaactaatgattatgacctttgccttggaatttatcatctaaaatgtctgtgatttgacagataggagcaaacaactgagctgaatctattctctatatatggagatggcatatggaaatagcatatatgcttactaataatgtcatttatttattgaatgcttgttgaatggtaggcattgtcctaaatagtttacatgtgtatcttcatttaatctttgaaacaccctgagaggtaaatacgataagaaaactgaagcttaaaaaagatcaaatacttattttgaggagtgaaagcagtcctgagctgtcaggcttccagataccatgctattaaccattacactataaagaagggaattgtagagaatagtaagcaattttgcttctaaagaataaaccaaacagaatgtactacttttcactgactgagaagttaaatactatgtgctaggtgatgagaataattacagtgagcaagttagatgctgtttccgctgtcaaaatgtttacattctaacaagaaagtcatctttatttgaatttggagatgaatttccatattttagtgttttttaaataaattaactagcactggactgagctgagtatttatcagaccaattcatgagaagtttgaggttttaagggagactatttggtagtattttaagggagactattgtggtagtcctggtgggatattttcctctgcagatgaaaccaaataaagcattatgaaattgtatgtttattgaaggagaattatattgactacggtaaatttggagaaacactttttaagccttaactatttttctttattatagcagcttcatggagtttggccacaagatgttgttgacggaacgtgtgtagcagtaaataacaagtatcgactaatggcatttggctgtgtgaggtataattgatgtaggcttttgcatttttaagagttgttgcaaaaaatactggtttttttttttgtaaacataagatgttcctaacatacttataaactgcatcatgctatcataatttatcagtcaaccttaatatgaaatgtaaaagtattttattagattgaaacaaacaaaagtaaagggcagattttggaggttgagcatgttaatttgtaaaagttagcgttttcttcagtggtggaaaattgagttacaagttaaacagaataaatcagttaaagtttaggttctttattgtttaaaagaggatttggaagatttttttaaatcttaatttttaagacatcagcattcatgacgccttcaaattagtgagtgtgctttagttaacaagcaaatttaaagtgcacatataaaaccagtttcttgccttagtttattaaatagagattttagaaaaaaattgaataaaattatttattcaacaagtatctgtatgcctatcacataccagccatagttctaagcacttgatacattagaaaacaaagatactgaacttggttgagcttaaattttagctcataaattttagctaaaataaaacgattatattagttgttataatgccttgcaatgtatatagtgctttttagttttctaaactctttcttaaataaaaaatcctatgttgccctcaaaatgagacttggttgttctatagaacatatatctagtatagtctccagccatatcatcaccacccaatttaagtatcaaagattttttttttttttttttgagatggagtctcgctctgttgcccaggctggagtgcagtggagcgatctcagctcactgcaagctccgtctcctgggttcacgccattctcctgcctcagcctcccgagtagctgggactgcaggcgcccaccaccatgcccagctaattttttttgtatttttttagtagagcaggcatttcaccgtgtttggccaggatggtcttgatctcctgaccttgtgatccgccttggcctcccacagtgctggattacaggcgtgagccaccgtgcccggccagatttttttattagtataaataattcacataaatcactttcattacactcttaataaactctttgtaaagtagggaatcctcatcctcaactttttctcaatacattgatcctcattgagcagttaaatgtagaaatacgagtaagtttaacttagtacaagagagaaggaaaagcttttttttaatgtttgtggattggattcagtcatattttgtttagaattttaaaatgtatgttcatgaatacatttcacctataattttcctctttactcttctgagtaaggttatggctgtctcataaagcaagttatgagaatccctcccttctttgtcttctctattcatctttgaatgtttggtagaatttgccaatgagaagccatctagacctagaattttcttattgtggatttttttggactactgattcaattcagtttttaaaaatatacatatatataatgtatatattttagatatatatatttaaatattataaatatatataatatatattttaaatatatatatatatttattttattttattttattttttgagacagtctcgctctgtcgccctggctagagtgcaagagcgtgatcttggctcaccgcaacctctgcctcctgggttcaagtgattctcctgtcttagcatcctgagtagctcggattgcaggcatgcaccaccatgcccggctaatttttgtatttttagtagaacggagtttcactgtgttggtcagtctggtctcaaactcctgacctcgtgatccatccacctcggcctcccaaagtgctgtgattacaggtgtgagccactgggcccggcccagttttaaaaatagatttaagaagattcagattttgtatctcttcctatgtcattttggcaagttgcattttttccaggaattggtttctttcttatacaccttcaaacttactggcataaagtttataataccctttttatttcacattgtgaaacaaaaatatgcatacaaagtagtacataatccagatattcatagttttaacgttgtagtagaaacacccatctcttcacaactggatcagtaaatagaacattactggtctccagtcacaaactgcctctgctacttcctagtcacaactcttattccctccttgactcacttagtaactggtcaacattgtgagattcatccatgtcatttaccagtagttgtaatcattttttaaattggtttataaataacgttccattgtctgaatatagcataatttatccactttgctgttgacatacttttgccttatttcttggtttctaaaaaaggagacattctcttgtataattggaatatctttatcacatgagataattaatgataaatccctaataggatctaatacccaatttatatgcaaattaacccagttgccaccagctaaatttcttctatagctcctttgttccaaacagaatcgatcaagattcattaataatatttggttattatttctctttagttaccttttaactacaatagtccttatgccacttattttcatgacattgactttttttgagtctgagtcgattctttatagaatatcctgcatcctagatttgccttattgtttcctcatgatggcatttaccttgtttatctgacacctgtcgtgactaacctggaagctagttcttgttgagcaatacagtcaagtgactagaaagcccacacatcaggcatggaaaagtatttagagaaaatacacagagacagaagcagtggcaagtgtgcagttccatttactgcatttggggccagcacaagggtgggtgttagaatccagaagaagtactcctccctaggctatgggcttataagctacatgattgggaagtactagcccttcccaggataatgtaggtagactcttggcctatagcttttcagtcacctcagttttcatcagctacgagactacaagttctcttctagcatgcccatgggttagggttaaagttttgtgattctagctgttgacataacaaaccagtgtctgctagtccagatctgccaacacttatcaggactaattaccttgaacactaggtgatagctggtgtccttagagttgtgtaagaagccagcttccttttaggatgccagtttgcagcagatcagtattttaacaaccttcctgttaacctaaatatttaaaggtattactagattctggttacacattttgtcatgggtgatgatatatatttcctatggtatcatttagtaataatgtcaagttgtttcagtattaatgacactaaatttgatcacttatggtgataatagtcatatctctcttatagagatttgctttggagttagtaagtcctgtctttttaatgaaaatatatttttctgttacattgggctggtgagaaatggaaggaaaagtagtttaaagaatacaagcactatagaatacctaaaagattgtcagacttttataagtagtaacttagcacctacttcttatatttaaaacatggactcctcactaacattttagagctcagcaacccagggttagcagttgacagttgtcagatgcaaagcaaaaacaaacacctgctacccacttagtgctgtctctcagcaagagttgatctatttgggcaggtagtctggaaagaaatctttttcagatatttggcttctgggtatgattgaatgacagatgacattttccctcccacctgatacagccaagaaaacggacaaaaatatgaaagagctgttttgaattcagaacacaaacataaggtaacaagggacagtgatttctgaaagatgagaaacaaaattatctctctgtaactgcccttagtttttattattttgagtgtttgtaggctgcagcacaggattggggagatacatcctgagctgagataagcacatggaaatcagagaatctgggaaaaccaaggcagctagagttcataatatagacaccaaagaggtggcacaaagagagaacttcagagagctgtagagggtctctcttgaatattaaactgagacatggaagatattagaaaaagactgaaattaaacttctagaggtgaaaactatgatgtctgagatgaaaaacatactgtatggaactaacaacagattagacattgcagaagagaagattaatgaacttgaaaaacagaaattatccaaaatggaacacagaaaaaaaagaaaacaaaaacagagtatcagtaagctgtgggacaactttaaggaggctactattgcaggtcttttagttagtcccagttctaatccttgagaagaggtaggacctggatgggaatggatcaaagctgctgtgaagaaaccatctgatttctcctaccaccaaaaaaaaaaaaaacaatctggtagtcataaaccagtgtcatcctattatgtgcaaaagcattcttatattaaaaagtgtctttaagaacatttgtttctctttctcactataaatgttgcataagtaatctaaaacaggagcctcattttcaaatgctgaatgtgcattaaatttttgaactgagaatataccatgagcagaaatgagacttttctgttatcctcgtagttcaattttgaaatgtggcttagacgtattatagagattttacttctggcttcaggcccttcagaaatttgacccttgtaaagatgttttaaattaagtaattatatataccatatacacaaaaaagcatatagattttaaaaataaaatgtttataaattaccatccaacataagaaataatacatcaccagtgctgatgaagcctcctgtttacccctcttctttgatactcccttctccaccagagtatcactaatctgaaatttgtatacattaactctttgttgtatttttaccacaaatatatttactattaatactgtatatctactatatatatatcaaatatgtatgtttatatttactatgcttttacacacacacatgttttatatcttaaacgtatatactgttgaccgttgaacagcccaggggttagaggtaccaaccccccaacacagttgaaaaatttacatataacttttgactcgcccaagacttttaactactaatagcatactgttgactggaaaccttactgacaatatagtcaattaacacatactttttattttatatatattaatattatatattgtattcttacaataaagtaagagaaaagattattaagaaaattataaggaagaaataatgtacttactattgattaagtggaagtggatcatcttaaaggtcttcattgtcaccgtgttcatgttgagtaggcttgaggaagaggcaaaggaggtatgtcaggtgtggcagaggcagaagaaaatacatgtataagtgggcccatgcagttcagatccatgttgttcaagggttaactgtattcgctatccatgtggctaaagttcattcattttcagtgctgtaaggtatagtattatattgctataccatatgtactatagccaaataaaagttcatttttttcctcatgttgctagataggctatttccttttttaaaaattatcacaatagtacaatggacattgtacatatctctagtaaacattagacaataatttctgggatatatctggaagtgaaattgctagattagaatatgcctttgttcaaatttatgagatgactgcaacttattgacaaagtggttttgttctagtttacactcccaccagcaaaacataagagttctataatgctttttctatttgtatttgtcttttttcactaaaagtttttcgttgttgttttcacagtggttctgtgcaggtctatacaatagataacagcactggagccatgctgctatctcataaattagagctaacagcaaaacagtatcctggtgagtctttttttttttttttttttttaacatttttaatgtactggtattgccatttgtagcagatgctgattttaagttaaacaatacatgtcatgctataggtcaaatattggggctctgggtgtgtaaactggctcaagtctggaaattgattgaggggccgtgattctgttttaataattcaaattagtattttgtccatttgacctagaagttttctgcttgtataaattaagtgggaatgcagtaggcttcctatcagtttcacttccaggaacaccataattaattagccaatgcccaagttctacacaagtcagactattctgattgctgctttgcttctgctgtccattacagtagctacgcccaccttacctttgatagttgagtgccgtcacttggcccctgctacctccggatccagttattcccattttgtatttaaattttgtagttgagtgactgaggttcccactgttagatctgacatacagagaagtgcaattatagggttcttcaaagatgtagctgctgcccttgtaaatctgttttgcaaggcatcagtcaagggtatatcttctggaccctcccagctgggatgagtaggtctaaagtgactaatccactccaccttctgaatctccctaagcctttggatcccttcctctacattaaaccaagggagatcaggcatttccagctcactcacagtgggccatcttttaatccatatttcagctaaccacgcaaatcaactattagaaccttttttaactccccgagctgcagctttaaatgcagaatccctacttagtgggcccaaatcaataaattcagcctgatccaactctgtgtaccttccatcattatcccacacccttaatatccattcccatgcctactctccagatttctatttatgtaaattagaaaactcaagcagttcccatagtgcacctcctcatgggtcatactctcaacctcacctctagaggcctgccaggactttattgataggtctagaagcaaacagaggtgttgggagtggctcctgaggagaatcaacattatcttgcctggcgactgcctcaggggagggcatcactgttgcctcaggcagcacagggtttataatcctcagacaaaggtggaagggctaatggcagcatgggtccaggaggggatgttgccactattggggatggggaaagctgtttcttctggcaaaaaaaaaggttcaccagagtttacaaactcagtgaatctagcttcatcagggtcctcccacacatcccctttccaagttgcagggtcccatttttttccaatcagtgccttcactttaacagtagacacctggtgaggctgtgcatgcaccttttgttgcagatcagccactcaaatgataagagtttgtctctgtgtttccacaattttagctctttctctataggagataagaccctcactcagggcaatcttagcagttttgaggctcagtatctgcttctgggagatggaatccctgagttcatcattttctttcatcaccttgttcactgaacttaggagcaaccaactagcttcattatgttccttgattctccacatatggtcaaaggtgttatgtatagagtcactaaactccttgcgtctcacaagcaatgaatcaggagtgccaaatgcatttattttgcataactctatataaacagttcacgtcaaggactgtcagtgcgtactattagaaatagagtccttagcattttggggtctaatgatattaggcagccaactctagaaaccccaaaaccaatgaaggaactccatccttaatattctgtacctctagaatcactcctggtaccaatatctgtattagtaaggttctctaggggacagaactaatagaatagatacatacatatttataaaggggagtttattaagtattaataaatgatcacatgatcacaaggtcccacaataggccatctgcaggctgaggaggaaggagagccagtccgagttccaaaactgaagaacttggagtctgatgtttgagggcaggaagcatccagcacacgagatgtaggctggggggctaggcccgtctctattttcacatttttctgcctgcttatattctagccgcactggcagctgattagattgtgcccacccagattaagggtgggtctgcctttcccagcccactgactcaaatgttaatctcctttggcagcaccctcacagacacacccgggattaatactttgtatccttcaattcagtcaagttgacactcagtgttaaccatcacaattaggatatttaactattcatgttgacttagtgttacccacatttataccagtatttttgcccaccatatctttgaccaactcataccttcttcttgagaccattttctgcctgaaaaacctcccatacatcccttggaatttcttttaatgaagttttttgaaggtaaactctactttgggagagtctgaaatgtacttattttgctgctgtgatttaattatagtttaacttggtgtgctgttttggattggcagttattttctttttatacattgaagaatttgttccagtgccattggatttccattgcagctattgagaggtcctctgtcaagttgtcttctcttttcaatagattggtctttatagctacctttcagatcttgtctttgtttttggctttctgcagttcaactgtgatgtggaagggaagaattttgtttgtttttcaaatcctgcttgagacttaggcttgctggatgaagatttacatctttgaactatttctggaaaattctcaaccagtatttctaaatattcctctcccctaatctattttctggaactcagatatacattacacttttttccatgtttcttaacctaactttaaattttttaaaattttgtttctctagactgcattctagaaattttttctccatctaggtttgctgatcctctccagttatgcctaataatgttgtttgatctgtccatcaagttcttaatttcagttattgtattttttattatttaaaggcttatttagctctttttccaatctgtatgcatcctgctccttgtttgagtcttctcctttattttcattggctataaaaagcagttattttatattctgtgtctgttaatcccaaaatctgaagcctttctgagtctgtttctgccatgtcttgattctttgtgttcttgctcgtttgtgtgtgtattttaggatttttgactgagagccgattgttttccttgaagcatattttttgtgtgtgtagcgctttgagaactggataacatttgagtttttccagagaggatttaaatttctttgcttccgctggtcacttgggagcactacatcagtctgtgaccctttgcattgtattctctgtttgaaccacattaaattgcacaaattacaaatcagagtgagggtttgtggcttcagattatcaagggagtattattttccattcacttccactgatgaaacatgaaagtgttccttgctaattcttttcctacatggcagaggcttttttctcattctctcttataccatggatatagtccattgtagtcccagctttacatgggtatcttttgttagattacctgtcttgggcaagctctgagctttatctcctgttcctaacatgctgtgagtcatcagaggtagaagtaaaggtctccagggtttggcagaaaaattcagggaacaagcactttgtctcagtattttttattgttttgaggatttaagtattctattcaccatcttagttttttcagtgtggaagtcattcagggtgtcatttgctgtacttccagaaatagaaatttgctccttacgtttttttaatcattcttactgtgtagctttttttaaggcctgcatatgtttttttctaaagacagcttttactgtaaccttatccttgttttacagaaactgatttatacaaagccaaagacttttaagattacgcagttataagttaatcaagctaatagtgactagaaacagctttcacttcttacaaatcacctgtgcactgagtttgttctgcttagatcaggacaaaactaatggccttactaactttaagtagtcctaaatgaccaggatttatttttggaagcagtcatacctttctactcatttagatttgaaaatacagattgtatttgaaaaaaaaaaaaaaacaagtatttctgaagcaactatttatttttaactcttctcactatttcctaacagacatttggaataaaacaggagctgttaaattgatgagatggtctcctgacaatagtgttgtaatagtgacctgggaatacggaggcctttctttatggagtgtttttggagcacagctgatttgtacacttggaggagattttgcgtaagtcaaaaaagacaatttttagataaaataactccattatttctcacaatgcatgcatacaaaaaccttgtgtcagaacttccctttttgccttgactcttaccttaaaacaatttgcaaagttcataatctgttcgaatatactgattctctgaacattcattttttaaaaaatgtacatctcattccacaaaaatgtatttatttattgaacccctgctgtatatatgacagcatgttagacacaaagcagaatcaggcatggttctgcttttaggtagtttataatctaatgagggtggtaaggcatgtacataaatagtagaaagttacgttatctcattaggttaatgtaggttagcccagtgattgataggagtaggttggtatctctgcccacttcatatactaccctgaacctcagttctgatgaaatgagcacacctttaaaagctgcatatctctggcaagaagtcacttggacctcggaaaatgtggctgagagatatatacacctaggtgtattaacccacagttttgtatttcatgcattattatgtatttctattttaaaggagcaaaatccgtttgattttttaaaaaacactaaattttatgtgtattatatgtaattggaaggctgtattatatttagtttctgttctgtttcagttataggtctgatggcaccaaaaaagatccccttaagatcaactctatggtaagtactttctataaaaaattggcatggtattaaaaaaacttggatttttcttcccttttttcactcatttttatttatttaattttttgagacagggtcttacactgtcacccaggttggagagcagtggcagatcatagctcactgcagcctctctaagcgatcctcctgcctcaagcttccaagtagctgagactctaggcacaccactatccacacacggttaatttttttgatttttagtagagacgtggtcttgccatgttgcccaggctggcccccttttttcactcatgttgatctgataaaatcacaaaactattttagtctcagcagactcttcattatacagttcttgcttgatgaaagtcttttgtttttttttaattggaaggctgcctggttttcagtatttgcattttgtttagatgtggccagcaaacccctgtcatctttatgatgataatgactgttcagatgaggccttttttgtatgtgtcttctcatggcctgcttgcttttaacatgaggtgaaatgctcattgggcatttttcctggaggacatgcacttgtgcattacttgaggatatctgtatctatatatctatatatatgtatacagtaccttgagcatattttttaaaatttacatagatgtatgtcaaagagaattatggtcactgttgtaaacaatacaggttgagtaccccttaaccaaagtgcttggaaccagaagtatttcagattttggaactttttggattttggaatatttgcaaatacattcttggggatgggactcaagtctaaacacagaattcccttatgttttatatataccttatgcacatagactgaagctaatgtaatgaatttgtaataattttgtacataaaacaaaattttgactgcagctcatcacatgaagtcaggtgtgggatttttttactgtggtgtcatatcagccctcaaaaagttgcagctattggagcatttcagatttttggattagggaggcttaacctgtatttttattttttacctattttcaagagtttctgtagaaaacagagatataaaacccctgtctttacataacaagtttttcttgctatagcccctctgcataccatcctttttaaattagtgactatgaggcttgtcgcttctcttctctcttgctccacagaggaagacattcttctgatcttgagtttcttgtagaattaaaaccgccatggttgcctaaaatagtggttcccaaactttcaccaccaaggaccccttctgatgtctttgcccacctccatagtttaaaataagttttcaccacacatttctataaataccaatcagtgcttctgaatggcatgcaagaaccagtgttgtccgtctcactaagttgatattttaaccacaaactaagaatctaagcattattagttaaaacttaggcagctttatcataggaaaacataaaagttctattaaacttttgaaattttgcaacaattcatgggctacccctgccccttcaccattttcttggcttgaagattgagaatcactaatctttaaaaatactatcatggagtctagttacagaatattaaaactgaatggttctggaggaatttatttgaaccttctcattttacagaggaagaaacttatatcccgagaaacgagacagcttggccaaggtaatatatacaaaaagccaagctataatgaagactctagtctcacagcttccaatccaatgttttttgctccatacaaaactgcatctgttgtaggggcttctttgccaggcttctactgggtaacctggggtgtcttctgtaaggaatttctttgtatttgagaggcagctaaattaaagcaatagagaagttacagagcacagtaggtatttttaggattaagaccctgaaattggcattaagaatggtaggtaatgttttcacttttgcagatagagagcagtgatggtgatttcctctggagttagttaagaggtaactgaaggtgtgattcttgtctgtgttatcacggtttctccaaccttcacaaatcattaataatgctatcattggctatttcagaatttgaataattgaagctagaaagggatacaaaagccttttattgctctgactttttttctccctcctcttctctctaagagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatggtaagtatatttaaagctctgattttttagtgtcttttgtgttagaagctcagacccttctttatgacatatgtatggcgtatacttctaaaattggcatattatcttcttttctatgattcttgtgtttctttttaatttatattaaatttataccaaaattttatttctcaacgggttgtgtttctttggtcttatttttttaaaagggtcataagcaatttgacggaaagcaatgtttatatatttatttaaataatttgagtaatttagtctttatctgaatagcatttcccaaagtgtgttcctccaggcactacttatgagagatattagtagcagttccacaggattttttaaaagttttgtttccatataagtgtcaaataaaggtaaaacaaaattgtagagattgattgtagggctccagaggcttaaatatgccattgtgcatcatgaaaatccaggaggtggtatattaaaaacagtgttccccatgcttatttaactgtgaatttttaagaaatagcttaaagaaagtatgtctgaggacttgcttttagaaacaccgccccaaacactgcctcttgtatttctatctgaaatagtgtatactaatattattatatatcgctaatatacagtaatggtatatgttacatgttagaaatgtgtatcttaatacctaccatcaatggctttttaatggatatttggtacaacaaatttctaattaaaatttacgaacatccataaaaaatgtgaaaatagcctgaatttcagatccattattccacttgaagactaaggatccccagaaaagaagagagcatttctccctccccttccccatcccaaataataatttaaaagcacccttgagttttatgtcaagccagcatttggactaaaatggaaaaatgacaagggtagggtgctactttgtctgatttcaatagttaatgagtctactcacctttgagaacactggctttctagctgaaatctcatagtcactaagagcactattctttctaattataacagtgcatgagattattgtgtagtctttgtcctctgtgaagaaaatcaacatcgagatacatgtacatttcctataataaaactaaatcgatgtgttatttttgcctgcgtaatattgagttgtttttatttgttttcctcctttgcccttttgttcctctttccctcatttagagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacaggtaaatctttagttactgattactagagacttattctttgataggatatcacctggaacagattattaaatatttcatctgttaacttcaggcaactgagaatccttttaaccattttgtcatgtccctcttctgcttttctgtgttcttgtcctctagtcttctccctcctttctttccacttggcgtagagtgtatccccacctgtttcaagtctattaataatgtcaagaactagaagtttatgttttgccttctcattgagaactatttattttactttcagcctctttttttgtataaatttagctctacggatttgcacaggcaaaacaaagtgtaataatctcatggaaagtggcaacatcagctagtactctgtacagctgaccttacagtcttaaggggccacgttgaggttaatcatgtgactttggacccaaattgcagacttgtgatcagtagagagctttattgttaatacttttattagctaatcttattccaaattatttattcattctgatatcacttttaaattaacagtgtctcacagtaattctgataaactgacatttaacatggaaattaattctcaattttgataccaagtaaaattattttggggaaaccagtaagttgaagtttcttaaaagaaacttgcatacataatttcagtcttccgactgttttctttccctttttgatagcaaaatattttaggtacatcaaagcccactcttagtttcttttagtcagtttctgtttccataattctttgccttactttgactctctatatgtttaccctactagcctacttcagctcccatgttattttcagttgactttgagtgaagataatgagagacaaaaaaatggtcatgtgaaaggttgaaggattatctcctacattgacatctggtatacactaaaagaaaatgaacttaacttacattaataaattcatagaatcaaacaatgtacataccattttataattagtaacaatttttaaataaaactgcactagctacttccttgactaaaattttccactgctcccttctctcctatagccatttctctgctattttcatttccccatactttgaactattcattctacactgacctagcatcaatgccagttctgcctagccaggtctgtgttaccagagagccaagtagagcagaggatcaaagaaggtaggtctggaactaaaaaatcgatcaggcaataacaaaaattgaatttccttccagctcaaaaactcagtgattctgtgattcttaagcatctatgaagtaccccatataagagaaacattttaacactgattttaggactttgggtactagcaagattccactgttattctgttctttagatagctaaagatatttagacagatgaacttttaaaacttgagtttacctagtttatcagtttccttaaaaataacataaataatgccacattgattgttttgtactgctgaaacaatgaaaatgggctcatagaatttttcaagctggaaggacctaagagatcataaagtccaactggatttgatacatgaggaaactgaggatcagagaagttatatgacttgtccagttcacccagcagagtagtggcagacttatctttatcatcactctacgttaaagtaaaaatctaatgtattttaaaaccgaggtactgagcattaaatcacataatacaccactgaccttgagctaaaacttagaattcgcctatttggcagtttgtacttggagttgccctgtatttcgctggcactccagctacatgattcagtgcagttatggtggcggtgtatagggcagtatacagtgtctatataatgctaaacttttacgttctaggctttttagccatttatgatgactccctgaagaaacatagttgcctggtttaatttgccccacaatagtatccttttttctaagataagtgaccacatcctctgtcaaagttgattttgtttgcgtgatttattcgttgtatgtatgcttcttgtatagcttagatgaactccaactaattctgctgcttgttctgtttctcatttagagtactagctttttgtttgtttgcttaaacctgctaccttatactccttagcttccagattggaagattctatgttacttatgatttttctttaactaaaacaaaacaaatacatacttgtcagaagcaggattggtaactggcagtaaaggcggtgcttttttttttttttttttttttttttttttgagattgaattttgttctttgttgcccaggctggagtgcagtggcgtgatctcagctcactgcaacctccacctccagggttcaagcgattctgctgtctcagcctcccaagtagctgggattacaggcacctgccaccatgcccggctaatttttgtatttttagtagagacggggtttcaccatgttggccaggctggtctcaaactcctgaccttgtgatccacctgcctcagcctcccaaagtactgggattacaggcgtgagccaccgcacccagccaaagcaagcaccagcaagcaccagccaaggtgctttttaaaaagttttttcttacctataagttttaaaacttttgaagtcatttgttgacatatggggcacaaactattgaaattttacagaacacaaagtttctagttttaggccatgttccttctaagactgccatttattttaatgctcagtattttgtatgatgtaagcatttacttctgaaaggtacataaatctattatccattgttctgagggtgttggtttgatggttagcttggctatttagaaagaataagcttcacaaaatgtggaagataagcacctacagggtatcaggcactatgttagggatttcaacagagagtatttaaaggctctttcattcataaattatttactgtcttcctacagtatgtatcaagtgtaccaggtatttggcacagaacaaatctgctaggaggatggctcccacagtctcactagttatagacaaaactaatctaggcaggagacagagttttagcagagttactttaaaatttaaaaatcataataacaaatgagggcggattcagtttctttaagagaaactgaaacattctaagataagggtagagtttctgtaccttagcactcagttttccagtgatgtggcatgacttcagtgccctgagtgtgctttcatgacctgttttttttgtcactgatcagctgcctcttccttacttctgccattcccttttatcaagtattagaggtagagctcagagttcagatgacacatagatcaataaagttgacctactggagaaaatacatagtatctttagacacaaactgcatgaaaaataaagcttcattctaaacttaacaccttaagtttttaaaatacatcatttgtggcacttcatagatttttgtagaataaagaataaattgttttatagatattgatcatagtgtgatcatttgataagatttaactttggttcccattattagaaactctttgtgttagaatccacttttgcagtaagatcccagctcctccattacccacccacacgtttcataagtactcatgaaacaccaaggtttgagggaggtaaggattccttttagtgcaatggatgattgacacagttatactcaggtacatcctcctgctgtgagtgactgctgaaaaaagttgaaaatgctttcaagttttatttcaccacccaatcattaccttaagtgtaccattattctgaactaattttacccatcatagtgatctttttgggggtctggggggcagggagacagagtctcactctgttgcccaggctggagtgcagtggtgcaatctcggctcactgcaacctccgcctccagggttcaggtgattctcctgcgtcagcttcccgagtagctgggattgccggcacctgccatcacgcctggctaatttttgtatttttagtagagacgggtttcaccatgctggccgggctggtctcaaactcctgacctcaggcaatctgcctgcctcagcctcccaaagtgctgggattacaggcatgagccacggtgcctggcccatagtgaattttattaatttattaagctattgatttagttggattttaagttgacttaagtcaacttaataagtataacaaataattagtaagtaaagcacttgataataagtgaagtataacaaacagttttatcaaattttatcaaggttaatacagatgtttagagcatattgcttttacttaattttctgtcttcacattacatacacaatcttactgggtttgattgctgttgacttagctttttaatttggcatttagtttttcaatatgtgacaacttttcttagagtaaaatgaaaaataaatttgaacagatcgaagcttttcttattccaagaacagaagactctttgttcagttctgttaattctcgccccactccaacatgtgctcatgaaaactaatcagcaggctagagagatcaatctcattaaaacgaaaatttactttatctacattgatatcccatgtcaattatttaaattgaaaggtgttgttagggtgatacaaagacaccatgttcaaagatgtaagacagacaacgtggaaaaatgaacgccttttcttgcagatagagttaatatttgtaatatattaaaagttcttgtagataagtaagtcaaataccccaatagaaaaataatagcttacatacactctttcatgtacatatatatatgtttgtttagagatagaataaaagctaaccagtggttgtacctaagtaacagagaatttcattttgtcaatttttatattgcataatttcataagtttttttttgttttttttttttggagacggagtttcgctcttattccccaggctggagtgcagtggcgcgatcctggctcactgcaacctctgcctcccgggttcaagcgattgtcctgcctcagtctcccatgtagttgggactacaggcatgcaccatcatgcacggtttcgtatttttaatagagacgagatttcgccatgttggtcaggctggtcacaaactcctgacctcaggtgatccacctgcctcggcctcccaaagtgctgggattacaggcgtgagcaaccacacctggcctaagcattgctgttttaatcagaaaagtgtaaaagtaataaaaatatttccattaaaaaccagaactttttctgaggctgtaattgtattagattaggttgttttggaatggtttatatcagcaaacccaaactgttcatctgcacaattcatagctgccctcacaggtgccttctctgaaaatctcttgtcagtctgtatttattgaattcaatatttaaaacaaacagaaacataaggggcaaggggcagggagaggaaagcctggtgcctagaaacatgaaataacgtaagatgtaaaacattgattcatatacaaatggtaaattccaagtgctctgctactaactagggggcaccttaaacattgttcggcaagatgaatctcatagtgtgataacttaatgctttaagtttaaatatatttcataagttttaccaatctgatgtgttattttctatagatttccagcacctatctagagagcaattggcctatacgggtgagttgttattttgttggtgttaacttttgttgactagcatttgctgcaagaggcattctgggaagagcccttcagtgggtgtactgagaaaaataaaactcttgatctattgtaacattgctagtatattaacatctataattttgtcagatataactgaatatttggactttaaaatatttaattagcaaacatttattaattgtctgtttgcctgacacaatactaagctctttatgcctaataaagtatataggtttgcaaggaaaagttcttatttttttttttaaacagttttcagctattgataagcttggacagaatattgctgtggttggcaagtttggttttgcacattactctttactcaccaaaaaatggaaactttttggaaacattacccaggttagtcttttttgagattaaaaacctatttctcaaagtataagagaactacaatatgaaatagctataaagtttatcactaagtaattttggttacttattaaaaataaggaaaatcagatataaaaaagtgatattgaataatatgtaagatttgattctgataaaatacttgatatttgataaaggatcttgtgttgaaatagttggtttatttttaattctttttaagatcggtaactataattccttagcctgaggatttattcttacattccagcttgagtttatctgatgtgatcagaatagatttccacagaatttgagatcattccatgcctattctgtgtgtgatgtatatgggatagtgagtgtgcgtgtgtgtatgtgtatgtgtgtgtacatatacgcatgcagttggaagagaaggaaatcagtacttattaggtgcctattgtgtgttaggcattttaaggcactttcatatatgttatcttactcatctgcacagcaacccagtgaaggcactactgttactgatcttttgatgtaaacacacacacacacacaaactaggattcagttactcatctgataagtgattaagccagaatttacactaagccctaatgggtgttagaatgatgatgctatatagcacccagttatttttaatggtatacttgccttcttaaagaaatatttatttttataaataggatatggatcattattaataaaggctctagagttatcattggagagagggggagtaagagcagaaataatttgatctttggctgggcgtgtggtggctcacgcctgtaatcccagcactttgggaggccgaagcaggcggatcacttgaggctgggagtccaagaccagcctggccaacatgacgaaaccccgtccctacaaaatatacaaaattagctaggtgtgttggagcatgcttgtaatcccagctacttgggaggcggctgagacatgagaattccttgaacccaggaggcggaggttgcagggagctgagatcgagccactgcactccagcatgggtgacagagtgagactgtctcaaaaaataataataatttgagctttgtctgggtaagaatttttataaatatattactttgttataatttctggtagcataaggtaaattttttaaaaaatttttattttaaggagcaaaatatgatcgtgacaggtggcttagcctggtggaatgattttatggtccttgcgtgttataacataaatgaccgtcaagaagaggtaagttttttctctcagaaataacagatttttatattttaaagctattaagcatgaattaattttatatagaaaatagtcgattgaaaactgaacaaaacattttattttttaatcaagaatgtagcttcttttaggtagtgggattttcttttcaggttattactttaaaaaattattaagtgacaattgagacttttaagataaccttttctaaggattttagctgtcggacattccctatggagtttgaaaataaagagttaaaagcaaaaaatttcatgatataagaatggctgtcctcagagatagatttatttagttactgatttacagtaacccctccttaattatgggggatacattccaagaccatcagtggatgcctgaaactgttaatagtactgaaccctatatagcactatcttttttcctatacatacatacctatgataaagtttaatttgtaagagattaataatgactaataataaaacaattatgacagtatattgtaataaaagttgtatgaatgtggtctctcagaatatcttagtatactgtactcacctattttcagaccatggttgactgtagataactgaaactgtgaagagcaaagccatggataagagagactactgtatctggttttttgttttgagaaacagctggtcttattatgtatcaggtctaaatctgcaggtctaggccaggtgcagtggctcatgcctgtaatccaagcactttgggaggctaaggcgggtggatcacctgaggtcaggagttcaagaccagccaggccaacatggtgaaaccccatctctattaaaaatgcaaaaattatccaggtatggtggcacacccctgtaatcccagctacttgggaagctgaggtggcagaattgcttgaacccggaaggcggagggtgcagtgagccgagatcatgccactgcactccagcctgggcaacagagtgagaccccgtctttaaataaataaataaataaataaataaataaagcaggtctaaaaggaatattttataatagtacattcagttttgatcacttcattttttgcttactcatagaatgagcctagtctgcaaaaatatgtaaacataatccatttactgttaaagcttagatagttcttttaactcctgttactaaaaaaaaaaaaaaaagtcggaagttaaaaacagcatgtttaaagtatttggtcatccctagtagttatcttgtttttataattttcttcatttttgttttcttcagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatgggtaagtatctggcatatgagaagtcactttttgctcctatttaccacgtttctcttttgtagtttttgttttctcaaaacagttattccacttttatattcaatcttgtttttgttagaggtaaaaaaagcaaggagttttaattagtgatattgatataatagctaaaaaaaaaagaaatatcgtacactaacttctttagcttatcttcctggagtcatttgaaaaaaatctagtttgggatgaggtaaacccttagatactaaattttttttcacaaccttgaaaataaatggttactgactctcctggtgctctcgatacttggtgggaatttgaaggagttctacaactttaagactgtaggaagcatgtccttagcaaactgacttatatttccactgagctagatggctgtagtctggggcagtaaaaaatcagcagtgttgttgctgctgcacgttgccttatatttgtcttggcatctggtctacttgcaacgtatttagaccacacctcttgagttttatttttgttctcagaggttaattgaagtatgtatttactgaaacagcacagtgattgagaagtaatgcaagataaaaattaagacatctcactagcctcaatgattgaaccatcattctttctcaacccactagttttttccacttaaatatttgtattcttatagcttcttccctagttttcgtcttccctcctatttgttactccctttctttctctctcatccccatatactctggttcccctcaaccttgccaacttcctgatcgaaggatatatggggagaagatgataggtagtaagacatctgagtcttccataagcatgaaatctaatactattactagtggaaaagaaagaaaatcttattagcattgttgttgaggtatgtgggtttcttttgtttttacagtccaaatactactgctggtattcaagttcttcaggaggtttccatgtcacgctacattcctcaccctttcctggtggtatctgtcactctgacatcagtgagtacagagaatggaatcaccttgaaaatgccacagcaggtaccactccattatcaaaggtctttggagtttacatttctgtttttagtatttgagtccatattaggaagtatttgtttggcaaataaatactaagtgtctaaaatgtaccttatatgagaatgctgggttgcagtggcaaattaaaaagacatggtttctgctcaggcattaaataaataattacatacataatgaattgttcctgttacgtgtaccaaaaagtagtacacattactgtgagagcatttaacaaaaacctgttatagtctgaacagtcagagatttctgtatcatttaaattaaaactaggagaataagtagaaattatccaagttaagaggggatggattttcaggtggaaggaacagtagtgcaaaggcccatagacaaggcagaacatgacacactcagggaattggaagaattttagagtgactgggacatggaaagtgaaagaggatatgagtcttgtagataatattgataattttagactttaagtctaaagtgttttaaggtaggtattattagatctaagctttataatgtttactgtaaggaggaaaatgaactgaagtaagacaaaactactgtagggagagcaactgggaggtcattgtaatgatctaggtcagtggtgttcacagtctgaacttgggcagtgaaaaaggatatggaaagaagtagaatgagtatagaatagcaagggctttataattagttaattatgaggaaagagaaagtataatcccgtagtttctgggtaaagtaacagggtaagaagtagggcgaccaggacccacgttgcataactttctatttcagtggtttctaaacttcatgtcaactgggaacctactgtcagaggaaaattctatgtggatttatttgtcatccctgtctgggcagtctgtcttttacttcctatcgaggcacttcgatcaaacctcaacactccataaaataattagaaaacagactagactagactatccagttatggggaatttaatattacttatatgaatctaaaatcaattttgttaccttctatcccagttctctattctttgtagaagacattgtaaaagctagtccctcttccacatgatgacccgtaaaatatctgcagacagttaacattccttggcttctccttctctcctcaaacctctctgtcatcttatctgcatgctaaatacttccatatgtccaactatttcattggatgtttattctagaccccttaagcatcttggtctcccttctttttttttttttttttttgtccttttttctttttttttttgagatggagtctcactctatcgccaggctggagtgcagtggtgcaatcttggctcagtgcaacctctgcctcccaggctcaagcaattctcccgcctcagcctcccaactagctgggactgcaggtgcacgccaccacgcccagctaatttttgtatatttagtagagacagggtttcaccatgttggccaggatggtctcaatctcttgacctcatgatctgcccacctcggcctcccaaagtgctgggattaagggcgtgagccatcgtgctcggccttggtctcccttctataggtaaaattggttttctcctttaaaatatagttcccatttcctctgcaaaccttatttaatggtaaccagttagtcctaattgataagggaatatactgttttacagaagtttagataaaaggtgtgaaaaaaagtgacaatttaaaaatcattttgcagtcctgaggaactaatcagtcttatcactaaaaatgggaaaaccagatatggtatgcttcttgaggtgatataacatgaagttcacaagaattattgccaaaaatcttgaacccaaatcaaatcaagtatagagagtcatcttccctaccacaagggagcagaatacaagacattctgttggacagctacaagtcactaacatgggggaagaaggagtgaatcttctagattaaataagactttgaagccataaaaaccaaatgcagtggttaaaagtcatttgtgaggcaaatgtgataatcactaccctgcagaaccaagtcagtaagctcatttgtatcttcattcaaatcagctatgaaaagacactgttgaaacaattagggatatttaaatactaatggagagagaaagtagggaataattgtaaattttattggatgtgatactagcattgtagctatgttagcagatgcccatatattttaggaatgcatattaaacatgtagaagtaaaatgggtagcatgtcttaattgaaaatattctgacaaaactgaaaaaaaaataagggatggatggagcacataaggcaaaatcttgataattgtgaatctggataatggcagtgtgaaagttcattatactattctccatacttttaatcatgtttaaagttttcatatttaaaaaaggactcttatatatcccagatagagtaggcaaccagtggcatcagtagtcctggataccatattttgagagggcctttcacaaagagaaggtgcttaatttggctagagcagattaagaagttaaaattgactgattaccatagagggaagacaaagaatgctggagcaaagtaagttttcatttaatactaaagttttcaaaaaaaatagtagtaacagtgaaaactcttcaacagcaagatagtctctccatgagagtgagctccttgttactgaaactctcatagagaatcatctgccaggggtttttttagggtaagagattgagtttggggttccttcaaatttaggattttgggcatacatgtagcccttgctttttctgaaagctttattaaagttgcttgagagtgctgttgcagtcatctttaacgttatcagaaagtgttgaatactaagataggatactgataatacccactcactgaagaaaagagaagtgtacttttttaatgaattagtatgaaatgtggtgaaatctaccatcttaaaacttaaggtagtcattataaacattactcatattgtggtgaattacagtaaatgcctttaaggtcttttgaagtgttttagtgtatgcagttcccagtcatgctgttttgctgcaggtgtttgtctttttctttttcctctgccatctagctacattttactgttatccaggtgtctgactcttctagttgccacacacctaaattccatgttcacttctcatacctccaaattactttctggatagataaccaatttttttatttagtcatttctttatacataatcccctgtagaatctgaaagcagtaagcaagagtagtttgtatagccaagtattttgcaactagaatatatagggtggctgctgttttcttgatgaaccctaaatgatcattggtagcttaaattcagccagccagcatgcagcaaagcctgggacacaatcccacaagttttgaatactcactctttcctccctgaaattctttccttctgtttatatagcatgtatagcattgtgcttccctatttctcttttgtcttccaaaagctcaggtgatggcccgctgctctttttaccctggctagtgtgcctgagaaacatctgtctgtctccttcagtttaccagcctcacctttttttttttttttttttttttttttgagacggagtcttgctctgtcacccaggctagagtgcaatggtgcaatcttggctcactgcagcctccgtctcccgggttcaagtgattctcctgcctcagcctcccaagtagctgggattacaggcacctgccaccacgcccggcttatttttgtgtttttagtagagacggggtttcaccattttggccaggttggtcttgaactcctgacctcgtgatccacccacctcagcctcccaccaaatgctgggattacaggtgtgagccactgcgcccagcctggcccagcctcacctttaagcttctgatgctggtacagtcgtctctgatttagtgattgctcacatttttacttggaattcttaagaatttttttttattttttcaaattaaatgagccaaaaagaaaaagggaaactctttggttttcccttccctaatttctcttcctgtcttctatcagtgataataacttcaacttctctagcacctcagctaacctggaaatcatctttggttcatctctttttctacctttcatgtctaggatagcagtaagttctgttttttaaccaaaatgttccttcctctttacagatagaaatgacttgatatctgaggttccttttaaaacagggctgctcaaagtttaatgtgcataatggtttaagttgcgtgatagggctcaattggaaatcattatactaggctctctgaggtttgattgaaatttttcattataaaaaggcagactatttcctcatttctgaagtcaacacccatgaaatctgcctctcctcagtaacctatcctgattaactctgattttttaaataactgtcttattcaagaaccataagtagtggcttctttcctgctgctcttttacctggctttctgaatcctccttgaaggtctgttaccatccagctttgttctcataatgtccctagtctagccagactgttctcactttcccaatagttccatgtcttcgttttccattagattaccaacccttactctcccacacgtgtatgtcttcctcatctgtcaggttcactgcatccttttaaactttctgttgttatgacagctagatcactgaagtgatctctcatttttataaacttctaaagttgtcttagctttttcaggataattcaactctgccctcaatcttatgtcactggtggtgttcattaattgcattatgtgttaggctttgtaccatcctagccagaaagctccttatattcccacagagcctagcagaatggctgtacatagtacaacctcaataaataatgtagattgtttgacctataaaccttatggattggggggagatgcggaaagcataccgatacagaagtatgaatttagctgctttttcttaaatttcaggctcgtggtgcagagagcattatgttaaacctggcaggacagctcatcatgatgcagagggacaggtcaggcccacagatccgggagaaggacagtaaccctaataaccaaaggaaacttgtgagtaaagtactagtcatttcttttcaaacattaagaaggtatgggatgaggatgaaggaatgaaacaatttaagagaagagtattttatgatttggaaaggagaaattaagtccataaaatcagtcttaagcctctgggtgtaagactgactgactggaggataaggtcccaaaatgatcatgaaatgttccatactccatatgttaactgcttaggcatcattcattgcaaattctaatggaaaaaatagggatagactggtgaagttcatggggtgttttgttttcagatttaagtgtatatactttaaaaggccaggatacttttattaactctaattctaattagatccctttgcttttcccaaaaaaatattatactatcatttgaaagacttagtaaactagtacctaggaacttaagaacctgcagatttaataggaaaacaacttgattcttgtctctccttctccagctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacaggtaacaattctcttcttataaaggggcaagaattaatgagcttaaacttagaaaaatagaaatgtcctgttttgacaccatgattgtgtttaaggaattcatagtcaaattttctgtttatatctttaatttggaagaattcagacagattcctttgaatatcataaagtaacattgcagagatattttttccattgtccataaataggcctaaaacagattaatgagttcagagtagtgttttgaaattttaatatattgaagaaatttaatatgtatattagaatacatgtaataggaacatggaagaaatattacataagattattgaaatattacataagaaacatagcaaagaaagtattatttgagatattagtgagtttgagcttctcacaacagtagatttgtttcctttcagtgtgggttactgaggggacacttattagagcatggtcataacagagcaccttgagctagtcttccccaaagcaagctgagaaggctcaggcctgccacagcaaagaccctcatagcacacagtttttctcaaaataatggcttctttgcaactcctgaaaatttatttcattagctatttgacaaaagggcttgacagttggttatttgataggctacacttaaagattctttccagttactgcaaagttgtttccattgatgtaagaagctaaccataaacctggtttcaatctctgcctgaagcagatttcctgtcagcttctttgcttcatgacaatgaactgaaaccagaggagacactcaagcagaggccaggtggccttgaagtatgattccatggctaaccctaaagaaaaagacatagggttttaaaaatagaatcaaaataaatgcagctgttttttggttccgggtcactccctgcaacttcactgtatctccctgacaatgtaatttttttctgcaacagaattcctaagttgctatggattggcagataataattacaattacagttgtctattaggcacctttccataaagaccaagataggcaggttaaatttgtgaaagaaaaatggaggattctgaatgtgcagcagaactttactacttgctattgcccaaagcaaagattctagtcacatcctcagaaaactctgcaacaggagacagacctgacctattttggagtcaggcaaacctcccttttttttcttccttttctgctgatcttcaacaatttacttaactcagtttcctcacttgtaaaatacaaatgatatgcctatctgcagagtcactgggagaaataaatgaaatgacttaaagtatatgtatgctatctggcatgtagtaggagtttaataaattatagtttacatacaccagaagagtacttgcctcgcttttccttgtatggtactttttaatcttattattaaactaacccctgtggtggtgtggctacattctttgagtttagaaaacgagataaagaattgctcatatcttcccaaattgtgtagtataaaaagaatgctgtcctggttgttttttgtagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggttagttgcaaaagttacacatcttctctaggccatacacccacgtagcatctttctctaatggtactgcatatggtgtgtaatcctaggaacccagttcaagtggtggatttgagttcttcaggaatcgaagcatcagtttatcccagtcagctgaaaatgttcctgccagtaaattcagtttacagaaaacactaagtatgccatctggtccctctggaaaaaggtaaaataataaagagccattactgctttttgggcattcatgacacattgcatttcaagacatttacaaaattaggtcttaatggaaacaactatttaatccaattgcagtttctttttccattcccaaaaagcagaggccacacagaaggcttccctttttccttcctcccaagttcacttcagcaccctctgaatagtttctgcccctttttctggaatagatcttcatgtacctgttctgaatgtaacaaacttgtttaagacagagtctcactctgtcacccaggctggaatgcagtggcaccatctcagctcactgcaacctccgccttacaggttcaagcgattatcctgcctcagccacccaagtagctgggattacaggcatatgccaccacactcggctaattttcatatttttagtagagacggggtttcaacatgttgcccaggctagtctcgaactcctggcctcaaggatccacctgcctctgcttcccaaagggccgggattacaagcgtgagccaccctacctggccaaatgctacaaacttttttttcccataagttactggggtccaggtggtatttggttacattaataagttatttagtggtgatttgtgagattttggtgcacccatcacccaagcagtatacactgcaccatatttgttgtcttttatccctcaccccctcccagcctttcccccaagtccccaaagtccattgtatcattcttatgcctttgcgtcctcatggtttagctcccacatatcagtgagaacatactacatttggttttccattcctgagttacttcacttagaataatactctccaatctcatcaggtcactgcaaatgctgttaattcattcctttttatggctgagtagtattccatcatatatacgtatatacaagtttctttatccactcgttgactgatgggcatttgggttggttccacgattttgcagttgtgaactgtgctgctataaacgtgtgtgcaagtatcttttttgaatgacttcttttcctctgggtagaaccccagtagtgagattgctggatcaaatggtagttctacttttggttattgagggaatctccaccctgttttccatagcagctgtactagtttacattcccaccggcagtgtagaagtgttccctgatggccacatccatgccaacatctactgttttttgattatggtcattcttgcaggagtaaggtggcattgcgttgtggttttgatttgaaaatgcaacaaacttttaaattacctctgatgatagaggaccaaaaggaagatagataaatctgtaggtaatccaaaagccttcttaaagtcgtaattttacctttccttctaattatactttttgatataaatttagtgctaatgcatttgacactcttgtgacctattgattagagaagttattacacagtcggggagccaaatgaattgtatgctggagactgaaactgctatcacccatagatgggatattgtcttctgagagatgactatgaattcacactaacattataaaatcatgagaatttcctctggtttgtgaggcctgtgtattccttcctatgttcttctgttgttgtctcatttttttccttacctaatcctttgttttatattgttcatattctctttttttttttttccccaggacaacatgaacatatgtttatattcttactaccgtgcttgggcacatagtgagagcttattgaacgtttgttattgtcatgttttactgggtttttttgttttttgagatggagtttcgctcttgttgcccaggctggagtgcaatggcttgatctcggctcatcgcaatctccgcctcccaggttcaagtgattcttctgcctcagcctcccaagtagctgggattacaggcatgcaccaccacgcctggctcattttgtatttttagtagagacggggtttctccgtattggtcaggctagtctcaaactcccgacctcaggtgatccgcctgcctctgcctcccaaagtgctgggattacaggcatgagccaccatgcccagcctgttttactgttttttaacaagtgcttactacatgccaggccttattctaagcatttacatacataggtcctattttaaacaactctatgagggttatccacattgtataggtgaagaaacagaggcctaggaaaataaacttagttatgttcacacaacaaatgagtggcagagccaagatccgaatccaggcagtactgcaccagagactaggctctttaccccaccactaaactgcctctcacttaaagcaccacattatccagttaccaaaccagttcccccacattagctcatgtaagtcaggaatgagagactatacttaggcaagttgtaatttttaaaaattggtttcaggactggcaaggtggctaacacctgtaattccagcactttgggaggccaaggtgggaggattgcttgaggccaggagttcaagatgagtctgggcaacacagcaagatcccatccttgcaaaaataaaaatacattggctaggcatggtggcaagtacctgtagtcccagctacttgggaggctgaggtggggaagatagcttgagcccaggagtttgaggttgcagtgagctatgatcacaccactgcactccagactgggtgacattgtgaaaccttgtcatttaagaaaaaaaaagttggtattcttttcatatgtctgcatgactcacactgagaaatttaatttcactttgcctctctatccttagtttctttgatgtgctctccttccctcttttcattgggcttttcaaatatagcatagaggtttgctgcctttctttctgtcagccacccatcacctgcttcctggtctgacttcttctgtcccccttttcctgttccctgtattcattctacaaatgtgtcttaagagccttctgtgttccgagggttgtggtgtaacacggaggagaagcgttgatactttatcttcattgtcaatcagaattagatcttggatctcttatctccttgtcagctttatcagtacctctgcgtaataaggatgtgaaatcctccagtaaagattattctgtagctttcttgtgtttccacttacagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactggtaatgtagacttcatgtcacttgtacaaggagaattgtattttactccgtgtatttacacattttgctattagttgatattcaaggaattattttcattccaaacttaggaatggataaaagccaactttttgtacatgagttggaatgcccactgtttgaccaaagatgtaaataaagtagaacctatgtctctaagtcttgtgaccttgaagtctaattcaaaaatctaatcatacttggattataaagaagttgagaactgcctgaatataaaagctaccatgcttatgttattgtgggaaggagttctggaatcagatagacatggacctcaaagtaagctgacagaactcattccaggggaacagtaaggccaccttctaaactaggagaggacaaactgaaagtgtatattttggtgaaataaaaatttaaagttttttaattcaggactttttatgaagactgttctaattattattatttgtgaatattgaaaccaaaacttttaactttggcatttggaaacttcatgttatcttaagagccaaagcaaatcacttagaagatcaacataataaagttttgcctagctccagtaagaaataggatgatataacttttaggtggtattgtggtcagtccattgttacacaatcccatgtctctagttttggggtggctgatacagtacaggacagtaattgcctttgaactgttcttattgggtaggcaggtaggggaagctaaaagagctgaattgaaaatgtcagtgtgtgcatcttcaatttcttcctccattttttgttttcggacccactctgcagtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtaaatgtaattttaaatcctagctcttcagttcctttgaagaaaatttatgtgctatagcacttcagagatagaccttcattctttttctatcgtgatggaggattaaccatttgtatccactggagaggtagaaagtttgtagaacaaggccaaactggccttgactgtactttgccatatttattttatgtgaacaaaataaatagtacagatcaacattaatagatgaatctttgtaaatcaattttgatgataaggaaacactaactttgagccccaagtaagcaaaatgttatcctcatataaagaattccatttttatcataattagatgtggatcataacaaattttactgcattatcatttttatgttttttatttatttttcttttggaatatgtgaggaggtaatgttttttatttcatcaataaaaattgtggacatttgctttttctcttgctatataagttcctacataatatccttgattttgcctcttggccttaaaagcttgtagtatttactatctggtgcttttacaaaaaaatgtacaccaacctctgctctgtagtaatgggtaaatcacaaactgaagaggttttgaagcaatttgtgttggcatagggttatatagtataggagcttaaacaacaatttgtctgagtttgcagtttttttagtggccaggcatttgtctaatgtttgattatcagtctgtcatcactattacctgagcttctgctatgtgaggaggcttacagatctcattagttttgttttaaattgtggtagaatacacaatttaacagcttaaccgtttttaagcagagtttgtagtgttaattatgcccacattgttctgcaatcagcctccagaatgctcttcatcttcaaaacgaaaactctgtatatgttacttaataacagcagctcctcataccttcttcccccagccagtggcaaccaccattttattttttctctctgaatttgactattctaggtacttcatataaggaaatcatatagtgtttgtctttttctgaccagcttatttcacttagcataatgtcctcatgttcatcctttttggagcatgttttattcctttgtatgcagataccacgttttgtgtattcttctgatgatggacacttgggttgcttttacttttggctattgtgaattatgctgctgtgaatgtgggtatataatatttctgtgagactctgttttcagttattttgggtatatatatccagaaatgggactgctgggtcataattctacttgcattttttttgaggaatcgccatgtttcccatagcaactgcaccattttaaattatcagcagtggacaagggttctattttctccacatctcaccaacactcactttcagttttttgatagtagtcatcctaatgggtgtgagatggtgccatcactttagaaaacttttttcaagagataatttcaaatatattaaaaagtacagttaataatatagtgggttctcctccctcccccatgtggccgtcactcagcttacatcactaatggccacatatgtttgttgtacctccccactcttgtattaactgaagaaaatccatgacatattatctataaatatttcagtttttttcctacaaggactctttaagaattatgaccaaaataccattatcatccctataaaaatttgataattccttggtaccatcaaatatccattaagtattcagatttctaattgtttcatagacatcataattttgtataggttaagatttaaataaggttcacatattgtgattgtgttcttaattctctttttaagtggatgttcccccaccctctccttttcccttccttgcagtttattcatggaagaaatttggttttgtggattttctcacaataatgattttgcttattacatctccatggtttagtttaacagtttcctctatttcctgtagtagctgaatgtaaagacttggtcaaactctagctagattttattgagggagttggggaagactgcttcataggtggtggtagtatatttttccatctaaaggtacataatgtcggttatctaattctttctttaaatgttttctatgttcacatggtaattttagccatggatttcatgttttagtttcaagatcctgagaaatcaacatctgaggaacagctaatatttaaaattaaaggaaaatatattttctccacgaagttggttgtaacttttggcaattcttcatcaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtgagtttcttggctatttgaaatcacagaatgcctactcagagtatttgggcaaataggtatggggctactctcctaataatcattgcacttctgtacatcttatagatctttcttagcataaatcattttgtttctgcttatatttaggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactggtaagtgctgctttccttaggcttggtgtccttccatgtcttttggtgaatcctgtcctttcacattaaggcctagttatggttcatgtgttacattttatttatttattatatattatttattatatgttcatttttaagctactttctttagtaatcattctatacccagctatttaaatggataattccatcgagtaaggttacactgttggtcagtgtataatttatagtgtgaatgtatatcactgacttaagattgatgcagtgcaaatgagcttagaattagactggaacttcagatttgcatccctgtgaaattgaaagcaatggtctacaaatatctacttgaaaagattcaaacttaaggtccatgtgaatttaacattccatggcagttacaagcaaatccaaattagagttgtggttgcagttaagagccttggactctagccctgtctttattaccagttaatgtgtgtatttggagctagttacttcccttacttggatctggttttccttaattggcaaatgcatttaggttaaatgttgtctgaaggtcctttttcaagtctaagctcctgttggcctttcaattgtaaaatataatttttagttgtaatactggttctaaaacatcagcctttgcccctaatgcttagaaacttaagcctcaggcttatgcaatgtgcagccccctctgctgggcaggacagccaagaagcctttcctccctaccttctttgcctcctctctcccctcctaatctatcgtcgtctttaccatatcaatgttcagtagaagttcacccgtaatgttctaccaaaccttttgaattatggcagatgagctaatgttttttttctctacatagtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagctcagtacgttgtaacatagttggatgatttaacaggagaactcagttcagagactcttcggtaagtattagtagattttaactaattctttcttgtctaagaaatctttttgactccataaaaatgtgatataaagcatctttcataaaaaaattttaagctgcagtgaaaagtaaatattgtacagatgtacatgagaatattttggttttactcaaaggttggtagctcttaaaccacaggaattgttttgccccaggtgagcttactttttcactacttacatcttctcacatttcccggttctgcattatgtccagattgctttttaaaaaataaatgctaaggtgcttgctatagtctgtcaggtacttgagctacctgtttgctcccttggatacagctggactctttaatcagtcctcctgaatagattgctaccctggggcacaatatgtgccagtgtgatggaaacattctccttggctttactagccagtcaaatcccagtccagaattgatggaagctatttacctgtgagttaatgtgcttgttttagcaagcttgattcccattagaccaatgtgggcagaggtctgagggggttcttctcaattttgctgttagataccactaaactattttgtattaaagaacagtatctttttgtgaatactcttgtgtaaatatattcaaaggcactgttcatattttagggcttgtattataatttgcaaggttttaatgctggattctgcatgtctacacatacaaagacagggcttgctcctctgcaaaactgaggaagacaggtttattggcttggtcatgaagtaacagaaatggtcacactgatcatgaaatgcagcaagttttgtgcaaattaacatagtctcttatttattgcttttgtaaattgaataaagatggacttctatgtaaatagactgctgaatcctgtattaccacggctactaaaaattagtgtgtaaagaatgcattcttcattgtaaacttaaagtattttatgtacttctagaaatgacttaaatttgttttcatacattatgaaaacaactgcatactccttaattgctttaaacacccatccactgtatgtaattctaattaccttataacagtattaagacagcttgtttgtactgtgcaatttgaacaaggaatgcaatgttattttttacaaaaaacaaacttgtttatttttataataacgatgtatttgatgtggaccaaattcgtaccactatctaaaatagcctcttttctcatagtgcagttgtagtttagaaacaaaacttggtcctctctccttgctttttaaagtaaatggctagatttagttgtcttagccaggtttcctttgaagagaaactcaaaaccattttgaaactgcttagttcagaatacatcgaagtatttaaaattactgagttgggtaatttactatcatttactttttacattacaagtgcaataatatttcacaaaatgaaactcccgaatgggtggagtatgtgattattggtacctggtccttctggtgctatttttatttaagtctttgtttcaaaccacctttccctgaatcttaaagataatgttttgcatgtgagtacatgcagcccagcaagaaactaaactgaactctcttctcctatcctagtccattaaggagaagaaccagcattgcttttgtgtttggtgtgaatattcagtcaataaaaatgatttaccattataaagagctgtgatcttttcaagtatctgaaataaaacactgtgctgctgagttcatctcaaacattcttgaaagcagggcaccagtataagttaactgtattcctgtgggttaggccgtgaatgaatcatttcttttatacaatattcttttacaactaatagagataggaggcccccaggcaagaagtttggcaggtttacagaaaatttggtaatttatttgttatataccttaatttttaaaaacccatttttattgtggtgtttggttcacatatcaactgtttaagccataattttagccaatgaatttaaatattcagtataactatttgaggtttactagatgcatttattaataaattatttgctgaaaccaaaacaagtcattgggggtgtgggaataaaatcaacctttgcttgtaattaaagttgctgctatttctgtaatgtgtatttttctccccttggtaaagggcaataaaaccattacacaa

SEQ ID NO: 1475 - DNA, 140337 bp, Homo sapiens
cgtcagcttgggggtgccttcgtcgcgcagccttgcgtcggcccggcccggccaggccagcgggcagatgccccgagctgccgccgccgccgccgccgactcggccggtggcggtgtgggaggtgggcgaccagcccggggccgctgagtgtgacggacgcaactgggggcgccgggggctccgcacggaccatgtattttctgagcggctggcccaagaggctgctgtgccctctggggagcccggccgaggcgcctttccacgttcagtccgacccgcagagggctttcttcgccgtgctggccgcggcccgcctcagcatctggtacagccgagtaagtagagccgcccgccgcctttcgccgctgcctccccggcctcccggcgccgtcccacccccaacttccacccagagcctaggactcctgccccttcgtgccagacccacctgccttcgcagtccgcgtcctcgttccaccgaattggccgcaggtacccgccggctgcaggcacgtcctccagccggcggtccggggtggatgaagtcgctgctgccgaaaatccctgagcctccccgcgttggaccgacggccgcggcgtgcagactccgcacgctccccggccgagcccagacttgttcttctctcccttcccccattccccgagggacaaatttgtttaaactttccacaattagaaatccggccgctgtggtgccccaaccctcccttactttaaaggtcgccgttttggagttagggaaagcctcttgggctttacccagcgccagactttacaggcctgtaataacttatttctacaaactacagcctgaattctttattcttcactaaaggtctggttatttaactcccctctttaaccccaacatcccttccccactttcgagttggtctttttctttgctgctgctcttggactcttcggaatagggggttaaaggagcggaagtagaactcaaatctgtccgcggaactcccagttataacacctggaaataataaggcttgggaggagcatggaactgaattctgtttttgctttaagtcctggttatctttttctttcttgtattgaattactgagtagatatgagaaagaaataagtggtggatgggatactccctactctctgcaaacactgctataactttgtctatgagaacgacagagttcagagtataaaaatgctttttttcctccccaaagaaggcagtaccaatcgatgtcagagtgaagtttttctcctttccaagttaatttgaccatgtggggataggttgtgatcttgtccttattaggtgttcgtgaaatactggttttagtttgttaaaatccccaaatctttgtgtgttgctgttccattacctgtaatgcccttgacagtcctcacccacttccctggtaatactggtgatgggatttagtgacgggtaattctggtgtctcctttgactgtcatagttgggctgtaaatcagactatttgccatcaagttttggctgatctaattttcaaatgcaaatcagaacaaaacaaacttataaaatcgtaataccaacaatatgactattttgtctagtgcctgattgtattttgaatatatatgtatgtatgtgtgtgtgtatatatataaacatatgtgtaaatatatataaagtatcatctggttcctaaatgagatattcgtttacaatgtatatgccagttgaataatttttaatttgtttaggtgtatataactcaactttaaagcacatgcagaaaaaaatagaacttgaatttaaattgtcttttgaatttaatacataattccttttgaatgtaacaaatttagactttcgtctaaaatttaacttttcttacctttaaaaaggcagacctaacttaattttaaataaaagtaaacaatatgacctatgaattgaccagaagcctgtaaaccactttattcccccataagagaagcataaacatatgctttaatttagggacattgtgaatattcttaagcatgtctattgtttggttttggagttacatacgacatctagaaatccaaggcagttctggaatttaaactattcatactcttctttcaaattcccacctcacatgcaacttcctttttccacagaagtccagggacccctactattaagttctgttgtgcaaaagttaggctgtagggaacccatgggtttagaggtctggagtgaaatgaaatgcaggaataccttagaggaggctgtatagtactgtagtatgagtggttaaccttggtctctgggcaccagctttgttgtcactgaaaaaaatcagatattcacgaggtcaagagatcgagaccatcctggccaacatggtgaaatcccgtctctactaaaaatacaaaaaaatagctgggcgtggtggtgcacgcctatagccccagctactcgggaggctgaggcaggagaatcgcttgaacccaagaggcagaggttgcagtgagccaagatcccaccactgcactccagcctggcgacagagcaagactctgtctcaaaaaaaaaaaaaaaaaaaaatcaaatattgaaccaagtgattataaggtgtatgattacatgcctaggtgagtgggatacatatgctagactccagcttccaatcttctcttcctgggatatgccctttcttactctgtatgaaagttttcattttgattttctaatttgtaaacttcctgaaagtatgtaagttaattaggttaacaaacttcatttaaaagtgaaaatgcctttaggtaaattaaagggctatcagttatacttccataatttagagtgaattggtttaaaaagttctcatggagctgctaaaagctttgatttttgagaggctgtagatacaagtagttttataataatatgtgaagatctacaggattttacagagttgaagtcttacagctgcttgagggcatttgaaggcagggagacatgctcgtagagatgataaaacaagatttgcttacctgaaattttgttagggctcacttagtaaatcaggctctcttaggagtgatatattttaaaaagagacaactagccttgtggaagggacagtcgtttagtagtctaagctggttgtttcaatgttcaaaagaattgtggaaattgtatgtgtacagtgataattcataagactgaatctctattaaaatctctaactgtacattatatgggtcttctaatgaacttttatgtactacttatacctactgtcctctattctaagtaggtattcggaattccactgtttagactcatatctcttcagaattatttcctaccccaaatttgagaaatacagtatagtgttgtttatgaacaaaagagcctctagatagttacttagcttttttatattggagccccaatattatattttggagccccccaaatggtgttaaaaaaaggctcagtatgtgtaggctagattggggtggtagaggtagaacttgactgggggcagttggtacatttctgctaaggttattgtaaaaggactagtttcagctttgaggatgaaactgttgcataaggtaggttatgatttatgattgacgtaggtgtagtgtgagatgaattacattttgtactgtactgagggcccagaattattcctttaatatactaactgtgactatgaaagtctatatatgtgaacatcagaatggtatctttgaatttagccattctaaattagatgtatagacattctcgtttttcaggtcaccgactttaaacatttaaattagcttcagaagtatttttgaacatcaactgtaaaagacagatgtgtataaaagggatgaagagacatgttatatgttagtgtgttagatgttagtgtgttaatataaatcttgtgagatatcactgttgtaggtagctaataaaaagctgaaatgggcaaataattactaggcttataaaataaattatatgtcgtttagtaatcctgagcaaaaacttagttcccattggtatgtgctaatcatggaaaaaaacaatgatatgtcaaaagaaccaagctttggatcaggtatgtgattaactgtgttgacctcaggaagaccattttatttgtattttcccagcattcccatttctcacccttttaactctattactttctccagagagccttctttataaattcactgctctgaagtcttctagggttcactgttgatgaaagaatggagttcaaactccttagtttgatatcacagacactcccttcttggaatgctctcttgcctcatttctgcctgtcagagtattatctatcctttaactgctgttgaaatcctttctttatgagtcattctttacctaccgtaaccataagtgttcatttttctgatgaactactgcttccccactactgccagctttgttgaggtataattgacaaataaaaattgtatatatttaaggtgtgctgtgcgatacttagatctaccctgtgagttgataatcacaatcagtctaattaacagatccaccatctcacacagctccctctttttttgtatgtgggatgagaacacttaagacctactctcttagcaaatttcaagtatacaatatatgttaattatggaaataaatgtcattattaacgatagttactgggccatgcattaggtccccagaacgtattcatcttatacctgaaaatttgtacctttgactgaaatactcccatttcacccacctcccagcccctggtaatcatcgttctattctctgttcctatgaatttgacgtctttatattccatatatgagatcatgaagttgttttttgtcttgcttacttagtatactgtccttaagttttgtccatgttgttgcagatggcaggatttccttgttttttaaaggctgaataatattttatgtgtgtatgtgtgtgtgttacattttctttatccattcatctattgacagacacttaggttgtttctgtatcttggctactttgaataatgctgcaatgaatatgaaagtgcagatatctctttgagatactgatttcaattcctttggatatatacctagaagtaggattgttggatcatgtggtagtcctgtttttagtttgaggaacttctgttttccatcatgactgtaccattttgcagtcccgtcaatagtgtacagggaggggatcccttttctccacgtctttgccgaccttgttatgatttaacttcttgataatagatatcctaacaggtgtgaggtatcttatggttttgatttgcatctccctgatgattagtgtattgagcacctattggccattggctgttttttggtaaaacatctgttcagatctcttgtccatttttaaattaggttatctgttttgtttttttctcggtactgagttgtatgagttccttacatatcttgaatattagcccccttttagatgtatggtttgcagatattttctcctattccataggttgcttttttatcttgttgattgttttctttactgtacaataacttaatttcatgtaatcctacttgtttatttttgcttttgtcacctgtgctttccatgtcatccaaaataccatcgtgaaaacagatgtcagggtgtttttcccctgttttcttctaggatttgcatggtttcaggttttacatttaagtctttgatccttcttcttattttaatttttgtgggtacatagtagatctgtgtatttgtggggtatatgggatattttgatacaggactatagtcaccctgttgtactatcaaatactagattttattcatcatcatcaccattattattttgagacagggtctcactctgtcactctggagtacagagtcatgatcatggcttactgcagcctcgacctcttgggctcaagcaattctcccaccttagcatcctgagtagctgggagtacagatgcatgccaccatgcctagttaattttttgaagagatgtggtcttgctgtgttgcccaggccggtctcagactcctggacacaagtgatctgcccatctcagcctcctaaagtgctaggattacaagcatgggccaccacacccagtccttattcattttttctattttttgtacccattaaccatccttccttccccctccgtctttaatccttcttgagttgatagtgtaagataagggtccagtttccttccttagcatgtggatatccagtttttctaacactatggtgttgaaaagtcagtgttgcaagatgtgttttctccattcttagcactttgtgaaagattgactatatatgcatgcgtggttttatttctggactccattctgttgcattggtctatgtatctctttttatgtcagtaccatactattttgattactatagctttgtaatatactttgaaatcaggttgatatggtttggctctatttccccacccaaatttcatctctaatcgtaatcctcataatccccatgtatggagggcaggacctggtagggggtcattagatcatagcgggagttttcctcatgctgttcttgtgatagtaagttctcacgagatctgatggttttataagtgtttgactgttccttctacacgctctgtctctctcttgcctgccagcatgtaacaagtgcctgcttccccttctgccatgattgtaagtttcctgaggcctcaccagccattatggaactgaatctattcaacctttctttataaattaccaaatctcagggaagtttgttatagcagtgtgaaaatggactaacacacaggtaatgtgacacttccagctttgttgttctttctcaagatggccttggctattcatgggctattgtggttttgtataaattttaggattgtttttctgtttatgtgaaaatatcattgaaattctgatagagattgcattgaatccatagattggtttggatagtagggacattttaacaatattaattcttccaatccatgaacataagatatccagccatttatttgtaccttcttcagtttatttcatcagcattttatggtgtttagtggcggttaaatgtattctaagtatttagttttttggagctaccataaatggtattgttttctttttctttttctgttttttttagacaaagtctcgctcttgtcaccgaggctggagtgcaatggagcgatctcaactcactgcagcctctgcctcctgggttcaagcaattctcctgccccagcctcctgagtagctgggattacaggtgcctgccaccatacccggctaatttttgtatttttagtagagacagggtttcaccatgttggccaggctggtatcgattcctgacctcagttgatctgcctgcctcagcctcccaaagtgctgggattataggtgtgagccaccactcccagccatgttttcttaatttattttttagatactcattgttcttgtgtagaaacacaacttattcttgtatattgattttatatcttgcaactttactaaattcatttcttagttctaaattttttggtggtttttaggtttttctaaatataagattatgtcatcttcagagacaattttgctttttcctttgaactactgctttatatcgtaagttttgcacttatgctttatttctccagctagattataagtttctggagcacagaaactatcttaatttgtattatctatagtgccttgtacaaggaagatgtttaataaacatttttaatattaatgaatttaaggtatttgtcatacgtgtggcacagcaatttttttttaagttttagtgttttgatttttgtgagaacacagtaggtatatatttatgatttttttgtttgtttgtttgtttttgagacagggtttcacttcagttgcccaggttggagtgcagtggcacaatctcagctcactgcaatctctgcctactgggctcaagcagctgtcctgcttcagcctcccaagtagctgggactacaggtgtgccccactgcacttggctaatttttttttttctgtaattttttatagagatgggatttcaccatgttgcccacgctggtcttgaactcctgagctcaagtgatccatccacctcgggctcccaaagtgctgggattacaggcatgagccactatacccagccatgagatattttgatactagcgtgcaatttgtaacaatcagttcatgaaaaatagggtattcatcccctcaagcatttaaccttcatgttccaaacaatccatatgtactcatagttattttaaaatatacaattaaattattttgactgtagtcaccctgttgtgctatcaaatactaggtcatactcattctctttttttgtacccattagccgttcccacctcccttcctatccccccagttacctttctcagcctctggtaatcatctttccactctttatcaccattagttcaattgttttgatttgtagatcccacaaataagtgagaacatgcgatgtttgtctctctatgccttgcttattgcacttaacataatgacctctagttccatccatgttgttgtaaatgaccggatctcattttttttgtaactgaatagtactccattatgtgcaagtaccatgttttctttatccatccatctgttgatggacacttccagtactgtgttgaataacaatagtgaaggtgggcatctttgtcgtgttccagatcttagaggaaaggctttcggtttttacatactcagtatgatactagctatgggtctgttatatatggcttttattatgttgaggtatgttccttctatacccagtttttttagggtttttatgaagggatgttgaatttttatgaaatgctttttcagcatcagttgaaatgatcatatagttttggtccttcattctgttgatatgatgtatcacattgattgatttgcatatgttgaaccatccttgcatccctggaataaataccacttgttcatgatgaatgatctttttaatatattgttgaatctcattagcttgtattttgttgagggttttcacatcagtgttcatcagaaatattgacctgtagttttctttattgatgtgtctttgtctgggtttggtatgagggtaatcctggcctcatagaatgagtttagaagtactccctcctcctgtatttttcagaacagtttcagtagtattggtgttcttctttaaatgtttgttggaattgagcagtgaaaccactaggtcttgggcttttctttactgggagactttttattacaggttcaatctcactgttgttagtctgttcaggttttgaatttcttcatgattcaatcttggtaggttgtatgtgctagggatttatccatttcctctagattttccagtttattggcatatagttgctcatagtagtttgtgatgatcgtttgaatttttgcggtatcaattgtaatatctcctttcttatctctgattttatttattttggttttctcttttaaggtttgtcaattttgtttatcttttctaaaaagcaactttatgtttctttggtcttttgcattattttcttcatttcaagttaatttatttctgctccatctttattatttctgttactaattttgggttgtttgctcttgcttttcttgttgtttaagaggcatcattaggttatttatttgaagtttttcttcttgttttctgagacagggtctctctttattctccaggctagagtgcagtggtgcaatctcgtctcactgtagcctcaacctcccaagttcatgtgatcctcccacctcagccccctaaatagttgggactacagttgcatgccaccgtgcccagctaatttttgtagagacaggatttcaccatgtttcccaggctgttctcaaattcctgagctcaagcaatctgcccacctcggctcccaaagtgctaggattcaggcatgagccactatacccggccatttttcttcttttatggtgtaatacttatagctataaatttctctgttaatactgcttttgctgtctcccataacttttgatatgttgtgtttccattatcatttgtttcaataaagttttcagtttgcttcttaatttctgcactgacccattggtcattcaggaacatattgtttaatttccaagtgtttatatgatttccagaattgttcttattgatttctagtttaactctattatgagagaagatgcttgatattatttcagtttttttgaatattttaagatttgtgacctatcatatgagcaatccttaagtgatccatgtactgagggaaagaatgtgtgttctgcaccctttggatgaaatgttctataaatatctgttaggtccatttgttgtatagtgcagattaagtccgatgtttctttgttgagtttctgtctgggagttgggttcagtgctgaaagtgaggtgttgaagtctccagctatcatattgaggtctagctctctctttagccctaataatgtttgctttgtatatctgggtgtgttgggtgcatatgtacatatgattgttatattctattgctggattgactcttttctcagtatataatgacattctttgtctcacaatttttgtcttgaaatctattttgtcagtatttatataattactcctgctcttttggtttccattggcatgtaatatctttttcatccccttattttcagtctatgcatacctttgtatgtgaagtgtgtttcttgtgggcaacagatcagtggatcttgttttttcatccattcacccactctctgtcttttgattggagagtttggtccatttgtattcaatgctattattgataagtagggacttctgccattttgatatatattttctggttgttttgtggtcttcgttctttctttacttgctgtgttccttttagtgaaggtggttttctctggtgctatgatttaatttcttgctttttatgttttgtgtatctgttgtgttttttgatttgagtttactgtgagacttgcaagtactgtcttataacccattattttaaactcacgacaacttaacactgattgtataagcagtcaaacacacacaaagtgtttaaagtgtaattaaaagtgtaattaaaactctacactttaacttcatccctctacactttaacttcatccctctgctttttaacttttttgtttgttgtttctccttatgtcttactgtactatgtcttgaaaagttgtcgttattctttattggttcgtttcatcagtctttctacttaagagtagtttacacactacaataacacttataaaataagaatcattgttaggttatttatttgaagttacagaataagagtgtaattgtgctgtgtaaactactcaagtagaaggagttatactcttctgtgtttttctgtgtgcttactattaccagcgagttgtaccttctgatggtttcttcttggtcattaaatactcttttctttcagattgaacaactccctttagcatttcttgagggcagatccagtgttgatgaactctctcagcattttttgtctgtgaaggtctttgtttctccttcatgcttgaaggatattttcactggatatactgttctaaggtaaatgcttttgtttgttttttttgtcagcactttcaacatattgtgccactctctcctggcctgtaagatttttactgaagagtctgctgtcagagatattggagctctattgtatgttatttgtttcttttctcttgccgtttttaggatctttctttatccttgataaagaaactatcctttgagagtttgtttatagatgccataaggtagtcttcttttttttttttttggacggggtcttgctctgtcacccaggctggagtgcagtggtgccatctcagctcactgcaagctctgcctcctgggttcacgccattctccagcctcagcctcctgagtacctgggactacaggcgcccaccaccacacccggctaattttttgtatttttagtagagatggggtttcactgtgttagccaggatggtctcgatctcctgacctcatgatctgcccgcctcggcctcccaaagtgctgggattacaggcatgagccaccgcgcccggccgccatgaggtactcttctttaggttaaatctgcttggcgttctgtaaccttctcatacttgaatgcagatatctttctctaggtttgggaagttctctcttatccctttgaatgaactttctactccggtctctttctctacttcctctttaaggccaatacctcttatatttgcccttttcatgctattttttaggcatgcttcactgttttctattcttttttcttttgtggtctcctctgactatattgtcaagtagcctgtctccaagcccactaattctttcttctgcttgatcaattctgcttttcagagactctgatgcattcttcagtttgttggttgcatttttcaactttagaattgctgcttgatttttaaaaatttaaatttctttgtttaaaatgtgatagaattctgaggtccttctctgtgttatcttcaatttctttgactttcctcaacatagctattttgaattcctgcctgaaaggtcacatatctatctctgtttttccaggattggtccctgccttacttagttcatttggtggggtcatgttttcctggatgatcttgatttgatgcttgtagatgttcattggtgtgtaggcatcaaagaggtaggtatttattgtagtctttgcagtctgggcttgtttgtatctgtcctttttgagaagtctttccagttattcgaagggacttgggccccaagcccaataatgctgaggtttttgcagactcagaggtactgccttggtggtcttggataaaatctggaagaattatttggattaccacgtagagactcttgttcttttctgttactttcttccaaacaaatggagtctctctctgtgctgagtctcctggaactagggatgtgttcatgcgttgatgcaagcacccctgttgccaccaccactgaaactaagctgggttagacctgaagccagcagagcactgggtctcatccaaggcctgctgtcaccaccacctggctaccacctatgttcactcaaggccctaaggctctaccatcagcaggtggtgaagccagccaggtttatgtccttcccttcagagtgtctcattccccaaaccccaggccagtccagaaatgctgtctggaagccagggattagagtcaaaattcttagcaatttgtttgatattctgttctgttgtggctaagcaggcactcaaaccgtaacacaaaattcttcccactttttcccctgtccacaggcagaggagaatctgcctctgtggccaccactaccacagggccatagtgggttctgcctggccactgccgggcagtcatcttcaggtgtttatgaatcattaacataatccatattatagttaaatatttatttggagtttactgtggactaggtattttacatcatagtaagcaaagtttcccaaatttaagttctttttatttctcattcatgacttttggcctgttctcatactacctattcattgtaacttttaaacttgaaagtctctttcaaaataaatgaatttatacttttaccataaatggaaatctagtaccatttttatgaatagaagatattatgaaggaatacaataaaaacaattttataagtctgggcatggtggctcacacctgtaacctcagcacttttgggggcctaggtgggaggatcacttgagcccaggagttcaagaccagtctggacagtatagggagacccccatctctataaaaaataaaaataaaaaaatcagctggccatggtggtgcatgcctgtggtctcagctaatctggtggctgaggtgggaggattgtttgagcctgggatgtcttgattcataaacacatgaagatgactaaaatctccttttaaatttgtttatactgctttttcttctatggctttctttttttcatagatcatgtcaatataaacacatactgagaaccaggagtttgagtgattctatatgaatgactgtatactatttaaattttgatgaactacagagtagtttgagcctaggaggttgaggctgcagtgagccatgattgcactatggcaacccagccaggatgacagggtgaaaccctttctcaaaaaaaaagttatgaaaaatatggtttcctgccaaactcataattactcctttattaaaaagggcaattagccctttttatgcaaggtgcttaaaaataaactagcacctcatttagatactctccttacgtaaataaaaaagattgaagaggagttgaaaaaagatttttttcctatgtgattgtttacttcagtatttgtatgtcatctaaaatggtgatataggacctgcattaaagtgttccacctgtattagtttgttaggcaatttatttaatcagaaaaaataaaataaatttacaatttaaaaatattttggaatttacacctgccacaaaatgagacagtttcttcgttcagatttcttactcatgagcaggcatcaattggttggaatcagagaggtttcttacctttaagttacaattgctttcctttgagttgctgtcacaaatctactgtcccccaagtagtttaccttatttcaaccataaatcatacaaaaatttacctatgaaaatttggatattattgtagataatactgtagaatttgctatggtttaaatttttaagagctttgaggtgcataaaaatacatctaagtgtacattgatttttagtaaatttatagtgttgtgcatccataatcacagtctagttttagaacatttatatcagccttaaaaagtactatgcccatttgtcatcaacctcttctcccattccagccttagaaaaccttggcctactttttgtccatttgatttagctttcctagaattttcatatcattggaatcatatggtatatggtcatttgtgtttggtttttatttagcataatgtttttgaggtgcatccaggtcataatatttcttttttcaaaatgtgtgtaaactaagggatacaagtgcagtttttttacagggacatattgcacagtggtaaagtctgggcttttagtgtaatcatcagctaaagaatgtgcattgtacacataagtaacttcttatcctttatccccttctcatccttctgagtctggtatctgttattccacactctatgtccatgtggtagtattcctttttgttgctgaatatttttccattatttgcatatgccgcatttctatctccattcaccagttgacaggtatttgagtcattgtgaataatactctcattttgaatgattgtgagtaatactgctgtaaacatttgtatacatgtctgtgtgtggataaatgttactcttctagagagatacctaggagtgcaactactaagtcatatggcaagtttaacttattggtaaagtgcaaaactttgttccaaagtgactgtagcattttacaaccccaccaataatgtatggaagtttctgtttctccacacccgttctagagggtttgtagtggtgtcttatttgtggctttaatttggtgtttttctaatgactaaaaaatgtttggcatgatttcatttgcttattagctatttatatatcttattccatttatatatcttattagccatttcgctatacctatgtagttaattatctattcaaatcctttgtccatttaaaaaaaaaacagtgatctgatcttgggtcactgcagccttgaactcttgggctcaagtgatccttccaccccagcctccctagtagctgggactacagatgcccaacagcatgcctcacttatttaaaaattttgtagagacagggtctccataagttgcccaggctggtcttaaactcccatcgtcaggctatcctccgaaagtgttggaattacaagtattagccatgatgcccagaccatttttgtttaagtggaatatttctcttattattcagttgtaagagttctttatatgtcttgatacaaattatttagcagatatatacttcgcaaagttctgcagcattaagtacattcacattatcatgtaaccattaccaccatcagtatccagaactttcattttcattttcccaaactgaagcttcgtaccctgtaaatggtaattcctggttttctcatcccatcagtccctggaaactactattgtattttctgtctttatgaatttgatttgtgtgggtacctcagacaagtggaaccacacactatttgtctttttgtgattgacttattgcactcagcatgtcttaagttttatccatgctgtagcatgtaccaaaatttccttccttcttaaggctgaatgatactccattgtatatgtacatactgcattttgttttattcattcatctgttgatggacacatgggctgcttttacctcttggatattgtgaataatgctgctgtgaacatgggtagacaaatatccagatccctgctttacttcttttgggtacatacccagaagtggacctgctgtttcatttggttattctataggttttttttttttttgagaaattttgcttttttttttaatgttaagaaattgccacatactgtgtttccacagtgtacatcattttacattcttaccagcaatacagtggttccagtttcttcacatccttgctagtacttgttttctgttgttttgatgattgccattccattgggtccaatgtggtatgtcatggttttggtttgcattttcctaatggttattaatgtcgagcatcttttatgtacttgtaagtcatgtgtatgccttctttgaaagtgtccgttgaagttctttgcccattgtttttcttgggttattttttgttgagttgtaacgcttcatgtattctgggtataatcctttatcagatatgtggtttctaatacagttatgctccatgtaatggcagtttgagatgttcctgtcaacagactgcattatatgatggtggccctataaaattctaatggagctgaaaaattcttcttgcctagtgacaatagaaattttatatagtgtaatgcattactttttctatgtttagaagtatttagatatagaaatatttaccattatggcacaattgcttatgtattcagtatagtaatatgctatataggcttgtatcctaggagcaatagggtataccttatagccaaggtgtgtagtaggccataacgtctaggtttgtgttaagtacccactgtgatgttcacatgatgacaaaattgcctagtgatgcatttcttggaacttatcccctcttgttaaagtgacacgtgactgtattttcttctgtttcaagggttacatttttactctctttgtagtagccattgatgcacagcattttcaattttgatgaagtctgtcttacctatttttttttgttgcctgtgctttcagtatcatatccaagaaattgttttcaaatccaaagtcatgaagtttttggcttgtgttttcttctaagagttttatagggtgaggtcttctgtttagagttttgatcactttgagacaatttttgtatatagtataagataagggtccagctttatttttttacatgtggatatccagttttcccagcactgtttgttgaaaagactttctttccttttcccctttgaatggtctaggtagccttgtggaaaataatttgactatttatgcaagagtgtatttctggactctgtgttttattctgttggtctatatgtgtatccttgtgccagtacgacagtattttgattgctgtagtcttctagtaagttttgatgtcaggaaatgtgagacgtccaactttgttattttcaagtttgttttgtctattcgaggtctcttgggaatccatatgaattttaggatggatttttctgtttctgctaaaaatgctgttaggattttgaaaggacttacattgactatgtagattgctttgggtagtattgacatcttaacaatattaaattttctaatccatgaacagaggatatcttttcatttatttgtgtctaatttctttcagtgatattttgcagttttcactgtagaagtcttttgcctgcttggttaggtttagtcctaagtactttattctttttgatgttacggtttgctgatttttctgtgttgattttgtattctgcagttttcctgaattcattcattctaacaggtttgttgttgttgtggaatctttagagtctttacatataagatcatgtcatcttcaaacatataattttacttattcatttccaagttagatttattttatttcatttccttgctgattgctctggctagggctttaggtattacgttgaatggaagtggtaagaatgggcatctttgtcttaattctgacctttgaggaaaagctttccatcttttcaccattgagtttgatgctggttacaagttgttgttttgttttttgtttttgtttgtttgttttttgtttgtgtgtgtgggggtgggtggtggtggtggtggtggtggtggtggtggtggtgatggtggtggtggtggtggtagtggtagtggttttttcttgctctgttgcccaggccggagtgcaatggtgtgatctcggcttactgcaaccgccacctcccgagttcaagcaattcttctgcctcagcctcccaagtagctgggattacaggcgcccgccaccatacccgactaatttcttgtatttttagtagagacagggttttgccatgttgttcagactggtctcgagctcctgacctcaggtgatccacctgtctcggcctcctgaagtgctgagattacagctgtgagccatcatgcctagccaggtataggttttttatatatggcctttttattatcttgagatagtttgcttctattcatagttttttgagtatttttagcatgaaaggatattgagttttatcagatgttttttctgactcaattgaaatgattatctgttggtggacacttaggttgattccatatctttgctaatgttaacagtgtggctatgaacttgggggtgcaaatatccctttgatgtatttattttgtttcttttggataaatacctaacagtgggattgctggatcatatggtagttctatttttacttttcgagaaatcttcatactgtttttggtaatggctgtactaatttatatttccaccacaggagttcccttttctctgcattctcatcaacatctgttatgttttctttttaataattgctattctaactgggttaagatgatatcttgtggttttgattttcattttcctgatgattagtgatgttgagcctcttttgatgtacctgttggccatccatatgtcttttgaaaaaatgtttatgtcttttgcccactttttaatgggaatgttttgttttaactgttgagttgtttgagttccttgtatattctggtttttagtttcttgtcagatgcatagtttgcaactattgtctaccattcaaaaggaaggttatttctttactctgttggattgtttcctttgctatgcacaaaacaagtctcaaaacattttaaaactctgggaggctgaagtgggagaatcatttgagccagggaggtaaaggctgcaatgagctatgattgtgccacttcactccagcctggcaacagagatagaccctatcttaaaaaagaaaaaaaaaattaaactcaaaactatatcaagtgtcttcttagaccacagtagaatcctcaaactagaaattaataccaagaggaacttagaaaactgtctaaataaatggtaattacatagaatactcctgaatgtccattggttctttttctgctcctttgatcttgtctttgccttctgtaacaccaaaaattcaaatagatcactttatggtgtcccatatgtcatgtaggctttgttcattcttatttattcttgttttgttttctgagttatttcaaaaatctgaaattcattcttctgcttgatatcatccattgctgaagcacttgaatgtattttttattccacttagtgaattcttcggtttgaggatttctgtttggttccttttttatgatatctatctttttggtgaatttttcattcatatcttgaattgtttttctgatttctttgtatttttgtgttctctatctcactgagtgtctttagtattattttgaatcctgttgctggcatttcataaatttcttttttattagaatctgttgctggggaattattgtgttcctttggagatgtcataatttcttgttttttttttttcacattacttgtatacttacaagttgatgtctgtacctctggtgtaacagttgcttcttccagttttttagattggctttcagagaggtagactttttcctgaagatctatccgtggtgttggttgggtagggcaccttgtctttgattctgggtgtgtgcagtagtgtatttttcatatgacctttttagccatatatagcattagtggtgtctgtgatttcctcagtggtttagggtgcaattgttagcagaggctgaggtgaagttctcctgggcagtgggatgctaggtaggccagtccttgggcaccagtggtggcagcagcagactgtgtgcctgtccttcggccccagggtacacaggcatggtgttagcaggtttaattgggttgattcttaggcctccatatggcttgcttaggtgctggtggttgcagtggatgaccaggtgagtgggtaggtccttggatccctgggcagtgcatgtggtatgggctatggcagtagttgtgatggtagcatcaggctgggtgggctgactctcaggcttccctgtaggagtgcgtatgtgtgagtggcagacagggtgaggcaatctctatgctccaatctctatgcttgggcccttgggggtatgtggtgccaggccaggtgggcctgtcttcaggccccctggtagagtgctcaggtagcaacagtggatagagagagccttgcctcagggcatgtgcatgtccactgtggccctgctactagaggggatagggttggtgtcggtgtcagtagcctcacaccagaggctggggtggggcaggtatggtatgctttgctccaagcagtgtcaggaacattgacactggcatgctgggagattctgtcctcaggacatgttcaagtgtgctgcagtcttgctgttagtggagatggggttactgtcagtggcagcaaccccaggctagcagggtttaggctctcagaagtgtacgctttggctctttttgtccttgtgatagcctccccagtataccctccccagtgcattgcacttgcctgttctccacagtgtaggattttatatatgctttaataccagggactctgccactctgctgggtccaagtggcattgcatcactgtaggcccccaggtggatgcagggaatgttagtagggctttactaatgtggaaatgcagggactcttgtgctcaagggcaggatgcagcctgttaagagctggactgaaaatgacaccatgctgtaactgtttaggtctcatgcaggtggtacaggacccagtgtgagctctctctctggagcagtgtcatcacatggtctctaagaagttctctatgctagtctctggaccccctctctgtaagctagggttgcaggagtccgtggtgggagtgtgagctgctgggtatctctcatttacctttcccccacactggagatctgctctgtgctccaggtcgataaaggccaagcaaacaaccttgcttccctcttcttccttgctttaggtgtttcctgtcacttctctgctaaattccagtgttgtgtcttagatgttctgttgaaagtgtgactcctccctgtttgggttttttttttgtgaaggaggcaagggctgatgtctctagtcagctatcttgaagcccctcctctatttttgctgttgttgcctgtgcttttcaggtcttatccaaaaaattccttgctcagaccaatataatgaatcatttcctttatgtttttcttccagtagtttcatagttttgggtcttacatttaagtctttaatcttttttttttttttttttttttattgagacagtctcaccctgtccttcattcttgagtgcagtggtgtgatctcagctcacttcaacctccacctcctgggttcaagtgattctcctgcctcagcctcccgagtagctgagattacaggtgcatgccaccatgcccagctaatttttgtatttttttttattagagatggggttttgccatgttggccaggttggtctcgaactcctgatctcaagtgatctgcccacctcggcctcccaaagtgctgggattacaggcatgagccaccgcacctagcctctttaatctattttgaaatgagttttgtgtatagtaagataagggtctaatttcattcttttgcatgtggctatccaggtttcccagcaccatttattagattatcctttctccaatgtgtgctcttggcacctgttttttgaaaatcagttggctgtaaaagcatggatttatttctgggctattttgttccattgttttatttgcttttattgccagtaccatggtgttttggttaatacagctttgtagtatattttgaagtcaggtagtgtaattccactaactttgttatttttgttcaagattgctttggctatttgaggtcctctgtggttcagtatgaattttaggcttgtgttttccactgctgtgaggcatatcattggtattttggtagggattacattggatctgtagatcactttgggtcatatggacaatttaacagtattaatttttccaatctataaacatgggatatctttccatgtatttgtgttttcttcattttattactgtttcatagttttcattgtagtgatcttttacttcttcaattaaattttttgttctttgggtttttttatagctattaataagtgggattgttttgttgatttcttttttcagctaattcactattagtgtatagaggcattactggtttttgtatattgattttgtattctacaactttactgaattattttgttctaccacttttttggtggcatctttagggtttctatatgtaagattgtgttacctgcaaatagtgttaatttgacttctcctttccaattaatttggatactttttattcttttttttttcttgcctaattgctctggctaggatttccagtactgcgttgaataaaagtggtgaaagatagtatccttgtcttattccagattagaggaaaagatttcaacttttccttattcagtagtgttagctatgggtttgtcatatatggcttttattgtgttgagttacattctttctattcttaatttgttaagagttgttgtcaagaatagatgttgagttttgtcaaatgctttttctgcctctcctgaaatgatcatggggtttttgccttttattctgttaatgtaatatatcacatttattgatttgtctgtgctgaaccatccttgcattcctgggatcagtcctacttgatcatgatgaattgttgaatttggtttgctaccattttgttgaggacttttgcatctgtgttcatcaggtatttatttttgtgaatgttgacgtctagttgtttgaatactattcattgcaaagactgtcttttctctgttgtacttcctttccttgtttgttaaagatcagttggcatatatttgtgtgtgtctatttctgggctctctattctgttccattgattgatttgtttattattttgttaataccacactttcttgactactttagctttatagtaagtcttgaagtcaggtaatgccggtcttccaacattgtcttctccagtattaagttgctagtcttggtcttttgcctctctgtatcaactttagagtgactttgttgatagccagaaaataaattgctgggaatttgattgagattgtattaaatctgtatatcaagttgggaagaactgacatattgtgacagtattgagtctttgtattcattaacatggtatatgtctccatttatttttttctttctttctttctttctttctttttttgagacggagtttcactctgtcacccaagctggagtgcaatggcgcagtcttggctcactgcagcctccgtctcctgggttcaagtgattctcctgcctcagcctcccgagtagctgtgactacaggtgcacaccactacgcccggctaatttttgtatttttagtagagatggggtttcactgtgttggccaggttggtctcaaacttttgacctggtgatctgcctgcctcagcctcccaaagtgctgggattacaggcatgcacaaccacacccagcctgtctccatttatttagctcttctttggtatctttcattagtgttttgtaacttttttctatagataaacgtattgtgttacatagttttttaaaaatgctttttacattttttatgtttttgagacagcatcttactctatcacttaggctggagtgcagtgacatgatctcagctcactgcaacctctgcctcccaggctcgagcaatctcccacttcagcctcctgagtagctgggactacaggtgtgtgccaccatgcccagctaatttttgtattgttttgtttgtagagacaaggtttcaccatgttgcccaggctgcaagtgtgtattttttgtttttgtttgtttggtttcttttttttggaggtagagtctcactcttgctacccaggctggagtgcaatggtgtggtcttgactcactgcagcctctgcctcccgggttcaagcgattctcctgccacattctcccgagtagctgggattacaggtgactgccaccatgtccagctaatttttgtaattttttagtagagacggggtttcaccatgttggcgggctggtctcgaactcctgacctcaggtgatttgtctatcttggcctcccaaagtgttgggattacaggcgtgagccactgtgcccagctttgtttttgtttttgagattcagtttctgttgcctagggtggagtgcagtagcgcagtctcagctcactgcaacctgtacctcccaggtttaagcagttcttctgcctcagcctcctgagtagctgggattaatttttgtatttttagtagagatgtaaccacacctggctaatttttgtatttttagtagagatgggtttcaccatgttggccaggctggtcttgaactcctgaccttaagtgatctgcctgccttggcctttcaaagtgtagggattacaggcatgagctactgcgcctggcctgcaaatgtgtttataatgacaaattccacttttttattgctggtatatagaaaatttattgacttttgtatattaatcttggatcctgtaaccttgctatagttacttattctaggaggatttttgggtcaattctgtcaaattttctacatagatgatcacattatctatgagtaaagacagttttatttattccttcccaatctctttaccttttattcctttttgtggtcttattgaattagctgggacttccactattctgttgaaaagctgctgtgagtggagacatccttcccttgttcctgatcttagcaggaaagcgttgagctgtaggtttctcatagatcttctttatcacgttgaaaaaatttctttctattcccgagaggtttttttaaaatcatgaatgagtgttgttctgtagtttgctcagtgttttttgtttatttgttttgttttatggagacagagtctcgctcttttgcccaggctggagtgcagtctcacaatctcagctcactgcaacctccacctctcaggttcaagtgattctcctgcctcagcctcccaaatagctggcattataggcgcctgccaccacaccgggctaatttttgtatttttagtagagatggggtttcaccatattggccaggctggtcgcaaactcctgacctcaggtgatctgccaacctcagcctcccaaagtgctgggattacaggcatgagccgtggcgcccggccttgctcagcgtttttatcttggttgttagatttgttaagtgctttttctgtgtttattgaaataatcatgtgatttttctgtagcctgttgatgtgatggattatattaattgagttttgaatgccgaaccaggcttgtatttctggggtatatcgtatttggttatggtgtttaattttttttaataccttgttggatttgatttgctaatattttgttgagaggttttatatctatgttcataagagatgttgatctgtagtgtttttttgtttttgtttttgagacagagtctcgctttgtcacctaggctggagtgcagtgttgttgtgatctcggctcactgcaagctctgcctcccaggttcacgctattctcctgcctcagcctcctgagtagctgggactacaggcgcctgccaccacgcccagctaatttttttgtatttttagtagaaacggggtttcactgtgttagccaggatggtctccatctcctaaccttgtgatccgcccaccatggcctcccaaagtgctgggattacaggcatgagccaccgcgcctggcctgtagttttcttttcatgtaatatccttttctgattttggtattaagggaatgctggactcaaaattaggaagtactcctgcttctatcttgtggaaggctttgtaaagaattggtgtaatttctcccttaaacgtttggtagacttcacctatgaacacatttagtcctggttctttctgttttggatgattattaattattaattcagtttctttaataatacaggcgtaggtttaggtctttgttttggttgatatgcttgcaatgttgaaagccgatagtttaatatcaatattgtcttttattttactgtaaaaatactttgaatactctgttatcttaaattttatttgtgtatttttatgagatattgataaaaaatacaacttttttttttttttaatcacacagcctagtgtgttaattgtaacctacaaggagcctgcaaaatcatctactcagtttggatcctacaagcaagctgaatggaggccagatagtaccatgatagctgtatcagtaagtagattttaccgctaaatagtgttttcttatgaaatcattacatcgcatttaaatttgattctcttagatgactttctttcagtcttttgcactcataagtatttattttattctgataggaattgctttactgattattctatgtggattactcctactatagcttttcttctgactctgctacttccttaacaaagcacctatatccctaaacatagcacctgtatccttttctgtttgttgttctcactttactgttttgcccttgaagtctaactgctttactaattattctgtgcgtgttactcctactatagcttctgttttgactctgctgcttccttccatccctaaacatagcacctatatccttttctgtttgttgttctcactttactgttttgtccttgaagtcttatctagttttttaaaacatattcacatgatattcttgaatttatatttaaattcctcccttccattccaaaagatattccagaaaataataagctttatgtgcatatgttatactaaaatttccatatccatttggatctgtttctcctttttttcttctgttctattaaacgtgcctagatatgtttaattttaccttttcagttcatgtttcatcactgtctaaggctgtcattatgacttaatatgcattagcagtaatatatgtggttaattaacattattgagcacctcctatccgatgagtacaattgtaatcagtttacatggatcatcccatttaatctttagataagtgctttgaagtagatattattatccttcataatggatgtgtaaattgaggatctgaaaaattgtcttatccaaggttacatgcgtagtgtatattagagagataaggtataaacttagctactcagcttccatttactatatccttatatctaatttatctctttgcgttggtccctttctagtccatactgtatataacactgactaggttaatagtctgaaatgttcatatgatgaaaaatactgagtagttctacgcttcctatagcaggagtttgcagatgactgaccatgtaccaaatatgccctggtgcctgtttgtacacagaccataatgtaagaatagtttttacatatttaaataatcaaaacaagtcaaagaagaatatttgctacagttgaaaattatgtgatacttaaatttcagtgtccataactaaaattttactggggcacgaaaatcctcactgatttatgtattgtctgtaacttctttcaagctacaatagcagattgaattgaagttcttacagcaagtgtatgtggtgctctcattgctttgctcttctgttcaatgcactgtgtagtaacacagttgtaacttcataacatttcaagtgtacacatattgccattctgtgacattttatattatttttattctagtacatactcatgtcaaaagaaccaaagaagacaaaaagactttgttttgtttttaaagcacactgtagtgtggtttcttttattattgaattagatggcaaaatattgtatttattattcaatggcactatagctatgccaaaagaatataagctgacatcactagactaagcacttatcagaatgtactgaaggttaagttagaagaattaaaaaatttagcacagaacagctcaccacaaaattccttcacaaaaataaaatatgaaaatgaaagtgcagtaaaagtaagtttgcttagtttttgataaattgacagatgttataatactgctcagttgtaaatttcagtggtccatgtgaagtatgaattgactaagaattactgtgaatgacctgcagaacaattccagatgaaaaaaattctcaaaggagttgagaaaatactaattcagtacaacccgaagtagaatctaagaagttgtattaattgatagtagtaaaaatccacatggagcagcaaaagacttagttggacagatttacaaagtttgtgaaaatataagacttttaaaacctatggttagtgtaagttttttcagagatggaagcaggaatatcttgaattgccctcctccacagctgttatggcttgggtagtgataaaagtttattggaaagtttttttgtttttttttttaccgagactgacttttttttttttctttacttgaaggaccaccatctaccacttaacagacactaaataactttggaaaatagcttttgctgtattagaaaatgttttcaaatatgaattatgtaaaatgtcattaaggaccagcattaatagatgaaaatttgcactcaattttgatgatagggaaaagtactttaaaccccaatttaccaaaaaggttatttccacaaaaagaatctaattctcattagtggatgtatattaccaaaaaaagttgtactttatgttaaatgttacagtacaatatgttaaagaactattcttttcccattgaacggtcttggtagtcttgttgaaaatcaattggccattggtatttggggttatttctggatgctccattctgtttcattgttatatatgtctgtccttattccagtaccacagtttttaaattactgtggctttgtagtaacttttgaaatcaggaagtggaatcctccaattttattgttgtatttcaggatataagtcatgtcaacccattgtcaacccattgtaagttgaaaataccataagtaaaaaatttaacagccccaaacatccatcataatgtcgtaagttgaaccatcataagttcagtatcatctatagttttgactattctgagccagtccctaagatgctatatgactgtttgaactggttttctatttctgtaaaaaataccattgggaatttggtagagactgcattgaatctgtagttctctttgggaagcattaatttaagtcttccagcctatgaacatgcaatgtcttatcaattatttagaccttcaatttctgtaaggagtgttttctggtgttcagtatgcaagtctttttcctgcttcattaaatttatttttaagttttaaatttctttttgatgctattgtaaatggaattgtttttaagtttccttttcagttgttcattccaagtgtgtagacatatatctgattttttccaacttaacttcagggtacatgtgtaggatgtgtgggtttgttgcataggtaaacatgtgctatggtggtttccttgcacagattatgccatcacctaggtattaagcccagcatccattagctattcttccagatgctctccctcatcctgcgccctgcccctccatcctctaacagaccccagtgtatgttgtttcccccatgtgtccatatgttctcatcattcagctcccacttataagtgaaaacatgtggtatttgattttctgttcctgtgttagtttgctgaggataatggtttccagctccaaccatgtccctgcaaaggatatgatcttgttcctttttgtggctgcatagtattccatcgtgtatatgtaccacatttcttttattcagtctatcatcgggggacattcaggttgattccatgtctttgctattgtgaatagtgctgcagtgaatatatgcatgcatgaatgtttgtaatagaatgatttatattttggggggtatacccagtaatgagattattgggtcaaacggtatttctgcctctaggtctttgaggaattgcctactgtcttccataatggttgaactaatttccactcctaccaacagtgtaaaagcattcctttttctccacaacctaaccagcacctgttgttttttgactttttagtaatagccattctggcttgtgtgagacggtatctcattgtggttttgacttgaatttctctaataatcagtgatgttgagctttttaaaatgtatttgttggccacatttatgtcttcttttgagaagtgtctgttcatgtcctttgcccacttcttaatgggattttttttttcttgtaagttattaagttcattgtagatgctggatattagacctttctttgtcagattaatagattccaaaaatttgctaccattctgttgtttatctgctcactccaatgatagtttctgttgctgtgcagaagctcttcagttcgattagatcccatttgtcaatttttgcttttgttgcaattgcttttgtcatccttgtcgtgaaatctctgcctgtgcctgtgtcccaaatggtattgtctagattttcttcctgggttttacatttaaatctttaatcaatcttgagttcattttcctttagggtgtaaggaaggggtccagtttcaattttctgcatacagctagccagtactcccagcaccatatattacatggggaatcctttccccattgcttgtgtttgtcaggtttgctaagatcagatggtgtaggtgggtgttcttgtttctgggttctctattctgttacgttggtctatgtgtttattcttgtgccagtaccatgctgttttggttactgtagccctgtgttacagttttaagtcaggtagcatgatgcctctggccttgttctttttgctttgattgccttggctattcggactctttgttggttccatatgaattttaaaatagcttttttctaattccgtgaagaatgtcagtggtagtttaatggggatagcattgaatctataaattactttgggtagtataaccattttcacaatattgactcttcctagccatgaacatggaatgtttttccatttgttcgtgtcatctgtcatttgtttgaaagttggtttgtagttccccttgaagaggttcttcacctcccttgttagctgtattgctaggtattttattcatttgtgaccaactgtgaatgggagttcattcatgatttggctgtctgcttgcctgttgatgtataagaatgctaatgatttttgcacattaattttctatccttagactttgctgaagttgcttatcagcttacaaagcttttgggctgaggcaatggggttttctaatataggatcatgtcatctgcaaacaaagatagtttaattttctctcttcctatttgaataccctttatttctttctcttgcctgattgccccagccagaactgccaatactatgttgaataggactggtgagagagggcatccttgtcttgtgccttttttcaaggggaatgcttccagcttttgtccattcattatgatattggctgtgggtttgtcatatatgactcttattattttgaagtatgttccttcaatatctggtttattgagagtttttaacctaaagcgatgttgaattttattaaagaccttttccgcatctattgagataatcatgtggtttttgtgttcagttctgtttatgtgatgaatcacatttattgaattgtgtatgttgaaccagtcttgcattccggggatgaagtctacttggacatgatggataaactttttgatgggctactggatatttgccagtattttgttgagaatttttgcattgatgttcatcaagcatattggcctgaggttttctttttttttgttttgtctctgccaggttttggtatcaagatgatgctggcctcatagaatgaattaaggaggaatccctaattttcaattgttttggaatagtttcagtagaaataataccagctcttctttgtacctctggtagaattcagctgtgaatctgtctgtcctgggctggtttttttttttgggttgctaggctctttattacttctcaatttcaggactcattattggtctattcagagattcagtttcttcctggttcagtcttagggagggtgtatgtgtccagaaaagtatccatttcttctagattttctatttaatgtgcattgatgcatttatagtattctctgatgattgtttgtatttctttggggtcaggatgatatcccctttatcatttctgattgtgtttatttaaatcttctcttttcttctttattaatctagctagcagtctatgtattctattaatttttttaaataaccagctcttggattcattgatcgtttgaatggtctttcatgtctctatctccttcagttctgctctgatcttggttatatcttgtcttctgctagcttttgggtttgttcttgtttctctagttctcttagttgtggtgttaggttgttaacttgagatctttgtagctttttgatgtgggcatgtagtgctataaatttccctcaacactgctttagctgcatcccagagattctggtacattgtctctttgttctcattagtttcaaaggacttcttgatttctgccttaatttcattatttactcaagtcactcaggagcaggctgttcaatttccatgtagttgtgtggttttgagtgaatttcttaattcttctgagtgaatttttttgagtgttgtggtctgagagactgttatcatttcagttcttttgcatttgctgaagagtgttttacttccgattatgtgatcaaatttagagtaagtgccttgtgatgatgagaacaattagtttctgttgttttaggatggagagttctgtagatatctgtcaggtccacttgatctagagctaagttcagatcatgaatatctgttaattttctgtcttggtgatctgcctaatattgtcaatggtgtgttaagtctgctactattattgtgtgggagtctaagtctttttgaaggtctctaagaacttgctttaggaatctgggtgttcctatactgtgtgtgcatatatggaggatatttggcgcttattaaattgaaccctttatgtaacgccctttgccttttttatcttttttcatttaaagtctgttttgtgagaaactaggatcgcagtccgtggttctttctgttttccatttgcttggtaaattttcctccatccctttattttgggatgtgtgtctttgcacatgatatgggtcttttgaagacagcataccgctgggtcttggttctttatttagcttgccattctgtgtcttttaattggagcatttagcccatttacatttaaggttagtattgttatgtgtggatttgatcctgtcatcaagatactagttggttattttgcagacttatgtggttccttcatagtgtcactgatctgtttacttcagtgtgtttttgtagtggctggtaatggtttttcctttccatatttagtgcttccttcaggagctcttgcaaagcaggtctgatggttacgaattccctcagcgtttgcttgtctgaacaggatcttgtttctcctttgcttataaagcttagtttcgccagatatgaaattctgggttggaaattctttactttaagaatgtttaatattggccaggtgtggtggctcacacctgtaatcccagcactttgggaggccaaggcgggcggataacgaggtcaagagatcgacaccatcctggccaacattgtgaaaaaccccatctctactaaaaatacaaaaataattagctgagtgtcgtggcgcatacctgtagtcccagctactcaggaggctgaggcaggagaattgcttgaacccagaaggcagaggttgcagtgagctgagattgcaccactgcactccagcctggcaacggagcgagactctgtcaaaaaaaaaaaagaatgtttaatattggccccaatctcttctggcttttagggttttcactgagaggtctattgttagtctcatgggcctccccttcgtaggtgacctggtctttctgtctgactgcccttaacatttttctttcattttgaccttgcagaatctgatgattatatgtcttggggttgatcttctcagggaatatcttactgaggttttctgcatttcctgaatttgaatgttggcctgtcttcctaggttggggaagttctcctggatgatatcctgaaatatgttttccaacttcgttccattctccccatctctttcaggtaccccagtcagtcttaggttcagtttatttacataatcccacatttctcagaggttttattcattttcattcttttttctctattcttgtccgcttatcttatttcagcaagatagtcttcaagctctgagattcttttctccacttggtctattctgctattaatagttgtgattgcattgtgaagttcttgtagtatgtttctgagctctaacaggtcggttatgttgctctctaaactggctcctcctagtattgtcagtggtgtgttccagtctcccactattattgtgtgggagtttaagtctctttcaaggtccctaagaacttgctttgtgaatctgggtgttcctacattgggagcgtatatattgaggacatttagctcttcttgttgaattgaaccctttattgttatgtaatgccctttgtcttttttgatcttgtagtgtgtttctcagctctaataggtcagttaacttcctctctaaactggctgcttatctctcacattgtcagtggtgtgttaaagtctcccactattattgtgtgggagtctaagtctctttgaaggtctctaagaacttggcacgtcctgtattgttttgtcatgtttcttactttgcattgggttaaaacttgctcctttagctcagtgaagttcgttgttacccaccttccaaagcctacttctgtcattcagctttctcagcctcagcccagttgtgagcccttgctggagaggtgttgtggtcatttggaggagaataggcactctggttttttgagtttttagcatttttgcattgattaatttcttatctttgtgggcttatctgcctttgatctttgaggttgctgacctttgaatggggttttttgtagggtcttttttgttgatattgttgttttctgtttgtttttcttttaacaggccactcttccatagaactgctgccatttgtgggggtctactccagaccctagttgcctcgatttttcctgtacctggaggtatcaccagggagggctgcaaaacagcaaagatggcagcctccttcttctttggaagctccttcacaggggggtactgacctgttgttagctcagatgtgcctggaggaggtggctggagacctctgttgggagatgtcacccagtcaggaggaacgggatcagggacccacttaaagaagcagtctggctgcagcaggtgtgctgtgttggggattccttcagccccccaattggtatgggctctccaggacccacaggctggactgattgagaagcctgaatgccagtgtggcagcctaccccaccactcaggtatactccgtcctggggggaaattagagctctgtctaattgggggtggctcaagaccccagctgggaagacccactaccccatgaggaggagtggattgaggtctcacgtaaagaagcagtctggccatgatctggcagtgtggctgtgctacactgcaggaaacctttctcttccatgctgtatggatatatgtgatttttgtgtattgattttatatcctacgactttgctaactttattagctctaataatttttgtgtgcattatttatacatctctgtggtctgatttggatgcctttatctcgttttcttgtttaattgctcttggtggaactttcaatactatgttgaattaagtggtaaaagtgggtatccttatcttgttcttgttctagcgggaaggctttcagtctgtcaccattgagtataatgttggctttaggtttttcatatatggtctttattatgttgaggttatttacttctgttcttagtttctggcatgcttttattgttaaaggtgttaaattttgtcaaatgctctctttgcgtcaattgagaaacgtggattttttcttcatcctgttaatgtagtgtatttcattgattgattttcctacattgaatcatccttgcattcagtgaatgaatcccactttgtcacgatgtatgaagtatttgctgaggacttttgcatctgtattcacacaatatattgatttatattgattaccaaaactcaagtcagttttggtagattgtatgtttttagaactttgtcagtttcatctggcttgtctgatttgttggaatacaactctttattgtattctcataatctctgttatttatgcaaaattactggtaatgttctttctgatttttgtgatttgaatcatctcccttttttcttaacttacctagaggtttatcagttttgttgatttttcaaagagtcaacttttggctggatgtgatggctcatgtctgtaatcccagcactttgggaagctgaggcgggaggattgcttgaggcagggagttacaggggagcctgggggacatagcataatgccatcgctacaaaaaataaacttagccaggtgagttggcacatgattgtagtcctagctgctcaggagggtgagtcaggaggatcacctgtgcccaggagttcaaggttaccatgagttttgatcttgtcacagcactccagcctgggcaatagagcaagactccgtatcaggaaaaaaacaatttttgttaaagtgtattttctttattgtttttccattctctttttattttgctctaacttttattatttcctttcttctgctagcttcgggattactttgctctttgttatttagttattttatgtgcacatttaggttatttatttgaaatgtccctccaccgccaccttttttttttttttttttgagacagcttcctgttttgttgcccaggctgaaatgcagtggcatgatcatagctcactgcagtcttgatttcctgggcttaagtaatcctctccctcagcctccctagtagctgggaccataggcacgcaccaccacgcctggctgattttgtttaatttttgtagagatgtgatctcactacgttggccaggctggtctcaaactcctaggctcaagcgatcatcctgccttggcctgtcaagtgctgggattacaggcatgagccaccgcactgggcctgagatgtgcctttttaagtgtggatgtctactgttccaacctctgccagttacccagctccaaagttgcttccacatttttgggtatctttatagcagcaccccactctctgcagtaccaatttactgtattagttctttctcatgctgctataaagaactgcccaagactgggtaatttataaaggaaagaggtttaattgacttacagttctacatggctggggaggcctcaggaaaattacaatcatggcagcaggggaaacaaacatgtccctcttcacgtggtggcaggagagaagtgctgagcagagggagaaaagccacctattaaagtaccatcagatctcgtaagaactcactcattatcacgagaacaccgtgagggtaccacctctgtgattcaattacctcccgccaggtccctcccatgacacaggggattatgggaactacaattcaagatgaaatttggttggggacacagccaaaccatatcactgaggaacccttatatttgataagctgcttctctgttaatgttttcaaaattctgtcttttggtttcagcagtttgattctagtgtgtctcagtgtgggtctctgagtttatcctttttggaatttcttggatttgtatattcacggatttcattaaggctcctgacattttcaaccatttctctttcctccatacttctattcctatattatgtatgttgttgtgattaatggtgccccacaggtcccccagactctgcttatttttctttattcttctttttgctccttagattgcataatttcaaatgtcttattttcaagtacatttatcttttccgtctgctcaaatttgctattgaatttctgtagtgaatttttcattttagttactgtactttttatcttcagaattttttcagttcctttaaaaaaaattttcccttttatcgatattctcattttgtttagacattgttttcttgattttctttagttttttgcccatggtctcctttagctcattgaacatatttaagagtgttgatttaatgtctcagattaataattcaaatgtctgggcttccttagggatggtttctgccatattctttattttctatgactgggccatacttttctgtttctttttatgtgttgtaatttttcattgagaactggactgagtattatgttgtggtgactttggaaatctaattctcctagccctcagagattgctggggttctgctccttgattactgaagagttccttttatgattttttgaaactctttttgcatagtatgtatttcttctgatgggtggtctctgaagtttctcttttgttttctctgttgccagccagtcatgtaagatttccttatcctactcccaagagaggggagattttggtgcacccatcacccaagcagtgtacactgtgtacccaatttgtagtcttttatccctcacccgcctcccacccttttccctgagtccccaaagtccattgtatcattattatgtctttgtgttctcacagcttagctcccaattatgagtgagaacgtaggatgtttggttttccattcctgaattacttcacttagaataatagtcttcaattccatccaggttgctgcaaatgccattattttgctcctttttgtgactgagtagtattcgatggtgtatatatataccacattttctttatccacttgttgattgatgggcatttgattgtcatcttgcccatatgacatcaaaattcagcagatgtcttgagggtaaaattggtgttaaagaaaaaattatcgaataatacttgttgaaacacagtaaggaaaacttttttggggactatcgcagtatatatagggaacactgcagtgggttcttgcagtggcaaagagagattgggctcacttcttcagcatgggcaagtgggaatttatagccaaggagcagtgtgggagtcaatggatagaaaattaataagaggaaacatcaggggtaatggggattctggctaaaacaacaggattcttgctgaagacagaccagggtgatcagacatcacttaggggagattggaggatgagccacctaatcagatatcaagtgtgggggtcttgctaaactggattttataaggaaatgcacagatggacctaagagaagaaggttcaggagcctgactaaagtttgactaagcacagaatctttgtcactggttatgtgtttgaggcacatcaggtctccagttagtatggatacctgtgcatctcacaaatacaggaaattttactttgcctgtatgaagtttgctttcgagcccttgagccccttctgcagcttctaagttcagcagatgtcttgtgggaaaaattggctgtggagttgaggcatttcaagtctgattatttcttcaaccctatgtaactgccaagagctttgctgatttttctttgctccagcaggcgtctgcctgaactaagtctgctgctttcttagcctgtgcccagaattggtgaatgctcttaggggaaaaaaaatcagcttacttctgaacagccctcctactatgaattttaatcagtctaggccttattgattccatagcttgcctgatgcctttaaaaatataattttttatgttttctgcctttttctagctgttgggagagttggtctgccatgacctacttattgtatattactgtgcagtagaattcttaaccatgtaatataaaattgccttaatactccttttatgattttttgagtcatttcatttttatatataaaatccaaagcattatataaagatggaatgagcccagatatatccattaaaactattgtaactgcccaacagtttcgttttgcctgctgcctgaatacaattgatttatcaagacagaggaattgcaatagagaaagtttaattcatgaagagctggctgaacagaagcgccatagttttattattcaaataagtcttccccaatatttggaggctagggtttttcaaggatagtttggtggggcagggaatgggtgctgctgattggttagggaggcagtcagaggtgtggaaaatggtcttcatgtcgagtccacttctgagtaggaccacaggaccaggaccagttggtgggtccacgtggagccctccgccgtcagaaatgcaaaaacctgagaaggtatctgaaaaggccaatcttaggttctacagtagtgatgttacctgcaggagtaattggggaagttgcaaatcttgtgacctctggaataatgactggtaattgtttacatttacactttagcagaattcaggctcctctcctcctcctaatgtcttgctaaacagatgatacaaaaatatcagtgacctttctaaactattaccaaataatacagagatggctctctgtattatttattttattattattattattatttttttttttttgagacggcatcttgctctgtcacccagactggagtggagtggcgcagcgcaatctctgctcactgcaacctccgcctcccaggttcaagcagttctccctgccttaccctcccaagtagttgggattacaggtgctcgccaccaggcccaactaatttttgtattcttagtagcgacagggttttgccatgttggccaggctggtctctaactcctgacctcaggtgacccgcctgccccggcctcccgaagtgttgggattatgggcatgagtcactgcacccagcctgtattattttatatcataatgaaagaaatgaaaataaaaaagaacctgttttgcaggcagaggctacaaaaactttgaacaactagtagaaatggtttaagttaatttctaaattctgagaagatagaaggactaagcccccattcctaactcctctcctcttctcaggagtataaacatgagcctaaagtcagaatcatcaagatatcaagttctttagggaaagaataggtgctgaaggaccaggcagagggaaaggtttgctttgccactccttaaggcactgagacaggatctgagatttcacagttctctaagtgagcttaaaaaagtggaatcctgtggtttcccttcagaaaagggaggactgtgtctgctcctggaagtggacattagcagggcttcccataaaactctgttaactgctgcggacttagagtagaggttgcacaggtgaactcagttgctgccacacctcatggtctgaggaagccggcccttctactcagagacagtgcctgagaggagactgctgaagcctcagctcagcagtatgtgagcttgtctgcctctgcaaactgtcactttatccagcatctgtaggtttgcattgccagatacccacatcaaagcctaacctctacaggtggctaatggaacacagcaaagaaaaaaaccactaagggagctcattaactttacgatgtaagaccaaactaaacaagtaaaatatgtggctcctattgatgagccacagggatgagacagaagaatgtagtaaattaagaaaaaaattactaagaactttcagaaaatgtaattagaacataatcaggatttttcagagctaaaaatttcctaagagaaaaattcaacagatgaactgataaataaccccttgtgagagctgaatcttttgttccagaagatcaaatagaaacaatttcatgatgtaaggcatatagaaataaaattatttttgaaaagataagagacctgcaggagcaaattcaagaggtttgggaatgagtgttatagaaagaaaacaagacagaacaagtattagtttaggaaataatagaagaaacttacctagtttagaaacattgaaggttgtcagattgaaaaggctgagacttagatacatttgattgcgggtggggctatgtggaaaaagtttaatgaaaaaacgtacatatctagagataatgtgcagaaataactgaatttcagtcatgagaaaaatcattcagagaaaagggaaagagaatcacattgacaatagacttctcactactaaccctggaaacttaagggaacattagaacaacatctcatagccatgaaaaaagaatctctaacaatcctgtacctagacaggatgtcctttatctcggttaagtaacggtatgttcggataatttatttcgtttaataagggaatgccttggtattggagctacagtgaacaggacaagcaagtggacatgtaactaattcctaggttagtgagagataggtgataaacaagtttagacaagaaaatgaaacgtgatgaccataccatccatgttaggtatatgcaatgcttagggacaattattatctgtattaatattcatattaataaaaacttcctatggaagaccatcctattgaaaaatggacgaacaaggcaacttgcagaaggagaagtatgaagagccaataaaaatgaaaagataagcatcactagcaaggaaacaaatggaaattaaaataagaccatttttcaccaatctaatgcaggcataaacaggaattctaggaacaagtagagtgttactgggaattaatgtaattttttggataaatttggcaatacatattaaaatgaatgtacatacatacactttgacttggcaatcctacttaagggaaggtaccccacaaaatatatatgcaccaaaacataaggagatatatatatatatatatatataaataaatgttgattgcagcattgtctgtagttgccaaaggtccatcaagaaaagaatagcaaagtaaataagaaacttccatactttggaatatcacacaaatactaaaaatagtagtaagtgtatctatgaatgtggaagaacagtcagaaaacactaagtgaaaaaaatcaaattgcatggtaatgtgtaaattaagattccaattttgtgtgaaaatgataaaagttcctgtatatatttatcagtttaaaaatttactcatttctgagttagaatccaatgcagacatttaaaatcaagttacagaagaatgttaagtttatacaacatttgtgataaaataatgtcataaaagcagattataaaactgtatgatagctttatataaagaaaaaaattgtattttagataaccctctacttaagaaactaacagatttatcaactgtgctcgtcataaccagttacattagcaggcatttacagtatcatcagtttggatttaaaaacagacttcagcagaagtctaatatgctgtaaaatataagagtttgtgcaaatgtccctggaaaagacataaggactacataaaaattgataatgattatctgtgaatggtgaaactattggcagtttatttttgttactttctgtgtttcttgggttttcttcattgaacatggagaaatttgtcattcataaaaaaaaaatttaacaaaaattcatttatgatcctgtatgaattttaaaattcatataagctaaaatgttaattcatgttttaaatagcccaagtaaggatgaattaaattactagaagcaggtcagcatttactcaatatatttaatataagccagattactatgactaatattatatttatcttaacatctccacaaagttctagaaataagacggtggtgaaaggataataaaaactcaggaccccaattcaccactccaaaagggaaaaaataagctgaaagcccagtcatgcaagaaactgcctttccttttgttcctgagctgataactacagataaaaggttaggttacctactccacaagtagctacttatgttcaccatatcttatgtaaagtgcctgtttaatgatgccagacgaatacataattgactattcccctacctgctcttttctcttggaacttgtggattaccataccctccttctctcccctccagcccacttttcccctttaaagattgaagccctcaaattcatctttggagaaaggcacagatcacagactgtcactgtgattctgtttttttgttccgggcatatgcttaaccttggcaaaataaacttctaaattgattgagacctgtctcagatacttcttggtttacaactatgttctaaataaagtgttggtgccacaaaagaaatagcactcaaatataaaattttctttttaattctcagcaaggcagtgtacttctatagaggggtgcgcccttacagatggagcaatggtgagcgcacacttggacaagggaggggaaggggttcttatccctgacgcacgtggcccctgctgctgtgtcgttcccctcttggctagggttagaccgcacaggctaaactaattccgattggctaatttaaagagagtgactgggcgagtggtttggcgggaaaaatggttatggcagagcaggaaattggaatgagtcagggtggagaatgagcaggtaatgggaacgagtcagggtggagtaggtaatcggaatgagtcagggtggaggaggtaatctaaaaagattgctttatgaggaagttaagtttaaaagtagaaggcaaagaattgaacttactgacatatcgattctttgaagagaaacttagaactcctatctaacaactataagtaataaataagtgaaataaaaattagattttcagtggccaaaaatattaaattattttgttactctttatgtactttatttcttcaacttacgacaagtataatttcttctaacttctttgttgtcttaatatttagcgtaatataaaaggtagtcacttaataaattaatgtgaaattatttctgatataaaaataaagctatcagactgttccctctgtactgtctagtgggaattttaggggggaaaaatgtacatacaaaatggcctacaaataacatggaggaatcatatgtaaaaactaatgtaccagttgcttaaactttcactaaactcttcttcctttgaaagatgaggaagagttttaattatatactgaatataaaaattatgctattcataatatgcatacagcacatttgcagtcagtggtaaattattgatcttgaaaccacctttgcaaaaataacaatgagaaaattatgacagtaaaagaaatctaatctaacccccatcttgcctttaacctcccaactgcccttggtcattcctgggcctaggccatgctaactttaggagaaatttatagtttaaatgataatggcccttccccaaaactaaaccacctttgtaaagctaacgaaagacgaggtcttgctgtgttgcccaggctggtctcaatctcctggacttaagtgatacgcccacctcagactcccaaagtgctgggattacagatgtgagccactgcacctggcctggataagcaaactttctaggtaaccaaagctttatcagattctgaaacgttactaatttaatgattcttttcctcaaatgtattctatagttttttatccttgtatgaaatatattgaatatgaattaacggtgtacttgaagattaaattgtataattataatagtaaattttgggaggtgtctatgttctaggcactgttgtagtgctttatgtgtattaaaattaatttgttattcataacaatcctctcaaggtagatacttttatattcccatcatacagttgagcaaactagggtacagagaggttaagtaacctgctcaagaatacatggctaataatgaaatgttagtaatattttgaaagctctatttctgcatcattattagagccataggcatctccttatcaatttgtatcttaaaaagaaatctcactggcacttttttaatggggtttaaagaaaaaaattgctctactgttttaagaatccccacctctctcaaaaccaacgactgatctgctttttgtcactgccaattactttgtgttttctggttttatataaattaagtcatacactgtatacttattttttctagtttctctcagcatattttgagattcatccattttgtcgtgaatcagtaattcattatgagtattagtttacggatttctcacagttggtttatccattcatctgttgatggacagtttgacttgtttcccgtttggggctgtaacaaacaaaactacatgaacattgatgtacaagtctttgtatggatgcgtatttccttttctgttgggtaaatatccatgagtggaacagctacattatatggtagaagtatatttgacttttaaaggaaatgtgaaacttttctgaagtagttataccattttacattcccgctagcagtgtatgagaatttctattttcctctatctttgccaacatgtggtagggtatgcctttttaattttagtcattctggtagtggtgtagtgatatctcattataattttaacttgcatttttctaataactaatgatgttgaacatttttctcatttgtttatttgttatgtgtgtgtcttatttggtaaaatgtgtgttcaaatcttttgcccatttttttagatgggatccttgatttcttgttgttaagttcatattttgcatcttgatatctgttccagtacaattggttgaaaagattatcccttctacacagcatatcttttgcacctttgtcaaaaatcagttgtctacatatgtgtgggtttacttctatatacttcattctgttccatgatctatttgtatatatttaacatcattttgattactctagatatataataatttttgaaatcacacagtgttaggtctccaactttgttcattttcaaagttgcttttgctattgtaggcctttgtatttccatattttatgttcatctcaatttttttttgtaaacattaaaacacaggaaaagaattagagcatagatataagggttatttttacttatagcattatatgtaaattaaaactacattgttttgaaaaaacttccactgaacaaacatttttctcaccatgtttactctttttttttaaattttattattattatactttaagttttagggtacatgtgcacaatgtgtaggtttgttacatatgtatacatgtgccatgttagtgtgatgcacccattaactcatttagcattaggtatatctcctaatgctatccctcccccctgcccccaccccacaacagtccccagtgtgtgatgttccccttcctgtgtccatgtgttctcattgttcaattcccacctatgagtgagaacatgcggtgtttgtttttttgtccttgggatagtttgctgagaatgatggtttccagcttcatccatgtccctacaaaggacatgaactcatccttttttatggctgcatagtattccatggtatatatgtgccacattttcttaatccagtctatcattgttggacatttggcttggtttcaagtgtttgctattgtgaatagtgccgcagtaaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaactgttcctatttctccacatcctctccagcacctgttgtttcctgactttttaatgattgccattctaactggtgtgagatgatatctcatagtggctttgatttgcatttctctgatggccagtgatgatgagcattttttcatgtgttttttggctgcataaatgtcttcttttgagaagtgtctgtttgtatctttcgcccactttttgatggggttgtttttttcttgtaaatttgtttgagttcattgtagattctggatattagccctttgtcagatgagtaggttgcaaaaattttttcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtataaggaagggatccagtttcagctttctacatatggctagccagttttcccagcaccatttattaaatagggaatcctttccccatttcttgtttttgtcaggtttgtccaagatcagatagttgtagatatgtggcattatttctgagggctctgttctgttccattggtctatatctctgttttggtaccagtactgttttggttactatagccttatagtatagtttgaagtcaggtagtgtgatgcctccagctttgttcttttgacttaggattgtcttggcaatgcaggctcttttttggttccatatgaactttaaagtagttttttccaattctgtgaagaaagtcattggtagcttgatggggatggcattgaatctataaattaccttgagcagtatggctattttcacgatattgattcttcctatccatgagcatggaaagttcttccatttgtttgtatcctcttttatttcattgggcagtgctttgtagttctccttgaagaggtccttcacatcccttgtaagttggattcctaggtattttattctctttgaagcaattgtgaatgggagttcactcatgatttggctctgtgtttgtctgttattggtgtataagaatgcttgtgatttttgcacattgattttgtatcctgagactttgctgaagttgcttatcagcttaaggagattttgggctgatacgatggggttttctagatatacaatcatgtcatctgcagacagggacaatttgacttcctcttttcctaattgaatgccctttatttccttctcctgcctgattgccctggccagaacttccaacactatgttgaataggagtggtgagagagggcatccctgtcttgtgccagttttcaaagggaatgcttccagtttttgtccatccagtataatattggctgtgggtttgtcatagatagctcttactattttgagatacatcccatcaatacctaatttattgagagtttttagcatgaagggttgttgaattttgtcaaaggccttttctgcatctattgagataatcatgtggtttttgtctttggctctgtttatatgctggattacatttattgattttcgtatgttgaaccagccttgcatcccagggatgaagcccacttgatcatggtggataagctttttgatgtgctgctggattcagtttgccagtattttattgaggatttttgcttcaatgttcatcaaggatattggtctaaaattttctttttttgttgtgtctctgccaggctttgatatcagggtgatgctggcgtcatcaaatgagttagggaggattccctctttttctattgattggaatagtttcagaaggaatggtaccatctcttccttgtacctctggtagaattcagctgtgaatccatctggttctggactttttttggttggtaagctattaattattgcctcaatttcagagcctgttattggtctattcagagattctgcttcttcctggtttagtcttgggaaggtgtagggtgtatgtgtccaggaacttatccatttcttctagattttctagtttatttgtgtagaggtgtttatggtattctctgatggtagtttgtatttctgtgggattggtggtgatatcccctttgtcattttttattgcgtctgtttgattcttctccgttttcttctttattagtcttgctagcggtctatcaattttgttgatctttccagaacaccagctcctgcagtcattgatttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccgattttttttaaggtttttttgtgtctctatttccttcagttctgctctgatcttagttatttcttaccttctgctagcttttgaatgtgtttgctcttgcttctctagttattttaattgtgatgttagggtgtcaattttagatctttcctgctttctcttgtgggcatttagtgctataaaattccctctacgcactgctttgaatgtgtcccagagattctggttatgttgtgtctttgttctcgttggtttcaaagaacatctttatttctgccttcatttcgcaggagcaggttgttcagtgtccatgtagttgagtggttttgagtgagtttcttaatcctgagttctagtttgattgcactatggtctgacagacagtttgttataatttctgttcttttacatttgctgaggagtgccttacttcaaactatgtggtcaattttggaataggtgtggtgtgttgctgaaaagaatgtatattctgttgatttggggtggagagttctgtagatgtctattaggtctgcttggtgcagtgctgagttcaattcctggatatccttgttaactttctgtctctttgatctgtctaatggtgacagtggggtgttaaagtctcccattattattgtgtgggagtctaagtctctttgtaggtcagcaaggacttgctttatgaatctaggtgctcctgtattgcgtgctcctgtattgggtgcatatatatttaggatagttagctcttcttgttgaattgatccctttaccattatgtaatggccttctttgtctcttttgatctttgttggtttaaagtctgttttatccgagagtaggattgcaacccctgcctttttttgttttccatttgtttggtagatcttcctccatccctttattttgagcctatgtgtgtctctgcacctgagatgagtttcctgaatacagcacactgatgggtcttgagtctttatccaatttgccagtctgtgtcttttaattggagcatttagcccatttacatttaaggttaatattgttatgtgtgaatttgatcctgtcattatgatgttagctggttattttgcttgttagttgatgcagtttcttcctagccttgatggtctttacaatttggcatgtttttgcagtggctggtaccagtttttcctttccacgtttagtgcttctttcaggagctcttttaaggcaggcctggtggggacaaaatctctcagcatttgcctgtctgtaaaggattttatttctctttcacttatgaagcttagtttggctggatatgaaattctgggttgaaaattcttttctttaagaatgttgaatattggccctcactctcttctggcttgtcgagtttctgccaagagatcggctgttagtctgatgggcttctctttgtgggtaacccgacctttctctgtggctgcccttaacattttttccttcatttcaactttgctgaatctgacaattatgtgtcttggagttgctcttctcaaggagtatctttgtggcgttctctgtatttcctgaatttgaatgttggcctgccttgctagattggggaagttctcctggataatatcctgcagagtgttttccaacttggttccattctccccgtcactttcaggtcaggtacaccaatcagacatagattttgtcttttcacatagtcctatatttcttggaggctttgttcgtttctttttattcttttttctctacacttctcttctcgcttcatttcattcatttcatcttccatcgctgataccctttcttccagttgatcgcatcggctactgaggcttgcgcattcgtcacgtagttctcgtgccatgggtttcagctccatcaggtcctttaaggacttctctccattggttattctagttagccattcgtctaattttttttcaaggtttttaacttctttgccattggttcgcacagagtaatttgattttctgaagccttctttcaactcgtcaaagtcattttccatcaagctttgttacattgtttgtgaggagctgcgttcctttggaggagaagaggcactctgatttttagagtttccggtttttctgctctgttttttccccgtctttgtggttttatctacctttggtctttgatgatggtgacgtacaggtgggtttttggtgtggatgtcctttctgattgttagttttccctctaacagtcaggaccctcagctgcaggtctgttggagtttgctggaggtccactccagacgctgtttgcctgggtatcagcagcagtggctgcagaacagtggatattggtgaacctcaaatgctgctgcctgatcgttgctctggaagttttgtctcagaggagtacccggccgtgtgaagtgtcagtctgtccctactggggggtgcccctcagttatgctactcaggggtcagggacccacttgaggaggcagtctgccggttctcagatctcaagctgtgtgctgggagagccactaccctcttcaaagctgtcagacagggacatttaagtctgcagaggttactgctgccttttgtttgtctgtgccctgcccccagaggtggagactgctgaggaaggcgggcctccttgagctgtggtgggctccacccagttcaacttcccggctgctttgtttacctactcaagcctcgggaatggcgggcgcccctcccccagcctcgctgccaccttgcagtttgatctcagactgctgtgctagcaatgagcgaggctccgtgggcataggaccctccgagccaggtgcgggatataatctcctggtatgccatttgttaaccctgttggaagagcacagtattagggtgggagtgactcgattttcctggtgccgtctgtcacccctttctttgactaggaaagggaattccctgaccccttgcgcttcccaggtgaggtgatgccttgccctgcttcagctcacgcacagtgcgctgcacccactgtccggcacaccccggtgagatgaacccggcatctcagttgtaaatgcagaaatcacccgtcttctgtgttgctcatgctgggagctgtagactggagctgttcctatttggccatcttggctccacccccccccccccccccccccccccccgccatctcatcaatttatacagaaatgtctgctgggagtttgattgggattacattgaatctttggatccatttggggagagttgctatcttagcaatataaacaagatgtatttctccattgaagtatttttactttcagcactgttttctagttatcagtgtacaagtatttcatctcttttgccagatttatccatatctcacaactttaatgttactgatttttttcattttctaattgttcttattagtatgtaaaaatgcagttgatttttctatatttgtcttgtgtccagcagtcatactaaactcacttattatagttaattccattaggagtcctatgcaaatgaccatatcaaaaacagttttactttttctccccaatttatataccttttctttttcttgtctgaatttactgcctagagtctagacagtgttgaatatgatgaaggcattcagtcttttaccattaagaatgatgttataaatattttataaatctctttcatccagatatggaagtttcccatttcttcctaatttactgagaatttttaatcaggaatggatgttgaattttgtctaatgcttttaatgcaatgtattcagactgtcatggttttccttttttagtttgttaataaggtaaattacatgtatttaattttgttaaaccccaaccctgcattcttggataaacctcatttggttgtgatgttttttttttataaggttgaatttaatttgctataattttgtttagaatatgttaatgagggaaggagaactacaaaccactgctcaaggaaataaaagaggatacaaacaaatggaagaacattccatgctcatgggtaggaagaatcaatatcgtgaaaatggccatactgcccaaggtgatttacagattcaatgccatccccatcaagctaccaatgagtttcttcacagaattggaaaaaactactttaaagttcatatggaaccaaaaaagagcccgcatcgccaagtcaatcctaagccaaaagaacaaagctggaggcatcacactacctgacttcaactatactacaaggctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatttaataaatggtgctgggaaaactggctagccatatgtagaaagctgaaactggatgccttccttacaccttatacaaaaatcaattcaagatggattaaagatttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatgtaattcaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaacccatcaaaaagtgggcgaaggacatgaacagacacttctgaaaagaagacatttatgcagccaaaaaacacatgaaaaaatgctcatcatcactggccatcagagaaatgcaaatcaaagccactatgagatatcatctcacaccagttagaatggcaatcattaaaaagtcaggaaacaacaggtgctggagaggatgtggagaaataggaacagttttacactgttggtgggactgtaaactagttcaaccattgtggaagtcagtgtggcgattcctcagggatctagaactagaaataccatttgacccagccatcccattactgggtatatacccaaatgactataaatcatgccgctataaagacacatgcacacgtatgtttattgtggcactattcacaatagcaaagacttgaaaccaacccaaatgtccaacaatgatagactggattaagaaaatgtggcacatatacaccatggaatagtatgcagccataaaaaatgatgagttcatgtcctttgtagagacatggatgaaattggaaatcatcattctcagtaaactatcacaagaacaaaaaaccaaacaccgcatattctcactcataggtgggaattgaacaatgagatcacagggagacatgaaggggaatatcacactctggggactgtggtggggtggggggaggggggagggatagcactgggagatatacctaaggctagatgacgagttagtgggtgcagcgcaccagtatggcacatgtatacatatgtaactaacctgcacaatgtgcacatgtaccctaaaacttaaagtataataataaaaaaaaagaatatgttaatgagggatcttggcctgtagttataatgtctttgtctggttttgttatgaggcctcataaaatgagataggaagtggttccttctctttggtgttctggaagagtctgtattcaactgatattatttatttcttaaagagttggtagaatttaccagtgatgctgtctcagcctagaattttctttgtggaaaggatttgaattggaattataatttctttaacagacattggcttttcagggtacagatttcttttcagtgaactttggtggtttgtgtttatcaaggaatttgtccatctcatccaagttgttaaaattattgtcatattaataatgtgacctcattattcttttaatacctctagaatttgtagtgatatcacctctttgatttctgttagtggctcttttttgcctgatcagtgtgaccagaaatatgtcagttttagtgatcttctaaaacaataacaaaagaaccccagatttttattcattgattttatttttctgttttctatttcattgattaccactctgatctctgttatttgcatgcttccccaccctccaccacttgctttggatttcgtttgctctagtttaatttgtttctagtttaaggtagaagcttgtcattgatttgagattttcctttttttctaatataagtattttaaggctgtaaatttcctctttagtactgctttagcagcatcccacaaattttgggatgatgtatttttaaaatttccctttttctcctttgattcatgggttatttagaagtatgcagttaagcttcaaaatatttgtgggctttccagaattttttttatttgtttctagttttgttctattgggatcaggaaacatatattatacacattttatttttacacacggtataaaccccagcatacactgctattattcttgttttaaagcctgttatcttttaaagaaatttaagtgaagcaaatgaaatttgaatttaattaaatattttttttctgactcttacccctgtcatgcggagactctgtttatatgtatattgggctacatgaagttgttcctcaattcactgattttgtttctgttttattttgggtttttttgtgtgtgtgtgtgtttcattatggataatttttattgctgtgcttttctgatcattgtctaacctgtcattcatccagccaatgtctttttcatctcagatattttagtatttctgtttctagagttttgtttgagttttctatattgcctaacctttggaacatacagaatatagttcacatttggaacattatgaaatatagcaaaaggttttaatgtccttttgtgctaattttaacatctgattgagttatgcattgttttgattggttgatttttcattatgtctcatgtttgtcttactcttcctggactcttcagcttcttctcaactctggaagtctgccaggctttgtcttagtgcgccttctaagtgtgctgacccagaaattctcacaaggcagtaagctgggtaagagtaggagggtcacttcagttgtttcttatctctcaaggatgactggccttcattgcttgatgccagtgttttgaaaagtatttcatagattttgtctgtttttgttgttgttgttgttcttgtttttttatgtgtgaaacctttgttatgatttgatttgaagccattttccttttgcttccatactctccatattgcaagaacataaaattgcacataaagaattagaaagatgatcttatctgaagaattttcacccttttgtttttgtatcttacagtgttgaaactctagtttcaaatacattataaaatagtaaagttaatggtcaaaaagaaagcaaaccacctggttttgctgaagaaactaagtattttcttggtcattcctttgaaaaacaggaagccagaattagaaagtaatttgaaaccttggataatttcttggttttctttggttctactttgagtacatgcccacctccctctaaaatgataggaattcagtattactgtaaagtagtttgggcaaaacactgccacttcactctgttaggcgtaaaaatgtttggctggaaacagctaaatataatattttgtacttacagaaatgtaaaatggttgtttgaacttcacaaatgtatgtatgtcatgacgcagatgtatgtcatgatcatgtaatagcactgtttttaatacaatttcttttttttttttttttttttttgagacggagtctcgctctgtcgcccagcggggagtgcagtggcgcgatcttagctcactgcaagctccgccttctgggttcacgccattctcctgcctcagcctcctgagtagctgggattacaggcgcctgccaccacgcccggctaatttttttgtatttttttagtagagacagggtttcaccacgttagccagaatggtcttgatctcctgacctcgtgatctgcccgccttggcctcccaaaatactgggattacaggtgtgagccaccgcgcccggcctacaatttgttgttaaaaaatattttgttaacttagaaaaatgaactagctgatactcaaattttggaaattaaaggtttgctctgttttatgtctgtatctggggctatattttgtagtaaatcagagaccaaaagattgtttttgaaatatataaatatgctgttctgaagttaatactgtgtaaattttgagtagagtaagcgttttgtcttaaaggtgtaataaagccataaagtggcattgttgctttataaacttagaataataatttgccatattagtgcagagttcaaaaagtactatatattttgcaaaatagtcacttactcattattgaataatgcagttacttgagagtatgcatgtctagaatactttatgaagtactgatttcactgaaagattttgaaatctgtaaaaaccctttttttcaacatgggttatattaaaaagtcgcttctatttgcataattaggctataattctccaagggagggtattggagaataaattttttttcgaagtaagaatttataaaattaaaattcagggttacagttatagccttactctttaattcatgattaataaaatttctctttcagacggcaaatggatacatcttgttttttcatattacatctacaagaggggacaagtacctttatgaaccagtgtatcccaagtaagtttgttgcctttcattcttttaatatgtgatttgcatactttatattcagaaaaacattacagttttgagttgtctgtagtgattagaataaaactaaaccagcatttcccaaatagtatttaaaaaattaccaggtctttgaactgtcatttcttgaataaagaattctttaagtctgggaatcttgatgataaactatatcaagactattttcttgggtattcagaatgactgttaatatattccaggtctagcatttctcattccttattagggaagagctaagagatcatgagaggaagagttgaaatgttggtaagttacaggtacttttgcatgtgcttttgtatatgcatagaaaaaaaagaacctcagacagttattacctcttggtttaaatttgggaaaaacgtggacttttgccctttacactgtgtagttatgtatattttgcattcttttccttatagcaggccttaacttttgaaataaaagaacatacaattgtaaagcattccatctttttttttttttaatcaagccataaagccagataaaaatataagagcatttatcacatttctagatggtggaagatatccaaagtttaataggtatataagaaattagaaagacagattttactgtgtgaaaagtttaaatttttgaatattaacagaaaaaaagaaaaacattaacagcaaataacttgggaaaaatatttgtggtaaatagggccaagtcttactacttttatataaaagagatatataaattgccaataagcacacagagattccagtagataaatagggaaagtagtctcattaaaggaaatactgtaactaacaaactcaagagaaagtatttagacccagtagtaacccaaataaaataaacgttaaataaaataaacccaaataaaataaacattaaatataaccatttttattttttaataattaaagaattattactgctcgcagaggtataataaaagttgtgttgcacacttctgatacacaaaggtgtgataatagggagctggttaacaagttaactgtggtacatccttctcttatagtgatatgtagtcattatgtctcagaaaaatgtataaacttaagaacttgaccatattataatgccaagtgaagaaacaagtcacacaaaattatatatgtaatatgaccatgactgtataaaacaaaacaacgcaagtcatctaaagacaaaatctagagcaatacagtacaaatatttatagtaattgttcctgaatggtagaactgtagtgattcttctgcttttcaactcttaaattttcaactagttagattttcttgatgctatagccacttgtttttgtaacaagtatagtgctaactgaggtattcggttttggaaatctttaaagtacagacttttttgatgatgggattcaatttaacttgtttatttttcaataaaaatatttagtgcaaaaatttttgacacataaatatagtgcaaaatgataggaacatcatgatgtatttagaaattttaaattcagttttatgggtaaaactgaaaaaagaatttttttgcattctaagtgataattttgtgattcttttgaagaactgttgtaatcaatgactaaaattagatttactggtgcattttaaactactatgtttgttttattgcttaatttagacatgttcctataaataaaaagcagtaatcagaaacaacaatttaactccattaatttatgttcctgtgggcatggtagagaaataacttctcttgaaacagtgaaaattctattttctttatttcagttcactaataccattacatgtttatagtgttttggaatagtattttgagacccactttttgtgttccagaaaagttttaagaaacagtttctttcttttctgattctaaaactgcaagagacaccagttaactaagtagtcctgacaatgcgtgaactttgctgtgtttgactctatgtgttaaggcagagaactaaataaaaaacatactctctttcttaatttgggcattcttttactatattgaaagttttaggtttcagtggctggcctcaataaaatgtgcattgctttagagcagttcgaataatagttaaagatacaggctttggtgtcagatagacctgaaattaaatgttggctgtgccacttttcagctatatgacttctttcaagttatttaataccaccaaaaactttcctcatctgtagagtaggataacagtagtaatcatctcataagattaaatgagatcattcatatttaatgcttaggtaagcacctagcttatgggataattaataaaggacaactgttattatcagtaatttttttcaccaagtgtttacttcatttctaagcttttaagtaatttttaaatatatacatatatatctacttgatattttacttctttgccagagtctaacttctagtaactgctacctaaaatctcttatatgaaaatagttctgcagattaaagtcagcctgttgtgtatttgtgtgcttgactgttctagttatgttacttagtctagtgagtttcttggtttttctgcagaacccatttgtacaatgggaataaaaataacttctttcattgttaagaggattatgtgaattcatattcttaaaacctgaaaaatagtggttatataaggttttgaggaaagtaaagtttggttttgacagtggtatcttcattgtcatctgtgccattataaacccttctgtagtttgagacactgttctaagcattttttaatacgtatttaatccctttagcaaccctatgaggtagttaggtataactgttttacaaactgctgcacagagaggcagagtaactcacccatagtcacacgcgaataagttgtacagctaggattcagacataagtgttgtagctctaaagtctgtgctattaatcagtaatatactgtctcaaccctgtttatgctccatccagctactactttggggtttatctgggagtagagaatggaaaaaggagaaatgatctggagtggtttctaatagtcctgaagaatagaggcagtataattactgaggccagtggttaatcatcctcttctcacttagttatagaaatactattgtctctcgtttctcttctgtaaatcttacaagttcatcacaggagtttttctagagtatcttaacttccctgtattatgtgacagcatcttaacctcagactgcatatccttttccactatgctccatctgagaacacagttcagatgcctcatgatctttcctagtttccacctagtgttgtttctagcatccttctatagatgttgggagtcagtctataacaatggtggcagtcttattaagtgactctgtacctcaaagatcatttattctttggtgaatgaattttccattttagaaatcttagattccattgtatattacattatctcttcatattagttacacagaccagtggaccagactagttgaaggttgtctggacattttattttatggcttggaaattttagtgaaattaatgaaggaaacttccagggataagtcagaaataatttgtgtttagctttaaaatgtgttcatatgcttatgtttaaatagaagtttagtagatttctaaattgcacatcatgtttaatttcagcataatgaaaaaaatttaaacaaatatgtcatcatcatgtatactttgttgagagcagagatttttttcccccttcttcctgtcttttcactgctactattaccctcttttttgttagagactagcatttttgaggctgagtttctttaaaaaaaaaaaaagtttctgtactgaaattcagtacatttaattattatatagtaaagatactggtctttttcactgaagaaaaaaagtcactccaaaatataatcaaatctccttctcctcttccccctccaccctccccatataatttcatcagatggcaatacttcttaccagctcactgctaatgaattagtgccagctggaaaggaagaagagcatagctacctgaggttagcaatttttaacttcaacacaacttgccccttctaaaatccagcttctttgcagaagaaacctacagtaagggacagaagcatctaaatcgtatcaaatttaaaggtgacaagagatctgaattagttacagactcatgaaagtttccctcaatatatgtttctttttgctaatatgttgtgagtgttctttttctagagaggaactttagccactttttccccgtatttctaataataaaccttgttctacattcagtttataaacttgacaaagtatgttagtgatcttgatgttttttgttctgcttgagcctctgaaaacatcccgtgtctaatttgatttcagtgtgtttatattctgtaaatgtacatgggtgaccttttactactgaactttgcatattacatgcatccattacttcacattatagttgcatgagcacttattaataggattggcaacagtgttattatataagttctggatagtgaaaactcccttattggccacacttccaaggatggcacctgaatccaaagaatggtaggactgcccaaatcagagagccctgcacattgtttctgtcagactggaggctgtctcaatgtgtgataatataaacgataagcagttttggtttttggtggcttttttttttttggttctatgaaaagtctggtgaaagggtactacgtctttcaaaaaactcttctgaaaattattttcatccatctgtctatccatttaaaaagtattgaattttgtccagctctaggcactgttgtagatactagagatctaacagtggaaaaaaacaacaaaacaaaaagccctgctgatagatcttgttattcttctagtagagggtgataagtaaaatacattatgagttaggtgatccactctatggagaaaaattaagcagggtaagggaatagagagtggaatatgacttaaaatagtggtcagtgtcttcactgagaagatgacatataaaaggatctcaaagatgatgaggtaacaaaacatatatccaggggaagacaattctggattggtgagatttagcaggtatgaaaattcataagaagataccgtgaataaattttaggtcctataataatttatagttagtaagaaatgatgaactttttttattagctgtaaaaatgaaaatacagtctgatttttaggtaactgaatcctgggaaagtcaagagcgcacccgcttttttcttccagtaaatggcaccaccgtgtatttgagtttattcactcttcctgcccactaacatcaatagccagtctatatccagtctagtatattctaccttgtatgtcatttcttttccctcctcgtaattcccaatgacactagttcagtttaggtcttgtcacttttctcctggattattattatatctttttttttttttttttttgagacagagtctcgctctgtcgcctgtgctggagtgcagtggcgtgatcttggctccctgcaatctccgccttctgggttcaagcgattctcatgtctcaatcctgagtagctgggactacaggcatgcaccaccacacctagctaatttttgtatttttagtagagacggggtttcactatgttggccaggatggtcttgaactcctgacctcaagtgatctgcctgcctcggcctcccaaagtgctgggatttcaggcgtgagccactgcacccggcctattatgtcttcttaatgtcagattcatgtctaaacctcactcacttaccccctgccaagccaaacatgctattgctttgctaaacttttttgcagttaccatcatcttttgtacgttgtatgaggtagaaaacctttaattctttgtttcttcctctggattgtttcttcactttacatatttgttcagtcatcaaattttactgattgattagagttttccagtgcctctggaattcatttaactctattttactctcattggtctttttaggggccctcatgtcctcctccttgtctattaaaaaagcttattcactaactcatttctcttcccctagtctctttcacctacataatgaagtttatcatttgcattgataacaatttttttttttttccaaaacgaagtccaagctctctggcctggcatttagaacctactttctccatatcttgaacacatcgaacccacaattcctatttaatgcctctattcctttgttatttgctctattcagtatgactcccctgctatctttttttatgtaagaaatttatctgagttggttttcaagctcaggtcagacatctgttgtactctataaaccttctgccctcaactctcctatatccgcccctgtacccaataaataactgatctggcatgtgcattcccatagtatgttttaaaaatttacactactaattcatcaataccttcttacttaaaaaaaaatccaacaatgagagatctataaagataaaaagtaaaaaaatgtgaactttgcttttttagattctaatctcatttcactctccagttgtcctgtatctcttgagtaaataaatacctaggaatagaattgctgggtcatatcacatgtctagtaatttcagattggatgttagatactgtattacattatccattgtctgatttttgtccttttcctttaaagagtattgaaggttgttttgggtggcaggtaagctgcttggagatcttactgatcttttgaggctttttgtatgtcttttaggatggatttaactgttaagctagcttagcccttctgaagtccactgaatgtcctaggtctttaagaaggtctctccattctggctagtcagaaccgaaatgtctcccagtcctatatgaactgggtagccaaaaaccctagtagtcattctttgcctgtatttgtggagtgtcactatgtatttggatagtattcagtaagactcgggaaacccctgcaggtttctagagcttttctctgtgtggctcccacatcactggtgctctgcttcacaaatagctgcttctgcttctctgaactttaatctttttctcctcaacttaacaaggctgccatactatgcttggtttctctcactctacatgatggacaaaaccttaagaggttagatggtgacttctgccagaaaacctgtttgttttccttccctcatgatatcagtcctgtgctgcctgctgtctcatgtctgaatatggttggttgatctattttgtccagttctcttgtttctgggcactagtttggtaccaggtactctattagtagaataataaaatgaccatctgtgtgtccatcagtcagtttgaacaattttcagtctttttccactggagtatatttaagcacatccaagatatcattatttcatttcatccaaaaatactttttattattgtaagcattccagtaaacaatgatgaatgcaaatgatgaaatatgaggcctggagttttaggaaaagaaatcgttctgagcctttccagaattatggttggagaactaaagcctcttagtcccagaatttacataggactgccagaactttctagatcaagccttgcacatttcagaatcatctcaaatggattcatcctcatttattgtatgcctgctatctgtaaaacacttgctatacactgctactgaagatgctaatgaataattgtttaaagttaatggcaatataaaataacagattgccaggtaaatatcttgaaaagtcataatagcatttcagggtaaagtgattagttgtcaagggaagttttgtagataaggagacttgagttctatacttgggagagaagtcaggacttaggtaagttatgttgcaaggaaaaacactataattaattgcattcttgaagtttctgttcccccacaccccaaatctattaggttatttgccacattattcttttctttagctggcacttaaagcatttggtatctcctgcacagaagaatttgctcaaagaaatggctgttgaatttgtgaatcagttttctgtatcacctgatctagccctcaaagcatacttgacatgctttaaaagcagtcttcttttcttttaagacttctgtgtagtttttatgctacacttggtattgtggtttgatttttggtttttaccaatttgatgagaaattactccccgctcagtgtcctgggaagtttgactagtggttgacccatcccatagaaacattttatttttttcatggccctttaagggccactcattaacatgaatgccttatcattcattggaatagaaaactgggaggctttacttttagttacaaaagttaatgtatggaaaatacattaataaaaccggcttagcttcatttttcctactttcttgtgatatttttcttagacttgctattgatacctcagataaatatccagcagtttagagatgtggaaaaaaatatggcagttggaatcagagaggcccaggttccagttcagattctgctttttcccaagactttggaaaagccattttctaaagttgctttctgtgctgtgtgtctataaaatgagaaaaatgagtgattagattcttaataagttgcaactggtattgttgtctaggttgccttctgaattatgtaaatataatgtgcctccattgcatatttatgacaatttataagtgtttaaaaaagaaggggattctagttcattaactgcgaggttttagagtgaactagaatttgaagaatgacaaaactttaagaggttgccaaaaaatacaggtgtacttgttcaaaagcaagtctcagattgagtcatgtatcaaatgtaagcaataacagacttgactcctctggggaacttaggcagagtattcatttatacaatacttgaaaattccaagtattaacaaagatagcttctttaatatagcgagaaactccttacatcatatccttgaataatgtcataacatcgatgagggaaaaaaattgatccctggccagggccactgtcaatatggaattttcatattctccctatgtctgtgtagtactgtagtttcctcccacatcccaaagatgtacgctttgggtgaatcagcatctgcatggccccagtctgagcgagtgtggggtatgtgtgtgagtgcgccctccaatggaatgacatctggtccaaggtgggcttcagctttggccccaagctgctgggatgggccgtggccacctgcaattctgaactggaattagtgggtaaatgtttttattcatctttcttaaatgtatgtatagcttacatttatttcaatgtctttttttttttttcaaaaaactgtttgtatattgcatatataactaaaatataaaagcaacattttataaaactttctagagagacaaattccacacaagtggtaagggcaacctagtgtctctagatttgttctgtttcataaattggattttaacaaatcctatgtaaatcaatttttgtaaataaaatgtaattgttggatttttcacatgttagatttttgcaataatctgagatttacaacactttctgatgtatgttcactctgattctgaaactaaattatattattggatttcatatacagtattaaaattagtggtggtttaccaagattaaactttaaagcatatctgaaagttatctatctgtaaataagacaaattgtctacagaattagttttatatagtcagtgatgtgtaaacctcttggctttaagaaccacaacaactttgaatgcattaagaaaactgtcacacaattgatccgaaactgcattaagaaaaaaattcctacttttttttttttttttcctttcactggtttcttgtctctcagggtcatcgttccatgggctgtccccacccaaccccaccaagtttccttcattgacatttctgttctttccttcacaaattctgccatggcttgtagggagagcacctgattaaccaatactgagctgggaatgaccgacacttcttagctagttctataaattttgttagtttgtttttgttagccccagttaatctcaaatagatagaaatttagaacattattgaggggattataatgggattaatcccttttgcctatcccataatgtattcagctgtttcatttctttttgttcatttgtgattttgtgttttcaaagtaaaaaatctgaatatttatttagagtttactttggattaaaaatattcaatttattagagcttcaaaataataactgtagctcaaacttttaagttccatctacaaatcttaaaaatctattcgtaaatctagcaaatttcaacacttttagaggggaatcttacaaattaaattctcttacgtatattaatgtatatttataaatatgccttataaatatataataaattatatattttgtttcttcttaaaatacttgaattgtctaacaagctttgtaccatttcatgagcaggtatttttgccaaagcatgatatatgcattgtgtaaacaccttcattctgcacaagtgcacactaaaaacaaagcttgtgggaaaatcgttggaacagatcacttaaaacttcctataactttgaactagaggagtcacaaataataatcttaataaaagttagaaaataattaaattttttcttttccatgtagtttcacaaagacaactgcaagttataaatattttttttcaaataagtataatttcctactgcttccctactcttcacattcttttccccagttagcttacctagcttttagttcagattcttctcagaatcgtatggtcaaagtctggtgtttaatttcccttcatgtttcttctcaaaatttatcaaaactatcactatgacttaagttggctgggttctatttcattagtgcaagtaaacaataacttgttatcacccatttgtggtaaaactgtggtatagctggctcttctgtttgagacctatagaaaagctctgaatgttttttttctttcatgagtggatgtgtacatagcactcctgatggagatatttatcttttttatgggcatctatattgaatcctttggagtatatcgatttaaatgcaaagtgtagcttagaaataaatgtttgggctgggtgaggtggctcacgcctgcaatctcagcactttgggaggcccaaggcgggtggatcacttgaggtcgggagttcaagaccagcctgaccaacatagcagaacccccgtctctactaacaatacaaaaattagctggtgtggtaatcccggctactcaggaggctgaagcaaattgcttgaactgggaggtggacattgcagtttgccgagattgcaccactgcactccagcctgggtgacagagcaagactccatttaaaaaaaaaaaaaaagaaaagttcagttacattttctcttgaaaattcaggtttttgttttctatccatcttccttaccttgtatagtttaacttaacttttgctctgtataattcgtactataacattagtatgaatatggtaggtagtgcatgtcaaatctattatctgttcttccaaacaattttgcttttagtgagaaaaccatcataattaaaatattgaagctggttagtttctcaagcacatgactgggatcaaaagcaaaggagtaactgttaacatttaatacactcaaaatgtcaaaaaacatacgtgcatacatcccacttatgcagggatccacgtattaaacatcatcaattgcctggaatagctaagactcaggaaataaggcctccaaggggacactcatctttactcatttaagacatttgttggttttgggctatatacaaggcaatggtgtgaattagagttgattttttcccagtctgaagctcatagtttattaaggggacaaaagctaaattcagataatatcaaatatactgtaaaagtgatgtgtactctaaaggagctacagataaatagctttgggaggcagtttagaaagggaatatactttcagtgtattattgaggaattctttgtaaagagagtagcatctgagctgagtcatgaggtatattagtctattctcacactgccataaataaacacctaagactgggtaatttataaagaaaagaggtttaattggttcacagttccgcaggctatacaggaagaatggctggggaggcctcaggaaacttacagtcatgacagaaggagaaggggaagcaggcacctcttacacggccagagcaggaagccggggagaggtgctacacacttacacactttttttttgttttgttttgtttttgtttttgtttttgtttttgtttgtttgtttgtttgagacagagtctcactctgttgccaggctggagtgcagtggcaccatctcggctcactgcaacctccgcctcccgggttgaagcaattctcctgcttcagcctcctgagtagctgggactacaggcacacgccgccatgcccggctaattttttttgtgtgtgtattttagtggagacaggctttcaccctgttgcccaggctggtctcgaactcctgagctcaggcattctgcccgacttggcctcccaaagtgctaggattacaggcgtgagccactgcatgcaactgagctacacacttttaaacaaccagatctcacgataacttactatcacaagaacagcaccaaaggggaaattgccctcatgatccagtcacctcccaccaggccccacctccaacgttggggattacaatttgacataagatttgtgtagggacagagacccaaaccatgtaattccacccttgtcccctgccaaatctcatgtctttctcacatttaaaatacaatcatgccttcacaagagtcccccaaagtctgaacccattccagcattaactcaaaagtccgaagtctcatctgagacaaaactagtctcttctgcctatgagcctgtaaaatcaaaaacaagttaataacttccaagatacaatgggaatacagacattggttaatactcccgttccgaaagggaagaatcagccaaaagaaagggactataagccccgtgcagatctgaaacacagtagggcagtcattaattcttaaagctccaaaataacctcctttgactccatgtctcacatagcattaagtacatttacagtgttttgtacaactatcacaattacctagttccagaacttttacatcactccaggcagaaaccatggattcattaagcagtcattccctgttctcttctgctctcagcccctagaaccatacatttgtttcttgtctgtgtctctctggatttgcctattctggatacactatataaatataatacagcatgtaccttttgtgtcttatttaattgctggatactttgtataaatggaatcacacactatgtaccttttgtgtcttcttaatgtaatgttttcaaggttaattcgtgttttagcatgtatcagtacttcgtttcttttatggctgaataatattttgttatatggatttaccacagggtgtttatccatgaatcaggtgatggccattgaggttgttttcactttttggctattggaacagtcctgctatgactaggagtgttcatagcagttgttcatgtacaatttgtatttgaacacctgttttcaattatttttgggtatatacctggaagtagaattgctaggttacatggtaattctatgtttaactttttgagaaactgccagactgttttcccacaagccatatgtgaaggttctggtttctccatatcctcatcaacatttgttattttctgggtttttttttttattatattagggtcatcccaatgaatgtgaaatagtatctcattatggttttgatgtgtatttccctaatgattaatgacattgaacatactttcatttgctctttggccatttgtgtatcttctctagataaatatctattcaagtcttcttcccactgtcttttttttttttatttttttaaagaaagcttcttgctctgtcttccaggcagtgtcacaatcatagctcactgcatccttgatttcttgggctcaagcaatcctctcacctcagtcaccagagtagctgggactacaggcatgcaccaccacacctggctaattttttgatttttttgtgaagttgggatctcactacattgttcaagctagtctcaaactcctgggctcaagcaatcctcctgtcttggccccccaaagtgctggaattacaagcatgagccaccatgccctgcctctcccttctttttaattggtttgtttatctttgagttataagaattatttatatattctggatactacatccttttaagatacatgattttcatattttttttctcattgtctgggcttttcactttcttggtagtgtattttgcacaaaaaagtttaattttgatgaagtccaatttatatatatattttgttccttacagtttttttatatctagaaaacaattgccaaatgcaaggccatgacaatttacgcctatattttcttctatttttttaagaatagttttagctcttatatttagagtttttattcattttgaattattttttacttatgatgtgagataaggatccaacttaattctttcgtaaatggttattcagttgtcttagtacagagaatgttgtttcccctgttgagtgcacttggcacctttgccaataatcaattgaccataggtatacaggtttattattaggctcttaattccattccattgatctgtatgtctgcccttgtatcattaccacactgtgttggttactgtagctttgcagtaggttttgtgatcaggaaatgtgaattctccaactttgttcttcttttcaagattattttggctcttcggggttccttgcctttctgtatgaattttaggatcagctttcccatttctgttttttttttttttttttttaaaagaacattgggattttggtagaaattgcatttaatctatagctgtttgggaagtattatcgtaacaatattaaatattccattcatgaacataatatacctttccaatttcttagttctcccttaatttatttacgcatacaactcttactcatccttgggtcagtttattcccaagtattttattcctttttgatgctattgtaaatggagttgttttctgaaatttttattgctagcgtagagaaatatatacgatttctgtgttgatcatgtactacagctttgatgaatttattagctctaataactcttctgtggattctttagaattttctatatatactatactattatgacatctttgaataaagagagtcccattttttccgtttctgttggatgacttttctttttcttacttgattgctgtctagaatgtccagtattatgctgaacggaagtagtgagagcagcattcttgtctcatgcatgatcgtagcgggaaaactttcagtcagtaaacagtcatttactgttgagtaagatgttagctgtgcgctttatcatatatgtcctttatcattttgaagaagttcccttcctttcctcatttgttgagtgtttttatcttaaaagattattactattttttcagatgctttttctgcatgaattgaaatcattctgggatttttccccttcattctattaatatgattacattgtattacattgattttcatgtgttgaaccaccattgtattcttaggctaaagcccacttggtagtggtggataatccttttaatatgctactggatccagtttgctaatattttgttcaggattttttttacatctatattcataaggtatattgagccatggtttccttttcttgcagtgtctttgtctgactttggtatcagggtaattctggcctcatagaatgaattagaagtccggggatggtggcttaacgcctgtaatcccagcattttgggaggccaaggtgggcagatcacgaggtcaggagatctagaccatcctgaccaacatggtgaaactgcatctaaaataaaaaaattagctgggcatggtggcacatgcctgtaatcccaggtactcgggaggctaaggcaggagaattgcttgaaccagggagtcggaggttgcggtgagctgagatcgcaccactgcactccagcctagcgacagagcaagactctgtctcaaaaaaaaggaatgaattagaaagtgttccctcctcttacctatttttttttaataacatcttgagaaggatgaatgttcattcttatttaaatattgtataggtcactaattaagccatcttgttttgggttcttctttattgggaggttttttgattagtgactcaatttcattacttattataggtctattcatatgttttatttcctcgagtcagttgggaaatttgtgtgtttctaggaatttgtccatttaacataggttatctaacttgttagcattcagttgtttacaatattctcttataacccatactatttttttgtatgatcagtaataatattcccactttcatttcagacttataaagtcttctttttccttaggtttttcaattgtattgatgttttcaaacaaccaacttgctttaattgatttttctctgtttttctattctcgatttcatgtatagccactctaatttttatcacatccatccttctgccagctcttttactagttccataaggtataaagttaggttactgatttgaaatctttttcttaatataggcattttacctataaatttctctctgaggacttcattcactgtatcccataacgttgcatgtttgttttcattagtttcagagcatttcctgatttcccttttggttcttctttgagtcattgattgttttacagtgtattttgaatttccacatatttgaattttctagtttttcttttactgatttttagttatattccatttggttagagaagatactttatgtgctttcagtcttttaaaatttattaagacttttttgtggtttaatatccattctgtcttggagaatgttccatgtgcatttgagaataatatgtattctgctgttgggtggcatattcagtatgtgtcttaggtctaagtggtttatatagtgttatttaacttctctatttccttattttctgtccagttctatccattattgaaagtggggtattgaagtctccaacattattacacatctatttttcccttcagttttgtgttctttcttcatatattaatattttgtggctctgatgctatatttgaatctctttataggtgtggtatcttcttgctagattgactgtttgatcattataaaaatccttctttgtctcttgtgatagttcctaaagtcttttgtttttttgtttgtttgtttgtttgtttctgattttaccacagccaccctactatttgcatggaatatatttttccttccttccaccttcaacttgtttccttggatctaaagtaattttcttgtagacagcttataaatggactcatttggtttattcgaatccattctgataatgcttgccttttaatgaatgcatttaatccatttacattaaagtacttactgataaagaaggatttctgccattttgctatttgttttctattatgtctgtatcttttttgtcctgggttcctccactgctgcctttttgttgttgttgttgttgtttttattgttgttgttggtttgatttttttgcattgtaccatttcaactcctttctcatttccttttttgtacatgttttagttattaatggttaccttggggattaaattaacatcttgcatgtacaacagcctagtttgaagtaataccaacttagcttcaataatatctcaaaactatgttcccgtacatctccctctctccctttttatgttgttgttatgacaaattacatctttatacattgtgtaactgttaacatagatatataattactgttttatgcacttgtcttttgagtcatatagggaaaaaaaggcagatttctgaaccaaaaatactgctggcttttatatttacctatgtaattacttttatcagtgttctttattttcttacatgggtttgagttattgcctcttgttttttcaggctgaagaacttcctttagcatttctggtagttcaggtctacttgtgacaaattccctcaactttttgtttatctggaaattcattaatttcttttttgtttttgaaggataatttttctagatatttcagcacttgaaatatgtcatcccactgttctctggcctccatggtttcctatgaaaagttggctgtcagtcttacttgggatctcttgtatgtgaggagtcacatacatctcttgctgctttcaagattctcttcgtttttttgacagtttgaacatgatgtgtctctgtgtgcatcttttaaaatttatcctacttggagtttcttggaagaaagactcttggctttctcagatttggaaagtttgtaaccatgatttcttcatatattctcttttctctctccttgcctttggacttccatcatacagacaggcgttggtatttatgatgttgttcccataagtctttaaactgggtctatttttttttcattcttttttcctatttcttggattccatagttaatgaaatcactcatgtcgaatagtcacaaactgttaatttgttgagttttacaggacaaaaatctaacaattgttagttacttgattttgtacactatattagtcagcatagcttaaatcatcacagtagaggattaaaaacaaaacatgtaccaagtgttggctcttaaatcttctgttcagaaatgacacaaatcacttcccctcatattttataggccaaagtaaatcatgtggccacacctaattttaagaaggcaggaaactgcagttctgccgtctgtccagatacgaaaaacattaacatttacagtgtgtgttcccttccctactccatccccaatccattccttagcattcattccattatttctacgtgcagacagaggttactgtgttagtctctttaactctaattttcagttgcttagagccttaaatattagagtttgattatcagctcccttactttcttagctttgtgatcaagagcaaagttctcaatatttgtacgtttcagttttctctctgaaaaagtggagataattcctgtctcaaaagattacaaatgattggttgagaggatgtgtatagaacgttttgtacactgtttcatacatagtaaatgctctattcctattctcctggcattcagtgctttcataatctggcttcaacttattcttctagcctcatcttctgtgactctcttccagtcatctgatgctgtaccttatcaaattatagttgaattctaagtaataatattttttatgagaaagtcagaatttttttgttactgtaattttttaaagtttgctctattttagtatgtttggaagacaggatggaaactttcctgcgagatgtatctctaattttataatggaagtcatgaagaaattagaatttacttaaatttgctttaaagttcttgtaatactttagttgtaataaatgagaatattcatataaagaaaaacacggtttccagttttaagataggtaatgtggtttcaattctttctcttgataatcaccaacagaaaaaaagctgaaataaaattcccatctttaatttaaactagaggtatctccaacccttgagctaaaaatccaaagagaaagataaataactaaggaagagcatcaaacttgagcgcttaagaacctacaggatactgataaaaagcaccttgttttacctgcaaactcagaaaggcttagagcttagaaggactggtactacagaatataggagtgaggcaggggccatcaacatagagattgcttgaaaacactgaataaggattcctatgttcccacctcacaggaaatatactgtctggtttaacaatatgtattatatttaacagaagagtgagatgctaaagttgtcatagtgcctctttaccctgcttggctccagacttctgtctttcacgctttgatatcccaggcaggtttgagggatccttcctggagaaatggaaccactgaagaaaaactgctcaacaggtactagtatttgaagacctcaaaaaagtgctggctggccactaccctgctgaagtccaccagttgacagcctgcagacacgtagtcacctttttattgttaacctctaaaataagaacaaaggactaaacattgttagccattttaggaaagtttccagtgtaacttagaaacacataccagaaaaaaggaacttaaagtaaacagatacttgaaggaatgaaaacagtttgaggaaataattaacaaccttagacagattttggctaatcaaacaaggtaggatggtttaagaaaacggggggagtggatgagaaaattctcagaatgaaaagtacaatagtagaaatatattcagtaaaagcattgaaagaaacagttgaggaactttccctggatatagaataaaagacaagaataagagagaaaagagaaaattagagtttaatatgaggtttaatatctaactgactaggagttgtagaaagagagaacagggaatggagaagcttattattatattaaggaaacaaaacatgtaaatttcctagagtttaaactaaatacatcagtagattgaacaggtctaccaggtgctcagtgcaatgataaacattcacatacttgtagaaaaattaattattttgaaatttcagaacccatcggatatataaaaagaagatcctaggtacttcagaggaaaaagagctagtctgtgaataggaatgtcattgaactccacagccacacttgagaatctaaaaggacatgtccccagtgtacttatctcccagattcaaaagttgtcaacatccccctctccccatgcatgcatactttttaattattaaagcaactttcatatactatatcattcaaccctaaatgcttctgttttgtctgtaacaggtagacattttaaggaaaccaaaccacaatattattacccaacagaattaatagtttattagtgtcatcaaatactcagtctgtgttcagttttcccattttaactcagagctgttattttaggagttggtctgttcaaatcaggacatacgtcttttttgtttgttttcctttttatctttattttatatatatatatatttttattatactttaagttctagggtacatgtgcacaatgtgcaggtttgttacatatgtatacatgtgctgtgttggtgttctgcacccattaactcgtcatttacattaggtatatctcctaatgctatccctccctgctgcccccaccccacaacaggacctgatgtgtgatggtccctttcctgtgtccaagtgttctcattgttcaattcccacctatgagtgagaacatgcggtgtttggttttttgtccttgcgacagtttgctgagaatgatggtttccagcttcatctatgtccctacaaaggacatgaactcatccttttatatggctgcatagtattccatggtgtatatgtgccacattttcttaatccagtctatcattgttgaacatttgggttggttccaagtctttgctattgtgagtagtgccgcaataaacatacatgcgcatgtgtctttatagcagcatgatttatattcctttgggtatatacctagtaatgggattgctgggtcaaatggtatttctagttctagatccctaaggaatcgccacactgtcttccacaatagttgaactagtttgcagtcccaccaacaatgtaaaagtgttcctatttcttcacatcctctccagcacctgttgtttcctgactttttaatgatcaccattctaactggtgtgagatggtatctcattgtggttttgatttgcatttctctgatggccagtgatgatgagcattttttcatgtgtctgttaaagagcttctgcgcagcaaaagaaactaccatcagagtgaagaggcaacctacagaatgggagaacatttttgcaatctactcatctgacaaagggctaatatccagcatctacaaaggactcaaacaaatttacaagaaaaaaacaaccccatcaaaaagtgggcaaaggatatgaacagacacttctcaaaagaagacatatgtctttttaagtttccactgaaaggagtctacctctgtgttgttttctgtcttaagctttctagccctatttgaattttaacttctgtatatatattactttggaaaataaaatttaactttaaaaccagatatattaatacatcgaagacatctcagtaaatcatcacagactgtgtgttcagcagtttaaatgtgactcctataaactaattactttcatgtcctttttacaggctgtcacatcagtcagacatgttagttgaacacgaacctgtatggttaaacattagctagtttagtcatttagacttagaaggaattaagtaagtactccagttcatagtagtagcaggatagaatggtaataaatcaccacaaaactttataagaaaaatagtctgtaacaaaaaaataagcaaaaataagtaagaaagaaaactaaaaaaatgagcatcaaaatatatttcccaaagccaggaactttgaaagctattggacttgtttgcctctttgtgcatattttaatagtatcgacaaattataggaatgtacttgactggaaagggagagatgacatcagcaggctaattgttgccacaagtgatagctgatggtgagagacagataactgttaaattccagcacaggcactgaagaagatactggtctaccatgccatgtggagataaagaatacaaaacaacctgtagtcctttgaagggtcgtgtgtgacagttcagttaagttggcattgacccagcactctactgcagctatttgatgccagggatttaaaattttaggtatttagctacttattactaagtaacttgtgaaacatctcctaattgcacccttgaatttcaccttaattctgattcacacccaaagaataggaatgaaggataaggtgtggagtaagtaaagatgaagccacacgatttggatcactgggacagatactgtatagaatgatacttttttccatagttgtccaccttagaaagggccctcaggaattttaaacaaaatgcctgttggttctctttagagttagttcacttttatttcaagtgggtttttttctcagattctctgctcttcttcccaccctcctaacacaaattacattggtcaaacatttatttccaattgataagtagataatgtctgctataatagaatttaagtctgtttttcatttgagaatctgaaggatgaatacctgatttgtaagttttatttcatttactttatttgattgtatgtgtattagccacagaatggaggcaaattcagcatctttctttaactctatgctgtttgttttagaggaagtccacaaatgaaggggacaccccattttaaggaagaacagtgtgctccagcattaaatttggagatgaggaaaatactggatttacaagcacccatcatgaggtacagtactttggttaaatttgacattgtgtgatgacagtagacaatgtagttcgtaaatcccatgaccaacaggaaagttagtttaatttcttttaattcaagataacttcttagttctggaaatgcttgattaacccttataagacaatggaagttttacagatggcacttaatacttaaattattataataaaattgaatataccaactataatcttattttgaaatttatattttataaggtctagaattgtttgattgagtgataacagtccatatttcccaaaacaatactgatgaaagcacacaagttgaggaaaagagaaagtgcctttgtttccaaagttgccataagcttctgggaagtttatatacacttggaagaaagttacactttttcatccaagtatgaataaaggttttatgacaaagtggccagaaataccagaataccaaaaatctattttatacccattggtagaaaaaatcttacctacaatttggctttatttctttaattgttgttccactattgatgttttagttgtcacttagtttagctgcatatcttttccattgtgtagatataagaaaatttatttaaacgatacgcagctgtaaaaacattgaggacattctttatggaaaaaaatctttccaaatatgttgttgggtgaaaaaagcaaaatgcttatgttgctaatgtttgtttttaaaagggagatgaggtatctccatcttgtttaaaagagagagcatgtatttttctggaagaatacataagaaactggggatgagaactgagtagctatgggacaggtttgggggaaaagctttttattgtgtactcttttttaatattgaactatgtaaatgtattgaattatatgaatgtcatgctacttttaaaaaaatccctctgactcacagttctaagtaaaggtttatttcaccatttctcttgttagagtactgtacagaatgatactgaaacattaaaactatgcaagtggctgggtattgtcttgccttgtttggtccatccccttcatatcttattctcatagaaaagaacacaattattatttgcttaaatgtaatcagtgttacagaagattgagttcaaagttactcatcgccttggtcacaaggttattcatcacttcacattttatttatttcagcatgggaatcgttttcaagaaagtaacttgatacataaggaattctgagtgtctgtaggtaccaagaaaaggtggaattgtacaggcttggctttctacctccacctggtgggaaaccttgtatggtgcatggaaatagaatagaaaaagagccaaaaagaaaaaaaaacaattctgccatcttgtccaagtttaacctgtcaggtgctaggttttaatctatgaatttaggtggttggaaatctgtaaggtttctctcaaaactccagtgaaataactgcatttcagaacaaagttatcagcacctgaaacacataactgctggaaatttgaaatttgctatagattttaaatcgagtgagaagacatgaaacttagatttttataaccaattattttccctcctgtcaccacaaatataagtcagataaggctaggatattggttatgctgttgcttataggggtaagagtactatctcatcttttatttttgatttgaagaaaaaatattaatgttaagcatctaacttttgttattaattgaggatagagaatgtttagaaggtaaaaacataattttaatgagagtttcccctcccctcccttcccctcccctcccatccccttccctacctctctccccactcctccgacagggtctcaccttgtcacccaggctgaagtgcagtggcacaatcacagctaattgcagcggcatgatcacagctcactgcagcctcagcctcctgggctccagtgatctcacctcagcctatcaagtagctgggactacaggcacacgtcacagcacgctaattttttgtactttattgtagagacaaggtttcaccatgttgttgaggctggtctcaaactcctaagctcaagcgatctcccctccttggcctctcaaagtgctgggattgcaggtgttgagccaccacacccagccaagatcctaaatttaaacatacatttaacacacacgcacacctgggataccacatagctctcataaaattaatgaagtcaatgattgaagaggctctctaaggatataacttagagtgtatttacctaaatttttaaatgtactcattaacagttgtgatattaaaaatatttcagaaccaggctgggcacggtggctcatgcctataatcccagcactttgggaggccaaggggacagaagggcagatcatgaggtcaggagtttgagaccagcctagccaacatagtgaaaccctgtctctactaaaaatataaaaattagctgggtgtggtggcacacgcctgtactcccagctactcaggaggctgaggcacaataattgcttgaacccgggaggcagaggttgcagtgagctgagattgtgccactgcactccagccagggcaacagagactgtgtctcaaaagaaacaaaaatttaagaaccaatacagcatgaaaagacatgggttattagttatcgaacagggttctgacatcgccctactacgccaataatgaatccttcagttggccagatttttctgagggaggggagtcagttgtagcaaacacttaggtgacttggggcaaggtctatttaccaacatttatagaattattagtattttaacaactgacaccagcttttttatttctaaatttttttagaggtggtagtctcactgtgctgctcagttggtctcgagctcctgggctcaagcattcctcctgcctcagcctcctagtagctgggattataggcacaagccaccacgcctggctcagcctttgttttaacaagtttgtccactttcaattaaatgagaaggatatatctatctcttcctgtagattatttattatgtctgtcacagtttttaaaaagcctatctgctaattccaatatcaagattatctataagtctatttatattgatggatttttctcttgactctaggttacattttcctgtttattcacacatctggccagtcatttgtttgttgcagcatcactgattatcatgttatagagattatgaactcttaattttgtcagacgattgttgagttttgtctagcaggtagtcagattactggaggataactctgttgtatacagtgattttctagggagatagggttaggggagagggagaatgtagtttggaataaacgatgctgactccttccaaggaaaatcactggtaaaccagtgactactctgctaaattgcctctcttgacattgtcaacttgaagtaatcaaaaggatcagattctggaattaatgcaagcagaaagctgaccaatccgggagaacagacttcagaaaatggggtcagtgttccaaagttaaaagttcagttcttgcaggccaggcacagtagctcacacctataatcccagcacactgggaggccgaggcgggtggatcacctgaggtcaggagttcaaaaccagcctggccaacatggtgaaaccttgtctctaccacaaacagaaaaattagctgggcgtggtggcgcatgcctgtcatcgcagctactcaggaggctgaggcaggagaatcccgggaggcggaggtttcagtgagctgagatcgcgccactgcactctagcctgggcagcagagtaagagactgtttaaaaataaaaaaaaaaaaagttcagccaggcgcagtggctcacgcctgtaatcccagcactttggaggccaaggtgggtcgatcacctgaggtcaggagttcaagacgagcctggccaacacggcgaaaccttgtctctactaaaaatacaaaaattagctgggcatggtggcgtgcgcctgtaatcccagctactagggaggctgaggcaggagaatcacttgaacctgggaggcagaggttgcagtgagctgagatggtaccactgcactccagcttgggcaacagagcaagactccgtctcaaaaaaaaaaaaaaaaaaaaaaaaaaagttcagttcttgcttatataggtggaaaataaagtttagtaggattataatgttttctatacaaggctggtttatgagttacaatttagttacagtttgttttctttatggcttgtctttacagctagttttcatttccaatttaaaaagagtgtatttaacattccattttaagacaatgtgatagccatgaagtctttgtgtaagaaagataagagggaagttaatctaccatgaagatcaacagtgaagagggaaggggtcttccctggagccctttagtcatttacagcatttataaaacaatacagtaaggaagaaagctaatctataatcagagaaagaaagatgacagctgcctagattatagctgcctattgtgtgactcaggccccataattacatttctttaaggctcaaaagtaattcagatttccaacagcttagattttgaattacatattttcatagcatatagtagtgcatctaaaacataaactttttatactctacccaccaaatgatacacatagattttatcactgaaatataaatttgaaattaatatataatgctttaaaaagtgaaatgtctaaaaactgggaattttaattgattacaaatggctgtgaagttcaagaaatagagctgggtaaagaaacatctgtttctgatctttttcagtatttttatagttggggaaaaaacagcaaattctacattagctgaaatctttggagtatgagtaattgaagtcaactttccaaagaattaaaggtttagtttaagaattaaaatactaaaagacatttttttcatcattatggattaaaatatttcagaaatatgctcttaagtatgaaaaggaatttaatagtatttaatagggtatatataatatacacataacattttttgtttttccttatatagtatttgatactttgaacactctttcttaaattcatcttacttccttggctttcttgatatcagtttctactggtttccctggttgtctttttctttgtgccagtacctttgcggtctcatttatgggttcctctttcctctaaccctttccctcttcttgcctcctttgcacaaatatttagtgacagatttaactaacactgcccttggggctgtgcatacagaggtgagcaaaacaggctatttccccattaaagaagtaaatgctgaatatcttcataaatattgataagtgatgagatcatgctatgtaactatttttgatttcttgcctgagaagtcctctgaagacggagaatattttattcatcctcgaatatccagcacacagtatagcacctgtcacagaggataggctcagtaaatgtttgtagaaggaatgaacaatgtgagacttgctaatacctaagaaatatattggcctggaactatactccaatacagtagccactagtcacacatgaatttatttaaatttacattaatgaaaagtaaataaaatttcagttattttattgcactagccatatttcaagtgtatagtcaccacatacagctcatagctactgtttacagatagcacagatatagaacatttccatcattattcaaagttttattggacaagtgccagagcattgttacctctacacttaatggctctagattgtcatactgttattagttgggtttattcattttatggtttctctacctctttttctttctttctgctatcacttctgtttccatcttctaatttgctgtttcaatatttgtagtttttaactagttttatcagttatcaagtttgtgactgtgagtgcccatagtctttcatttctttcaggatttctgattctagattgaaatatacatagataaagttgcagataaatggagatgttttgtaaatggtttcatgatcatttttgcatgagtattctctaaagcagttttaatattcatacacattgctttcccagtatgctctcttaaaaattaattgattctacctacagtttgcagtctgtgttggaagatctcctggttgctacttctgatggacttcttcatcttattcactgggaaggaatgacaaatggaaggaaagccattaatctttgcacagtacccttttcagtagacctgcagtcatctagaggtagctatactttctacatgaggttgaaccagttgtttaatgtttgatgtctagttaggtatcttctatggatgaacacttctttggaattacttatgcaaggggagaggtgggcagagtatgagaggcggggtgagagaggcatttaataggaaaggacagtttaattatttagggttgttaggtcattatttttacccttttaaacttacaggtttttctggcaaaaagtgagagagtaatttattatattcttaatcctatttcatgtgcttatttttttcatcagtaggttcattcctgggcttcacagacgtacacatcagagacatggaatactgtgccacacttgatgggtttgctgttgtatttaatgatggtaaagttggatttattacaccagtgtcaagtagatttactgcagaggtatgacttatttactttgaagggttttttgttattgtgtacttattttattctttgttatcaaattcttctctattttcatcattcatgtaagattttaagggttgttaattttttaatcaaaccaaacatataaatagtataagtagacaaaattctcttggacatgttaaagaaaaataatgattcctgttctcctccctgctctcctcatgcctaattttccacttttggaggcaactacttgttattcctttactggttattttgatttttaatctccactactctgaatatttcctttaatttttagttcttaggctgtgtttattgacttcttactgttgaaagtgaccatttacttccctcttccctgcttccaccatacttatattcttctcatgttcccattatagttattgtgattttgattaggttactattaattgtttatatttttatcaatatgtaagccccattagtaccgaaaccatgtggtactgacgcagaagtttttgctccttagtttagctaaaagcaggttcttgtcacacagccaggaaagattaggcatgcagacatactgaaaggtgaggagagcagaatttattaaaagcaagctctcagcaaataaagatgatgtcctgctaacaggctcccacttcacagattgattaccaaaccccagcacacacgcgcgtgcacacacacacgctgaagagccccagggtcctacccgctgaacaaggcgtgaacttaaccccattctcctagtgcgcttgtgggcattattcagaaagaatcactcaggaaacggcaaacgggcagttatttatccctctggatcaccagtttcatctgggacaaggagtcccatctttcagccttcaggcactttttgggcttgaaagtgggttttcactggggacccttggccaactcctgtctctgtcagtataattatttttcctttactgcagatttttcctcctgctaggaattaatgattgccttgttctttacatttgcttaatttttgtgtacttatctcttactcaacccaaactgtcagttgtgtaaatatcctcccagctttttcaaacatattagctgttctgttcatttcatcttttttgttttcttttttttttttttgagatggaattttgctcttgttgtccagactggagtgcagtggcacgatctcggctcaccacaacctccgcctctcgggttcaagcgattctcctgcttcagcctcccgagttgctgggattacaggcatgcaccaccacgcccgcctaattttgtgtctttagtagagacggggtttctccctgttggtcaggctggtcttgacctaccaacctcaggtgatccacccacctcagcctcccaatgtgctgggattacaggcgtcagccatggtgcccagcccatttcatcttcttcttctttttttttttttttccacagtaccacaaaacaatttaatggaggaagagatttttttttttttttttttaccccgaggaactatatcacttaaggatggcttacagaaggaatgagcttgcaaaaactataagagagagagagtgtgtgtgtgtgtgtgtgtgtgtgtgtgtgtgtacctatgcagtgtatgtgtgggtctataggtatgtatcacacgtccacatgcatgttcatagcctccatgcacatgtaaatatttcttcacataaacttttctgactttaatactagaaagaacttacactggttttctgaagcccactgtgatatcagagatccctttctaaatctatctttttatttacttttttaagttctagggtacatgtgcacagcgtgcaggtttgttacatatgtacacatgtgccatgttggtgttctgcacccattaactcgtcatttacattaggtatatctcctaatgctatccctccccccctcgccccaccccacgacaggccctggtgtgtgatgttccccaccttgtgtccaagtgttctcattgttcaattcccacctatgaatcagaacatacggtgtttggttttttgtccttgcaatagtttgctcagaatgatggtttccaacttcacccatgtgcctacaaaggacatgaactcatccttttttatggctgcatagtattccatggtgtatatgtgccacattttcttaatccagtctgtcattgatggacactgggcttggtaccaagtctttgctatttgaatagtgccacaataaacatacatgtgcgtgtgtctttatagcagcatgatttataatcctttgggtatatacccagtaatgggatggctggatcaaatgatatttctagttttagatccttgaagaatcgccacactgtcttccacaatggttgaactagtttacagtcccaccaacagtgtaaaagtattcctatttctccacatcctctccaggacctattgtttcctaagtttttaatgatcaccattttaactggtgtgagatggtatctcattgtggttttgatttgcatttctttgatggccagtgataatgagcattttttcatgtgtctgttggctgcataaatgtcttcttttgagaagtgtctgttcatagccttcgcccactttttgatggggtggtttgatttttttcttgtaaatttgtttaagttctttgtagtttctggatattagccctttgtcagatgggtagatggtaaaaattttttcccattctgtaggttgcctgttcactctgatggtagtttcttttgctgtgcagaagctctttagttgaattagatcccatttgtcaattttggcttttgttgccattgcttttggtgttttagtcatgaagtccttgcccatgcctatggcctgaatggtattgtctaggttttcttctagggtttttatggttttaggtccaacatttaagtctttaatccatcttgaattaatttttgtataaggtgtaaggaaaggatccagtttcagctttctacatatggctagcccgttttaccagcaccatttattaaatagagaatcctttccccgtttcttgtttttgtcaggtttgtcaaagatcagatggttgtagatgtgtggtattatttctgagggctctgttctgttccattggtctagatctctgttttggtaccagtaccatgctgttttggttactgtagccttgtagtatagtttgaagtcaggtagcgtgatgcctccagctttgttcttttggcttaggattgtcttcgcaatgcaggctgttttttggttccatatgaactttaaagtagttttttccaactctgtgaagaaagtcattggtaacttgatggggatggcattgaatctataaatgaccttgggcagtatggccattttcacaatattgattcttcctatccatgagcatggaaagttctttcatttgtttgtgtcctcttttatttcgttgagcagtggtttgtagttctccttgaagaggtccttcacatcccttgtaagttggattcctaggtattttattctctttgaagcaattgtgaatgggagttcactcatgatttggttctgtgtttgtctgttattggtgtataggaatgcttgtgatttttgcacattcattttgtatcctgagactttgctgaagttgcctatcagcttaaggagattttgcgctgagactatggagttttctagatatacaatcatgtcatctgcaaacagggacaatttgacttcctcttttcctaattgaataccctttatttctttcttctgcctgattgctctggccagaacttccaacactgtgttgaataggagtggtgagagaggacatccctgtcttgtgccagttttcaaagggaatgcttccagtttttgcccattcagtatgatatttgtgggtttgtcataagtagctcttattattttgagatacgtcccatcaatacctagtttattgagactttttagcaggaaggactgttgaattttgtcaaaggccttttctgcatctattgagataatcatgtggtttttgtctttggttctgtttatatgctgtattaccgttattgattttcgtatcttgaaccagccttgcatcccagggatgaagccaacttgatagtggtggataagctttttgatgtgctgctggattcggtttgccagtattttattgaggatttttgcatcattgttcataagggatattggtctaatattctctttttttgttgtgtctctgccaggctttgatatcaggatgatgcaggcctcataaaatgagttagggagggttccctctttttctattgattggaatagtttcagaaggaatggtaccagttcctctttgtacctctgatagaatttggctgtgaatctgtctcgtcctggactttttttggttagtaggctattaattattgcctcaatttcagagcctgttattggtctattcagggattcagcttcttcctggtttagtcttgggagggtgtatttgtccaggaatttatccatttcttctagagtttctagtttatttgcttagaggtgtttatagtattctctgatggtagtttgtatttctgtgggatcggtggtgatatcccctttatcattttttattgcgtctacttgattcttctctctttacttcttcattagtcttgctagtggtctatcaatttcgtcagtcttttcaaaaaaccagctcctgcattcattgatttttttgatggtttttttatgtctctatctccttcagttctgctctgatcttagttatttcttaccttctgctagcttttgaatgtgtctgctcctgcttctctagttcttttaattgtgatgttagggtgtcaattttagatctttcgtgctttctgttgtgggcatttaatcctataaatttccctctacacactgctttaaatatgtcccagagattctggtatgttgtgtctttgttctcgttggtttcaaagaacatctttatttctgccttcatttcgttatgtacccagtagtcattcaggagcaggttgttcagtttcatgtagttgagtggttttgagtgagtttcttaatcctgagttctagtttgattgcactgtggtctgagagacagttggttataatttctggttttttacatttgctgaggggtacttccaactatgtggtcaattttggaataagtgtgatgtggtgctgagaagaatgtatattctgttgatttggggtggagagttctgtagatgtctattaggaccacttggtgcagagctgagttcaattcctggatacccttgttaactttctgtctctttgatctgtctaatgtttacggtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttagcattatgcaatggccttctttgtctctattgatctttgttggtttaaagtctgttttatcagatactaggattgcaacccctgcttttttttgttttccatttgcttggttgatcttcctccatccctttattttgagcctatgtgtgtctctgcacgtaaggtaggtctccagaatacagcacaatgatgggtcttgacactttatccaatttgccagtctgtgtcttttaatcggagcatttagtccatttacatttaaggttactattgttatgtgtgaatttgatcctgtcattatgatgttagctggttattttgcacattagttgatgcagtttcttcctagcatcgatggtctttacaatttggcatgtttttgcagtggctggtaccagttgttcctttccatatttagtgcttccttcaggagctcttgtaaggcaggcttggtggtgacaaaatctctcagcatttgcttgtctgtaaaggattttatttctccttcacttacgaagcttagtttggctggatatgaaattctgggttgaaaattcttttctataagaatgttgaatattggcccccactatcttctggcttgtagagtttctgcttagagatctgctgttagtctgataggcttccctttgtgggtaacccgacctttctctctggctgcccttaacattttttccttcatttcaactttggtgagtctgacaattatgtgtcttggagttgctcttctcgaggagtatctttgtggcgttccctgtatttcctgaatttgaatgttggtctgccttgctaggttggggaagttctcctggataacatcctgcagagtgttttccaacttggttccattctccccgtcactttcaggtacagcagtcagacgtagatttcatcttttcacacagtcccatttttctgggaggctttgttcatttctttttactctttttttctctaaacttctcttctcacttcatttcattcatttgatcttcaatcattcgatcaaatcggctactgaagcttgtgcaggcatcacatagttctcgtgcgatggttttcagctccatcacgtcattttaggtccttgctacgctgtttattctagttagccatttgtctaatcttttttcaagattttttgcttctttgcaatgggttcgagcatccttctttagcttggagaagtttgttattactgatcgtctgaagccttcttctctcaactcatcaaagtcattctccatcgagctttgttccattgctggcaaggagctgcgttcctttggaggtgaagaggtgctctgatttttagaattttagcttttctgctctggtttctccccatctttggttttatctgcctttagtctttgatgatgctgacatacatatggggttttggtgtggatgtcctttctgtttgttagttttccttctaacagtcaggaccctcagctgtaggtctgttggagtttgctggaggtccactccagaccctgtttgcctgggtatcactagcggaggctgcagaacagcacatattgcagaacggcaaatgttgctgcctgatccttcttctggaaggttcatcttagaggggcacccagctggattgaggtgtcagttggcccctaatgggaggtgtctcccagttaggctacttatgggtcagggacccacttgaggaggcagtctgtctgttctcagacctcagactccgtgctgggcaaaccactactctcttcaaagctgttagacagggacatttacgtctgcagaactgtctgctgccttttgttcagctataccctgcccccagaggtggagtctacagaggcaggcaggcctccttgagctgcggtgggctccacccacttggagcttccctgccactttgtttacctattcaagccttagcaatggtagacacccctcccccagcttcgctgccatcttgcagttcaatctgagttgctgtgctagcagtgagcaaggctccatgggcatgggaccctccaagccaggcgcaggatataatctcctggtgtgctgtttgctaagaccattggaaaagcgcagtattagggtgggagtgtcccgattttccatgtaccatctgtcatggcttcctttggctatgaaaaggaattccccgaccccttgcacttcccgggtgaggtgatgccctgtcctccttgggctcacactccatgggctgcacccactgtctgacaagccctagtgagatgaacctggtacttcagttggaaatgcagaaatcacccatcctctgcatcactcatgctgggagctgtacactggagctgttcctatttggccatcttggaacctcccatttcatcttcttaaagaaatttctctgggagccttctggcctgctccaaattagactgcttgcttactataatctttaacacagctgttttttggccttctgtcataattatcctgagattccctttactcttatttgtgtcggatcttttaatagctaatagctaattaatatatggatttggctgctgtgacagagacctaaaattaaaataatttattgaaaactgtgaattttggttcgtttggtttactatgtcctttaccataggatgagctgactgagttatttacttgggggtcctcctacctttagagccatacccttccctctgtccctcccttctgctcccctctcccctctctgtctccagtgttccttggaaaagagtcctgcagtcctttctagaggatatatacttggctaccccagtattctgggatttgagttacagaagagttaagctagcgggtccaaattcaagatgtgaacctttattttctatccctgttttcagtgtggtccataggcctctggtggaggtggtaggggtgggggtgttttgttttgtttttctccaaagaaaaatatccagttttccgtaggagtggaggtagggtatttattggctgctcagctttggggaagtgctctgggaggacctggttgcttctttaagtaggttttgaaccacttctactacatttaatttagcctttcaaagacccctgaattcccaagcctttcgtgtaccctacaacttaaatttagacgtttctcagcattcttccctgtcagttaaggattctactcattgatatgctttccagcttctaaaattttctaatgccgcctcctattatttttgtctttgctgctttatgtttttttaaacaaaaactcttttctcttctagaagttacagttttaggagtccaagaagctaaatatttatattcagtcatctctctttaactggaaaggaatttaagtttttaatggccttttttaattgttgtcattctgtttggtatcaactttaatattcctatctactatcttccgttatcaactttattcagatagtaaggtactaaataatgtatttgtgatcacctgtgtcagaacataaataagaataaaaataaacttttgatgaattagaaaaaactcttttttttttcctataaggtgcatatatatttgtaattatctttgggacttaaatgtttagactggaaataaaaatattagagctgaaaaagtgattgactcttttccaagtactttagagttagtacaaaatatattctcagtgtttattagtatgtaattaaataattttttctaataagttaaggatttaaaaactaatgaaaagcagatgggcattactaaataaggtatagatagaaaatacaaattacaagaaaacagtacctatgtattaatggtaatagggaaataactaaatgacatttaacagatgtgttaaaatgtgattatgtcagtcctctgtggagactcattcagtaggactagattattaggacagaacctcctgaggactaaaagagctggagaaaaaatatattttttaatatgcttgaagcccttagagagcaaacaagacagtaaagagttgccagactaagggaggccagcaatccagtgagctaagcccaatatttaagcctacaatgaacatgaacaaattaggctatatgcaacaacacagatagatcttacagacatggtaagcaaaaaacagctagacacaaaggaatacatgctatgattccattttaggtaaaaattaaagggcaaataatgtaggcatttctaaattagagtatatatgggtgcatgtttaagtggtaatgatttaaaagaaagaaggaggtgattaccatgtaaatctggatattttttgttgtaggggtgtgaggatacagtgattgggaagggcactattgggagacttttgggtactcatgattcttggcctgagtagcaattccacaagtgtttgctttgtgatattgagatgtacatttcattttcatgtattctttattataattcatgacagaaaagtttaaaaaatttgaatattcttcttctatataacttgaagaaaaagccaaaattcttatggtggccttcaaagccctaattatctgacctcctgttacatctcttaccacatatactactttcctttcacaacccatccacttcactctatccacacaggcttctttgctggtctttgagcatgccagaaatgctcctacattagggcttttacacttgttttatttctttgaggactttcctcaaaaggcatccttatagggaaacctgtttaatattacatccttcccctgtactccctcttcaccagcattgcttaattttttttgtatagtattttttaacctccagtattcaatatacttttttaacttgtctgtctcttgactcaaatgtaaagcaagcatacaagtagagattttggtgtgctagtatagcctcagcacctagagcagtgcctggtgaatggtaaccacctagaaaatacttattgtaggactgaatttcagtctaagcagcagttcagagaaataatgctcactgctgtctttaccatttgtgacataaaatgtccagttttattattaaaattaaaagatacaattcctactaaagcaaagattccgtgtttagatagtagattatatagctgattgtggaattaaatgaaatctgtaggattctagttcatatagttgtgattatattgtatctttaatgtttactattaggatcatccaaaaataaagtgctatattatagtgtgccactttttctgctaactgaactaatgattatgacctttgccttggaatttatcatctaaaatgtctgtgatttgacagataggagcaaacaactgagctgaatctattctctatatatggagatggcatatggaaatagcatatatgcttactaataatgtcatttatttattgaatgcttgttgaatggtaggcattgtcctaaatagtttacatgtgtatcttcatttaatctttgaaacaccctgagaggtaaatacgataagaaaactgaagcttaaaaaagatcaaatacttattttgaggagtgaaagcagtcctgagctgtcaggcttccagataccatgctattaaccattacactataaagaagggaattgtagagaatagtaagcaattttgcttctaaagaataaaccaaacagaatgtactacttttcactgactgagaagttaaatactatgtgctaggtgatgagaataattacagtgagcaagttagatgctgtttccgctgtcaaaatgtttacattctaacaagaaagtcatctttatttgaatttggagatgaatttccatattttagtgttttttaaataaattaactagcactggactgagctgagtatttatcagaccaattcatgagaagtttgaggttttaagggagactatttggtagtattttaagggagactattgtggtagtcctggtgggatattttcctctgcagatgaaaccaaataaagcattatgaaattgtatgtttattgaaggagaattatattgactacggtaaatttggagaaacactttttaagccttaactatttttctttattatagcagcttcatggagtttggccacaagatgttgttgacggaacgtgtgtagcagtaaataacaagtatcgactaatggcatttggctgtgtgaggtataattgatgtaggcttttgcatttttaagagttgttgcaaaaaatactggtttttttttttgtaaacataagatgttcctaacatacttataaactgcatcatgctatcataatttatcagtcaaccttaatatgaaatgtaaaagtattttattagattgaaacaaacaaaagtaaagggcagattttggaggttgagcatgttaatttgtaaaagttagcgttttcttcagtggtggaaaattgagttacaagttaaacagaataaatcagttaaagtttaggttctttattgtttaaaagaggatttggaagatttttttaaatcttaatttttaagacatcagcattcatgacgccttcaaattagtgagtgtgctttagttaacaagcaaatttaaagtgcacatataaaaccagtttcttgccttagtttattaaatagagattttagaaaaaaattgaataaaattatttattcaacaagtatctgtatgcctatcacataccagccatagttctaagcacttgatacattagaaaacaaagatactgaacttggttgagcttaaattttagctcataaattttagctaaaataaaacgattatattagttgttataatgccttgcaatgtatatagtgctttttagttttctaaactctttcttaaataaaaaatcctatgttgccctcaaaatgagacttggttgttctatagaacatatatctagtatagtctccagccatatcatcaccacccaatttaagtatcaaagattttttttttttttttttgagatggagtctcgctctgttgcccaggctggagtgcagtggagcgatctcagctcactgcaagctccgtctcctgggttcacgccattctcctgcctcagcctcccgagtagctgggactgcaggcgcccaccaccatgcccagctaattttttttgtatttttttagtagagcaggcatttcaccgtgtttggccaggatggtcttgatctcctgaccttgtgatccgccttggcctcccacagtgctggattacaggcgtgagccaccgtgcccggccagatttttttattagtataaataattcacataaatcactttcattacactcttaataaactctttgtaaagtagggaatcctcatcctcaactttttctcaatacattgatcctcattgagcagttaaatgtagaaatacgagtaagtttaacttagtacaagagagaaggaaaagcttttttttaatgtttgtggattggattcagtcatattttgtttagaattttaaaatgtatgttcatgaatacatttcacctataattttcctctttactcttctgagtaaggttatggctgtctcataaagcaagttatgagaatccctcccttctttgtcttctctattcatctttgaatgtttggtagaatttgccaatgagaagccatctagacctagaattttcttattgtggatttttttggactactgattcaattcagtttttaaaaatatacatatatataatgtatatattttagatatatatatttaaatattataaatatatataatatatattttaaatatatatatatatttattttattttattttattttttgagacagtctcgctctgtcgccctggctagagtgcaagagcgtgatcttggctcaccgcaacctctgcctcctgggttcaagtgattctcctgtcttagcatcctgagtagctcggattgcaggcatgcaccaccatgcccggctaatttttgtatttttagtagaacggagtttcactgtgttggtcagtctggtctcaaactcctgacctcgtgatccatccacctcggcctcccaaagtgctgtgattacaggtgtgagccactgggcccggcccagttttaaaaatagatttaagaagattcagattttgtatctcttcctatgtcattttggcaagttgcattttttccaggaattggtttctttcttatacaccttcaaacttactggcataaagtttataataccctttttatttcacattgtgaaacaaaaatatgcatacaaagtagtacataatccagatattcatagttttaacgttgtagtagaaacacccatctcttcacaactggatcagtaaatagaacattactggtctccagtcacaaactgcctctgctacttcctagtcacaactcttattccctccttgactcacttagtaactggtcaacattgtgagattcatccatgtcatttaccagtagttgtaatcattttttaaattggtttataaataacgttccattgtctgaatatagcataatttatccactttgctgttgacatacttttgccttatttcttggtttctaaaaaaggagacattctcttgtataattggaatatctttatcacatgagataattaatgataaatccctaataggatctaatacccaatttatatgcaaattaacccagttgccaccagctaaatttcttctatagctcctttgttccaaacagaatcgatcaagattcattaataatatttggttattatttctctttagttaccttttaactacaatagtccttatgccacttattttcatgacattgactttttttgagtctgagtcgattctttatagaatatcctgcatcctagatttgccttattgtttcctcatgatggcatttaccttgtttatctgacacctgtcgtgactaacctggaagctagttcttgttgagcaatacagtcaagtgactagaaagcccacacatcaggcatggaaaagtatttagagaaaatacacagagacagaagcagtggcaagtgtgcagttccatttactgcatttggggccagcacaagggtgggtgttagaatccagaagaagtactcctccctaggctatgggcttataagctacatgattgggaagtactagcccttcccaggataatgtaggtagactcttggcctatagcttttcagtcacctcagttttcatcagctacgagactacaagttctcttctagcatgcccatgggttagggttaaagttttgtgattctagctgttgacataacaaaccagtgtctgctagtccagatctgccaacacttatcaggactaattaccttgaacactaggtgatagctggtgtccttagagttgtgtaagaagccagcttccttttaggatgccagtttgcagcagatcagtattttaacaaccttcctgttaacctaaatatttaaaggtattactagattctggttacacattttgtcatgggtgatgatatatatttcctatggtatcatttagtaataatgtcaagttgtttcagtattaatgacactaaatttgatcacttatggtgataatagtcatatctctcttatagagatttgctttggagttagtaagtcctgtctttttaatgaaaatatatttttctgttacattgggctggtgagaaatggaaggaaaagtagtttaaagaatacaagcactatagaatacctaaaagattgtcagacttttataagtagtaacttagcacctacttcttatatttaaaacatggactcctcactaacattttagagctcagcaacccagggttagcagttgacagttgtcagatgcaaagcaaaaacaaacacctgctacccacttagtgctgtctctcagcaagagttgatctatttgggcaggtagtctggaaagaaatctttttcagatatttggcttctgggtatgattgaatgacagatgacattttccctcccacctgatacagccaagaaaacggacaaaaatatgaaagagctgttttgaattcagaacacaaacataaggtaacaagggacagtgatttctgaaagatgagaaacaaaattatctctctgtaactgcccttagtttttattattttgagtgtttgtaggctgcagcacaggattggggagatacatcctgagctgagataagcacatggaaatcagagaatctgggaaaaccaaggcagctagagttcataatatagacaccaaagaggtggcacaaagagagaacttcagagagctgtagagggtctctcttgaatattaaactgagacatggaagatattagaaaaagactgaaattaaacttctagaggtgaaaactatgatgtctgagatgaaaaacatactgtatggaactaacaacagattagacattgcagaagagaagattaatgaacttgaaaaacagaaattatccaaaatggaacacagaaaaaaaagaaaacaaaaacagagtatcagtaagctgtgggacaactttaaggaggctactattgcaggtcttttagttagtcccagttctaatccttgagaagaggtaggacctggatgggaatggatcaaagctgctgtgaagaaaccatctgatttctcctaccaccaaaaaaaaaaaaaacaatctggtagtcataaaccagtgtcatcctattatgtgcaaaagcattcttatattaaaaagtgtctttaagaacatttgtttctctttctcactataaatgttgcataagtaatctaaaacaggagcctcattttcaaatgctgaatgtgcattaaatttttgaactgagaatataccatgagcagaaatgagacttttctgttatcctcgtagttcaattttgaaatgtggcttagacgtattatagagattttacttctggcttcaggcccttcagaaatttgacccttgtaaagatgttttaaattaagtaattatatataccatatacacaaaaaagcatatagattttaaaaataaaatgtttataaattaccatccaacataagaaataatacatcaccagtgctgatgaagcctcctgtttacccctcttctttgatactcccttctccaccagagtatcactaatctgaaatttgtatacattaactctttgttgtatttttaccacaaatatatttactattaatactgtatatctactatatatatatcaaatatgtatgtttatatttactatgcttttacacacacacatgttttatatcttaaacgtatatactgttgaccgttgaacagcccaggggttagaggtaccaaccccccaacacagttgaaaaatttacatataacttttgactcgcccaagacttttaactactaatagcatactgttgactggaaaccttactgacaatatagtcaattaacacatactttttattttatatatattaatattatatattgtattcttacaataaagtaagagaaaagattattaagaaaattataaggaagaaataatgtacttactattgattaagtggaagtggatcatcttaaaggtcttcattgtcaccgtgttcatgttgagtaggcttgaggaagaggcaaaggaggtatgtcaggtgtggcagaggcagaagaaaatacatgtataagtgggcccatgcagttcagatccatgttgttcaagggttaactgtattcgctatccatgtggctaaagttcattcattttcagtgctgtaaggtatagtattatattgctataccatatgtactatagccaaataaaagttcatttttttcctcatgttgctagataggctatttccttttttaaaaattatcacaatagtacaatggacattgtacatatctctagtaaacattagacaataatttctgggatatatctggaagtgaaattgctagattagaatatgcctttgttcaaatttatgagatgactgcaacttattgacaaagtggttttgttctagtttacactcccaccagcaaaacataagagttctataatgctttttctatttgtatttgtcttttttcactaaaagtttttcgttgttgttttcacagtggttctgtgcaggtctatacaatagataacagcactggagccatgctgctatctcataaattagagctaacagcaaaacagtatcctggtgagtctttttttttttttttttttttaacatttttaatgtactggtattgccatttgtagcagatgctgattttaagttaaacaatacatgtcatgctataggtcaaatattggggctctgggtgtgtaaactggctcaagtctggaaattgattgaggggccgtgattctgttttaataattcaaattagtattttgtccatttgacctagaagttttctgcttgtataaattaagtgggaatgcagtaggcttcctatcagtttcacttccaggaacaccataattaattagccaatgcccaagttctacacaagtcagactattctgattgctgctttgcttctgctgtccattacagtagctacgcccaccttacctttgatagttgagtgccgtcacttggcccctgctacctccggatccagttattcccattttgtatttaaattttgtagttgagtgactgaggttcccactgttagatctgacatacagagaagtgcaattatagggttcttcaaagatgtagctgctgcccttgtaaatctgttttgcaaggcatcagtcaagggtatatcttctggaccctcccagctgggatgagtaggtctaaagtgactaatccactccaccttctgaatctccctaagcctttggatcccttcctctacattaaaccaagggagatcaggcatttccagctcactcacagtgggccatcttttaatccatatttcagctaaccacgcaaatcaactattagaaccttttttaactccccgagctgcagctttaaatgcagaatccctacttagtgggcccaaatcaataaattcagcctgatccaactctgtgtaccttccatcattatcccacacccttaatatccattcccatgcctactctccagatttctatttatgtaaattagaaaactcaagcagttcccatagtgcacctcctcatgggtcatactctcaacctcacctctagaggcctgccaggactttattgataggtctagaagcaaacagaggtgttgggagtggctcctgaggagaatcaacattatcttgcctggcgactgcctcaggggagggcatcactgttgcctcaggcagcacagggtttataatcctcagacaaaggtggaagggctaatggcagcatgggtccaggaggggatgttgccactattggggatggggaaagctgtttcttctggcaaaaaaaaaggttcaccagagtttacaaactcagtgaatctagcttcatcagggtcctcccacacatcccctttccaagttgcagggtcccatttttttccaatcagtgccttcactttaacagtagacacctggtgaggctgtgcatgcaccttttgttgcagatcagccactcaaatgataagagtttgtctctgtgtttccacaattttagctctttctctataggagataagaccctcactcagggcaatcttagcagttttgaggctcagtatctgcttctgggagatggaatccctgagttcatcattttctttcatcaccttgttcactgaacttaggagcaaccaactagcttcattatgttccttgattctccacatatggtcaaaggtgttatgtatagagtcactaaactccttgcgtctcacaagcaatgaatcaggagtgccaaatgcatttattttgcataactctatataaacagttcacgtcaaggactgtcagtgcgtactattagaaatagagtccttagcattttggggtctaatgatattaggcagccaactctagaaaccccaaaaccaatgaaggaactccatccttaatattctgtacctctagaatcactcctggtaccaatatctgtattagtaaggttctctaggggacagaactaatagaatagatacatacatatttataaaggggagtttattaagtattaataaatgatcacatgatcacaaggtcccacaataggccatctgcaggctgaggaggaaggagagccagtccgagttccaaaactgaagaacttggagtctgatgtttgagggcaggaagcatccagcacacgagatgtaggctggggggctaggcccgtctctattttcacatttttctgcctgcttatattctagccgcactggcagctgattagattgtgcccacccagattaagggtgggtctgcctttcccagcccactgactcaaatgttaatctcctttggcagcaccctcacagacacacccgggattaatactttgtatccttcaattcagtcaagttgacactcagtgttaaccatcacaattaggatatttaactattcatgttgacttagtgttacccacatttataccagtatttttgcccaccatatctttgaccaactcataccttcttcttgagaccattttctgcctgaaaaacctcccatacatcccttggaatttcttttaatgaagttttttgaaggtaaactctactttgggagagtctgaaatgtacttattttgctgctgtgatttaattatagtttaacttggtgtgctgttttggattggcagttattttctttttatacattgaagaatttgttccagtgccattggatttccattgcagctattgagaggtcctctgtcaagttgtcttctcttttcaatagattggtctttatagctacctttcagatcttgtctttgtttttggctttctgcagttcaactgtgatgtggaagggaagaattttgtttgtttttcaaatcctgcttgagacttaggcttgctggatgaagatttacatctttgaactatttctggaaaattctcaaccagtatttctaaatattcctctcccctaatctattttctggaactcagatatacattacacttttttccatgtttcttaacctaactttaaattttttaaaattttgtttctctagactgcattctagaaattttttctccatctaggtttgctgatcctctccagttatgcctaataatgttgtttgatctgtccatcaagttcttaatttcagttattgtattttttattatttaaaggcttatttagctctttttccaatctgtatgcatcctgctccttgtttgagtcttctcctttattttcattggctataaaaagcagttattttatattctgtgtctgttaatcccaaaatctgaagcctttctgagtctgtttctgccatgtcttgattctttgtgttcttgctcgtttgtgtgtgtattttaggatttttgactgagagccgattgttttccttgaagcatattttttgtgtgtgtagcgctttgagaactggataacatttgagtttttccagagaggatttaaatttctttgcttccgctggtcacttgggagcactacatcagtctgtgaccctttgcattgtattctctgtttgaaccacattaaattgcacaaattacaaatcagagtgagggtttgtggcttcagattatcaagggagtattattttccattcacttccactgatgaaacatgaaagtgttccttgctaattcttttcctacatggcagaggcttttttctcattctctcttataccatggatatagtccattgtagtcccagctttacatgggtatcttttgttagattacctgtcttgggcaagctctgagctttatctcctgttcctaacatgctgtgagtcatcagaggtagaagtaaaggtctccagggtttggcagaaaaattcagggaacaagcactttgtctcagtattttttattgttttgaggatttaagtattctattcaccatcttagttttttcagtgtggaagtcattcagggtgtcatttgctgtacttccagaaatagaaatttgctccttacgtttttttaatcattcttactgtgtagctttttttaaggcctgcatatgtttttttctaaagacagcttttactgtaaccttatccttgttttacagaaactgatttatacaaagccaaagacttttaagattacgcagttataagttaatcaagctaatagtgactagaaacagctttcacttcttacaaatcacctgtgcactgagtttgttctgcttagatcaggacaaaactaatggccttactaactttaagtagtcctaaatgaccaggatttatttttggaagcagtcatacctttctactcatttagatttgaaaatacagattgtatttgaaaaaaaaaaaaaaacaagtatttctgaagcaactatttatttttaactcttctcactatttcctaacagacatttggaataaaacaggagctgttaaattgatgagatggtctcctgacaatagtgttgtaatagtgacctgggaatacggaggcctttctttatggagtgtttttggagcacagctgatttgtacacttggaggagattttgcgtaagtcaaaaaagacaatttttagataaaataactccattatttctcacaatgcatgcatacaaaaaccttgtgtcagaacttccctttttgccttgactcttaccttaaaacaatttgcaaagttcataatctgttcgaatatactgattctctgaacattcattttttaaaaaatgtacatctcattccacaaaaatgtatttatttattgaacccctgctgtatatatgacagcatgttagacacaaagcagaatcaggcatggttctgcttttaggtagtttataatctaatgagggtggtaaggcatgtacataaatagtagaaagttacgttatctcattaggttaatgtaggttagcccagtgattgataggagtaggttggtatctctgcccacttcatatactaccctgaacctcagttctgatgaaatgagcacacctttaaaagctgcatatctctggcaagaagtcacttggacctcggaaaatgtggctgagagatatatacacctaggtgtattaacccacagttttgtatttcatgcattattatgtatttctattttaaaggagcaaaatccgtttgattttttaaaaaacactaaattttatgtgtattatatgtaattggaaggctgtattatatttagtttctgttctgtttcagttataggtctgatggcaccaaaaaagatccccttaagatcaactctatggtaagtactttctataaaaaattggcatggtattaaaaaaacttggatttttcttcccttttttcactcatttttatttatttaattttttgagacagggtcttacactgtcacccaggttggagagcagtggcagatcatagctcactgcagcctctctaagcgatcctcctgcctcaagcttccaagtagctgagactctaggcacaccactatccacacacggttaatttttttgatttttagtagagacgtggtcttgccatgttgcccaggctggcccccttttttcactcatgttgatctgataaaatcacaaaactattttagtctcagcagactcttcattatacagttcttgcttgatgaaagtcttttgtttttttttaattggaaggctgcctggttttcagtatttgcattttgtttagatgtggccagcaaacccctgtcatctttatgatgataatgactgttcagatgaggccttttttgtatgtgtcttctcatggcctgcttgcttttaacatgaggtgaaatgctcattgggcatttttcctggaggacatgcacttgtgcattacttgaggatatctgtatctatatatctatatatatgtatacagtaccttgagcatattttttaaaatttacatagatgtatgtcaaagagaattatggtcactgttgtaaacaatacaggttgagtaccccttaaccaaagtgcttggaaccagaagtatttcagattttggaactttttggattttggaatatttgcaaatacattcttggggatgggactcaagtctaaacacagaattcccttatgttttatatataccttatgcacatagactgaagctaatgtaatgaatttgtaataattttgtacataaaacaaaattttgactgcagctcatcacatgaagtcaggtgtgggatttttttactgtggtgtcatatcagccctcaaaaagttgcagctattggagcatttcagatttttggattagggaggcttaacctgtatttttattttttacctattttcaagagtttctgtagaaaacagagatataaaacccctgtctttacataacaagtttttcttgctatagcccctctgcataccatcctttttaaattagtgactatgaggcttgtcgcttctcttctctcttgctccacagaggaagacattcttctgatcttgagtttcttgtagaattaaaaccgccatggttgcctaaaatagtggttcccaaactttcaccaccaaggaccccttctgatgtctttgcccacctccatagtttaaaataagttttcaccacacatttctataaataccaatcagtgcttctgaatggcatgcaagaaccagtgttgtccgtctcactaagttgatattttaaccacaaactaagaatctaagcattattagttaaaacttaggcagctttatcataggaaaacataaaagttctattaaacttttgaaattttgcaacaattcatgggctacccctgccccttcaccattttcttggcttgaagattgagaatcactaatctttaaaaatactatcatggagtctagttacagaatattaaaactgaatggttctggaggaatttatttgaaccttctcattttacagaggaagaaacttatatcccgagaaacgagacagcttggccaaggtaatatatacaaaaagccaagctataatgaagactctagtctcacagcttccaatccaatgttttttgctccatacaaaactgcatctgttgtaggggcttctttgccaggcttctactgggtaacctggggtgtcttctgtaaggaatttctttgtatttgagaggcagctaaattaaagcaatagagaagttacagagcacagtaggtatttttaggattaagaccctgaaattggcattaagaatggtaggtaatgttttcacttttgcagatagagagcagtgatggtgatttcctctggagttagttaagaggtaactgaaggtgtgattcttgtctgtgttatcacggtttctccaaccttcacaaatcattaataatgctatcattggctatttcagaatttgaataattgaagctagaaagggatacaaaagccttttattgctctgactttttttctccctcctcttctctctaagagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatggtaagtatatttaaagctctgattttttagtgtcttttgtgttagaagctcagacccttctttatgacatatgtatggcgtatacttctaaaattggcatattatcttcttttctatgattcttgtgtttctttttaatttatattaaatttataccaaaattttatttctcaacgggttgtgtttctttggtcttatttttttaaaagggtcataagcaatttgacggaaagcaatgtttatatatttatttaaataatttgagtaatttagtctttatctgaatagcatttcccaaagtgtgttcctccaggcactacttatgagagatattagtagcagttccacaggattttttaaaagttttgtttccatataagtgtcaaataaaggtaaaacaaaattgtagagattgattgtagggctccagaggcttaaatatgccattgtgcatcatgaaaatccaggaggtggtatattaaaaacagtgttccccatgcttatttaactgtgaatttttaagaaatagcttaaagaaagtatgtctgaggacttgcttttagaaacaccgccccaaacactgcctcttgtatttctatctgaaatagtgtatactaatattattatatatcgctaatatacagtaatggtatatgttacatgttagaaatgtgtatcttaatacctaccatcaatggctttttaatggatatttggtacaacaaatttctaattaaaatttacgaacatccataaaaaatgtgaaaatagcctgaatttcagatccattattccacttgaagactaaggatccccagaaaagaagagagcatttctccctccccttccccatcccaaataataatttaaaagcacccttgagttttatgtcaagccagcatttggactaaaatggaaaaatgacaagggtagggtgctactttgtctgatttcaatagttaatgagtctactcacctttgagaacactggctttctagctgaaatctcatagtcactaagagcactattctttctaattataacagtgcatgagattattgtgtagtctttgtcctctgtgaagaaaatcaacatcgagatacatgtacatttcctataataaaactaaatcgatgtgttatttttgcctgcgtaatattgagttgtttttatttgttttcctcctttgcccttttgttcctctttccctcatttagagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacaggtaaatctttagttactgattactagagacttattctttgataggatatcacctggaacagattattaaatatttcatctgttaacttcaggcaactgagaatccttttaaccattttgtcatgtccctcttctgcttttctgtgttcttgtcctctagtcttctccctcctttctttccacttggcgtagagtgtatccccacctgtttcaagtctattaataatgtcaagaactagaagtttatgttttgccttctcattgagaactatttattttactttcagcctctttttttgtataaatttagctctacggatttgcacaggcaaaacaaagtgtaataatctcatggaaagtggcaacatcagctagtactctgtacagctgaccttacagtcttaaggggccacgttgaggttaatcatgtgactttggacccaaattgcagacttgtgatcagtagagagctttattgttaatacttttattagctaatcttattccaaattatttattcattctgatatcacttttaaattaacagtgtctcacagtaattctgataaactgacatttaacatggaaattaattctcaattttgataccaagtaaaattattttggggaaaccagtaagttgaagtttcttaaaagaaacttgcatacataatttcagtcttccgactgttttctttccctttttgatagcaaaatattttaggtacatcaaagcccactcttagtttcttttagtcagtttctgtttccataattctttgccttactttgactctctatatgtttaccctactagcctacttcagctcccatgttattttcagttgactttgagtgaagataatgagagacaaaaaaatggtcatgtgaaaggttgaaggattatctcctacattgacatctggtatacactaaaagaaaatgaacttaacttacattaataaattcatagaatcaaacaatgtacataccattttataattagtaacaatttttaaataaaactgcactagctacttccttgactaaaattttccactgctcccttctctcctatagccatttctctgctattttcatttccccatactttgaactattcattctacactgacctagcatcaatgccagttctgcctagccaggtctgtgttaccagagagccaagtagagcagaggatcaaagaaggtaggtctggaactaaaaaatcgatcaggcaataacaaaaattgaatttccttccagctcaaaaactcagtgattctgtgattcttaagcatctatgaagtaccccatataagagaaacattttaacactgattttaggactttgggtactagcaagattccactgttattctgttctttagatagctaaagatatttagacagatgaacttttaaaacttgagtttacctagtttatcagtttccttaaaaataacataaataatgccacattgattgttttgtactgctgaaacaatgaaaatgggctcatagaatttttcaagctggaaggacctaagagatcataaagtccaactggatttgatacatgaggaaactgaggatcagagaagttatatgacttgtccagttcacccagcagagtagtggcagacttatctttatcatcactctacgttaaagtaaaaatctaatgtattttaaaaccgaggtactgagcattaaatcacataatacaccactgaccttgagctaaaacttagaattcgcctatttggcagtttgtacttggagttgccctgtatttcgctggcactccagctacatgattcagtgcagttatggtggcggtgtatagggcagtatacagtgtctatataatgctaaacttttacgttctaggctttttagccatttatgatgactccctgaagaaacatagttgcctggtttaatttgccccacaatagtatccttttttctaagataagtgaccacatcctctgtcaaagttgattttgtttgcgtgatttattcgttgtatgtatgcttcttgtatagcttagatgaactccaactaattctgctgcttgttctgtttctcatttagagtactagctttttgtttgtttgcttaaacctgctaccttatactccttagcttccagattggaagattctatgttacttatgatttttctttaactaaaacaaaacaaatacatacttgtcagaagcaggattggtaactggcagtaaaggcggtgcttttttttttttttttttttttttttttttgagattgaattttgttctttgttgcccaggctggagtgcagtggcgtgatctcagctcactgcaacctccacctccagggttcaagcgattctgctgtctcagcctcccaagtagctgggattacaggcacctgccaccatgcccggctaatttttgtatttttagtagagacggggtttcaccatgttggccaggctggtctcaaactcctgaccttgtgatccacctgcctcagcctcccaaagtactgggattacaggcgtgagccaccgcacccagccaaagcaagcaccagcaagcaccagccaaggtgctttttaaaaagttttttcttacctataagttttaaaacttttgaagtcatttgttgacatatggggcacaaactattgaaattttacagaacacaaagtttctagttttaggccatgttccttctaagactgccatttattttaatgctcagtattttgtatgatgtaagcatttacttctgaaaggtacataaatctattatccattgttctgagggtgttggtttgatggttagcttggctatttagaaagaataagcttcacaaaatgtggaagataagcacctacagggtatcaggcactatgttagggatttcaacagagagtatttaaaggctctttcattcataaattatttactgtcttcctacagtatgtatcaagtgtaccaggtatttggcacagaacaaatctgctaggaggatggctcccacagtctcactagttatagacaaaactaatctaggcaggagacagagttttagcagagttactttaaaatttaaaaatcataataacaaatgagggcggattcagtttctttaagagaaactgaaacattctaagataagggtagagtttctgtaccttagcactcagttttccagtgatgtggcatgacttcagtgccctgagtgtgctttcatgacctgttttttttgtcactgatcagctgcctcttccttacttctgccattcccttttatcaagtattagaggtagagctcagagttcagatgacacatagatcaataaagttgacctactggagaaaatacatagtatctttagacacaaactgcatgaaaaataaagcttcattctaaacttaacaccttaagtttttaaaatacatcatttgtggcacttcatagatttttgtagaataaagaataaattgttttatagatattgatcatagtgtgatcatttgataagatttaactttggttcccattattagaaactctttgtgttagaatccacttttgcagtaagatcccagctcctccattacccacccacacgtttcataagtactcatgaaacaccaaggtttgagggaggtaaggattccttttagtgcaatggatgattgacacagttatactcaggtacatcctcctgctgtgagtgactgctgaaaaaagttgaaaatgctttcaagttttatttcaccacccaatcattaccttaagtgtaccattattctgaactaattttacccatcatagtgatctttttgggggtctggggggcagggagacagagtctcactctgttgcccaggctggagtgcagtggtgcaatctcggctcactgcaacctccgcctccagggttcaggtgattctcctgcgtcagcttcccgagtagctgggattgccggcacctgccatcacgcctggctaatttttgtatttttagtagagacgggtttcaccatgctggccgggctggtctcaaactcctgacctcaggcaatctgcctgcctcagcctcccaaagtgctgggattacaggcatgagccacggtgcctggcccatagtgaattttattaatttattaagctattgatttagttggattttaagttgacttaagtcaacttaataagtataacaaataattagtaagtaaagcacttgataataagtgaagtataacaaacagttttatcaaattttatcaaggttaatacagatgtttagagcatattgcttttacttaattttctgtcttcacattacatacacaatcttactgggtttgattgctgttgacttagctttttaatttggcatttagtttttcaatatgtgacaacttttcttagagtaaaatgaaaaataaatttgaacagatcgaagcttttcttattccaagaacagaagactctttgttcagttctgttaattctcgccccactccaacatgtgctcatgaaaactaatcagcaggctagagagatcaatctcattaaaacgaaaatttactttatctacattgatatcccatgtcaattatttaaattgaaaggtgttgttagggtgatacaaagacaccatgttcaaagatgtaagacagacaacgtggaaaaatgaacgccttttcttgcagatagagttaatatttgtaatatattaaaagttcttgtagataagtaagtcaaataccccaatagaaaaataatagcttacatacactctttcatgtacatatatatatgtttgtttagagatagaataaaagctaaccagtggttgtacctaagtaacagagaatttcattttgtcaatttttatattgcataatttcataagtttttttttgttttttttttttggagacggagtttcgctcttattccccaggctggagtgcagtggcgcgatcctggctcactgcaacctctgcctcccgggttcaagcgattgtcctgcctcagtctcccatgtagttgggactacaggcatgcaccatcatgcacggtttcgtatttttaatagagacgagatttcgccatgttggtcaggctggtcacaaactcctgacctcaggtgatccacctgcctcggcctcccaaagtgctgggattacaggcgtgagcaaccacacctggcctaagcattgctgttttaatcagaaaagtgtaaaagtaataaaaatatttccattaaaaaccagaactttttctgaggctgtaattgtattagattaggttgttttggaatggtttatatcagcaaacccaaactgttcatctgcacaattcatagctgccctcacaggtgccttctctgaaaatctcttgtcagtctgtatttattgaattcaatatttaaaacaaacagaaacataaggggcaaggggcagggagaggaaagcctggtgcctagaaacatgaaataacgtaagatgtaaaacattgattcatatacaaatggtaaattccaagtgctctgctactaactagggggcaccttaaacattgttcggcaagatgaatctcatagtgtgataacttaatgctttaagtttaaatatatttcataagttttaccaatctgatgtgttattttctatagatttccagcacctatctagagagcaattggcctatacgggtgagttgttattttgttggtgttaacttttgttgactagcatttgctgcaagaggcattctgggaagagcccttcagtgggtgtactgagaaaaataaaactcttgatctattgtaacattgctagtatattaacatctataattttgtcagatataactgaatatttggactttaaaatatttaattagcaaacatttattaattgtctgtttgcctgacacaatactaagctctttatgcctaataaagtatataggtttgcaaggaaaagttcttatttttttttttaaacagttttcagctattgataagcttggacagaatattgctgtggttggcaagtttggttttgcacattactctttactcaccaaaaaatggaaactttttggaaacattacccaggttagtcttttttgagattaaaaacctatttctcaaagtataagagaactacaatatgaaatagctataaagtttatcactaagtaattttggttacttattaaaaataaggaaaatcagatataaaaaagtgatattgaataatatgtaagatttgattctgataaaatacttgatatttgataaaggatcttgtgttgaaatagttggtttatttttaattctttttaagatcggtaactataattccttagcctgaggatttattcttacattccagcttgagtttatctgatgtgatcagaatagatttccacagaatttgagatcattccatgcctattctgtgtgtgatgtatatgggatagtgagtgtgcgtgtgtgtatgtgtatgtgtgtgtacatatacgcatgcagttggaagagaaggaaatcagtacttattaggtgcctattgtgtgttaggcattttaaggcactttcatatatgttatcttactcatctgcacagcaacccagtgaaggcactactgttactgatcttttgatgtaaacacacacacacacacaaactaggattcagttactcatctgataagtgattaagccagaatttacactaagccctaatgggtgttagaatgatgatgctatatagcacccagttatttttaatggtatacttgccttcttaaagaaatatttatttttataaataggatatggatcattattaataaaggctctagagttatcattggagagagggggagtaagagcagaaataatttgatctttggctgggcgtgtggtggctcacgcctgtaatcccagcactttgggaggccgaagcaggcggatcacttgaggctgggagtccaagaccagcctggccaacatgacgaaaccccgtccctacaaaatatacaaaattagctaggtgtgttggagcatgcttgtaatcccagctacttgggaggcggctgagacatgagaattccttgaacccaggaggcggaggttgcagggagctgagatcgagccactgcactccagcatgggtgacagagtgagactgtctcaaaaaataataataatttgagctttgtctgggtaagaatttttataaatatattactttgttataatttctggtagcataaggtaaattttttaaaaaatttttattttaaggagcaaaatatgatcgtgacaggtggcttagcctggtggaatgattttatggtccttgcgtgttataacataaatgaccgtcaagaagaggtaagttttttctctcagaaataacagatttttatattttaaagctattaagcatgaattaattttatatagaaaatagtcgattgaaaactgaacaaaacattttattttttaatcaagaatgtagcttcttttaggtagtgggattttcttttcaggttattactttaaaaaattattaagtgacaattgagacttttaagataaccttttctaaggattttagctgtcggacattccctatggagtttgaaaataaagagttaaaagcaaaaaatttcatgatataagaatggctgtcctcagagatagatttatttagttactgatttacagtaacccctccttaattatgggggatacattccaagaccatcagtggatgcctgaaactgttaatagtactgaaccctatatagcactatcttttttcctatacatacatacctatgataaagtttaatttgtaagagattaataatgactaataataaaacaattatgacagtatattgtaataaaagttgtatgaatgtggtctctcagaatatcttagtatactgtactcacctattttcagaccatggttgactgtagataactgaaactgtgaagagcaaagccatggataagagagactactgtatctggttttttgttttgagaaacagctggtcttattatgtatcaggtctaaatctgcaggtctaggccaggtgcagtggctcatgcctgtaatccaagcactttgggaggctaaggcgggtggatcacctgaggtcaggagttcaagaccagccaggccaacatggtgaaaccccatctctattaaaaatgcaaaaattatccaggtatggtggcacacccctgtaatcccagctacttgggaagctgaggtggcagaattgcttgaacccggaaggcggagggtgcagtgagccgagatcatgccactgcactccagcctgggcaacagagtgagaccccgtctttaaataaataaataaataaataaataaataaagcaggtctaaaaggaatattttataatagtacattcagttttgatcacttcattttttgcttactcatagaatgagcctagtctgcaaaaatatgtaaacataatccatttactgttaaagcttagatagttcttttaactcctgttactaaaaaaaaaaaaaaaagtcggaagttaaaaacagcatgtttaaagtatttggtcatccctagtagttatcttgtttttataattttcttcatttttgttttcttcagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatgggtaagtatctggcatatgagaagtcactttttgctcctatttaccacgtttctcttttgtagtttttgttttctcaaaacagttattccacttttatattcaatcttgtttttgttagaggtaaaaaaagcaaggagttttaattagtgatattgatataatagctaaaaaaaaaagaaatatcgtacactaacttctttagcttatcttcctggagtcatttgaaaaaaatctagtttgggatgaggtaaacccttagatactaaattttttttcacaaccttgaaaataaatggttactgactctcctggtgctctcgatacttggtgggaatttgaaggagttctacaactttaagactgtaggaagcatgtccttagcaaactgacttatatttccactgagctagatggctgtagtctggggcagtaaaaaatcagcagtgttgttgctgctgcacgttgccttatatttgtcttggcatctggtctacttgcaacgtatttagaccacacctcttgagttttatttttgttctcagaggttaattgaagtatgtatttactgaaacagcacagtgattgagaagtaatgcaagataaaaattaagacatctcactagcctcaatgattgaaccatcattctttctcaacccactagttttttccacttaaatatttgtattcttatagcttcttccctagttttcgtcttccctcctatttgttactccctttctttctctctcatccccatatactctggttcccctcaaccttgccaacttcctgatcgaaggatatatggggagaagatgataggtagtaagacatctgagtcttccataagcatgaaatctaatactattactagtggaaaagaaagaaaatcttattagcattgttgttgaggtatgtgggtttcttttgtttttacagtccaaatactactgctggtattcaagttcttcaggaggtttccatgtcacgctacattcctcaccctttcctggtggtatctgtcactctgacatcagtgagtacagagaatggaatcaccttgaaaatgccacagcaggtaccactccattatcaaaggtctttggagtttacatttctgtttttagtatttgagtccatattaggaagtatttgtttggcaaataaatactaagtgtctaaaatgtaccttatatgagaatgctgggttgcagtggcaaattaaaaagacatggtttctgctcaggcattaaataaataattacatacataatgaattgttcctgttacgtgtaccaaaaagtagtacacattactgtgagagcatttaacaaaaacctgttatagtctgaacagtcagagatttctgtatcatttaaattaaaactaggagaataagtagaaattatccaagttaagaggggatggattttcaggtggaaggaacagtagtgcaaaggcccatagacaaggcagaacatgacacactcagggaattggaagaattttagagtgactgggacatggaaagtgaaagaggatatgagtcttgtagataatattgataattttagactttaagtctaaagtgttttaaggtaggtattattagatctaagctttataatgtttactgtaaggaggaaaatgaactgaagtaagacaaaactactgtagggagagcaactgggaggtcattgtaatgatctaggtcagtggtgttcacagtctgaacttgggcagtgaaaaaggatatggaaagaagtagaatgagtatagaatagcaagggctttataattagttaattatgaggaaagagaaagtataatcccgtagtttctgggtaaagtaacagggtaagaagtagggcgaccaggacccacgttgcataactttctatttcagtggtttctaaacttcatgtcaactgggaacctactgtcagaggaaaattctatgtggatttatttgtcatccctgtctgggcagtctgtcttttacttcctatcgaggcacttcgatcaaacctcaacactccataaaataattagaaaacagactagactagactatccagttatggggaatttaatattacttatatgaatctaaaatcaattttgttaccttctatcccagttctctattctttgtagaagacattgtaaaagctagtccctcttccacatgatgacccgtaaaatatctgcagacagttaacattccttggcttctccttctctcctcaaacctctctgtcatcttatctgcatgctaaatacttccatatgtccaactatttcattggatgtttattctagaccccttaagcatcttggtctcccttctttttttttttttttttttgtccttttttctttttttttttgagatggagtctcactctatcgccaggctggagtgcagtggtgcaatcttggctcagtgcaacctctgcctcccaggctcaagcaattctcccgcctcagcctcccaactagctgggactgcaggtgcacgccaccacgcccagctaatttttgtatatttagtagagacagggtttcaccatgttggccaggatggtctcaatctcttgacctcatgatctgcccacctcggcctcccaaagtgctgggattaagggcgtgagccatcgtgctcggccttggtctcccttctataggtaaaattggttttctcctttaaaatatagttcccatttcctctgcaaaccttatttaatggtaaccagttagtcctaattgataagggaatatactgttttacagaagtttagataaaaggtgtgaaaaaaagtgacaatttaaaaatcattttgcagtcctgaggaactaatcagtcttatcactaaaaatgggaaaaccagatatggtatgcttcttgaggtgatataacatgaagttcacaagaattattgccaaaaatcttgaacccaaatcaaatcaagtatagagagtcatcttccctaccacaagggagcagaatacaagacattctgttggacagctacaagtcactaacatgggggaagaaggagtgaatcttctagattaaataagactttgaagccataaaaaccaaatgcagtggttaaaagtcatttgtgaggcaaatgtgataatcactaccctgcagaaccaagtcagtaagctcatttgtatcttcattcaaatcagctatgaaaagacactgttgaaacaattagggatatttaaatactaatggagagagaaagtagggaataattgtaaattttattggatgtgatactagcattgtagctatgttagcagatgcccatatattttaggaatgcatattaaacatgtagaagtaaaatgggtagcatgtcttaattgaaaatattctgacaaaactgaaaaaaaaataagggatggatggagcacataaggcaaaatcttgataattgtgaatctggataatggcagtgtgaaagttcattatactattctccatacttttaatcatgtttaaagttttcatatttaaaaaaggactcttatatatcccagatagagtaggcaaccagtggcatcagtagtcctggataccatattttgagagggcctttcacaaagagaaggtgcttaatttggctagagcagattaagaagttaaaattgactgattaccatagagggaagacaaagaatgctggagcaaagtaagttttcatttaatactaaagttttcaaaaaaaatagtagtaacagtgaaaactcttcaacagcaagatagtctctccatgagagtgagctccttgttactgaaactctcatagagaatcatctgccaggggtttttttagggtaagagattgagtttggggttccttcaaatttaggattttgggcatacatgtagcccttgctttttctgaaagctttattaaagttgcttgagagtgctgttgcagtcatctttaacgttatcagaaagtgttgaatactaagataggatactgataatacccactcactgaagaaaagagaagtgtacttttttaatgaattagtatgaaatgtggtgaaatctaccatcttaaaacttaaggtagtcattataaacattactcatattgtggtgaattacagtaaatgcctttaaggtcttttgaagtgttttagtgtatgcagttcccagtcatgctgttttgctgcaggtgtttgtctttttctttttcctctgccatctagctacattttactgttatccaggtgtctgactcttctagttgccacacacctaaattccatgttcacttctcatacctccaaattactttctggatagataaccaatttttttatttagtcatttctttatacataatcccctgtagaatctgaaagcagtaagcaagagtagtttgtatagccaagtattttgcaactagaatatatagggtggctgctgttttcttgatgaaccctaaatgatcattggtagcttaaattcagccagccagcatgcagcaaagcctgggacacaatcccacaagttttgaatactcactctttcctccctgaaattctttccttctgtttatatagcatgtatagcattgtgcttccctatttctcttttgtcttccaaaagctcaggtgatggcccgctgctctttttaccctggctagtgtgcctgagaaacatctgtctgtctccttcagtttaccagcctcacctttttttttttttttttttttttttttgagacggagtcttgctctgtcacccaggctagagtgcaatggtgcaatcttggctcactgcagcctccgtctcccgggttcaagtgattctcctgcctcagcctcccaagtagctgggattacaggcacctgccaccacgcccggcttatttttgtgtttttagtagagacggggtttcaccattttggccaggttggtcttgaactcctgacctcgtgatccacccacctcagcctcccaccaaatgctgggattacaggtgtgagccactgcgcccagcctggcccagcctcacctttaagcttctgatgctggtacagtcgtctctgatttagtgattgctcacatttttacttggaattcttaagaatttttttttattttttcaaattaaatgagccaaaaagaaaaagggaaactctttggttttcccttccctaatttctcttcctgtcttctatcagtgataataacttcaacttctctagcacctcagctaacctggaaatcatctttggttcatctctttttctacctttcatgtctaggatagcagtaagttctgttttttaaccaaaatgttccttcctctttacagatagaaatgacttgatatctgaggttccttttaaaacagggctgctcaaagtttaatgtgcataatggtttaagttgcgtgatagggctcaattggaaatcattatactaggctctctgaggtttgattgaaatttttcattataaaaaggcagactatttcctcatttctgaagtcaacacccatgaaatctgcctctcctcagtaacctatcctgattaactctgattttttaaataactgtcttattcaagaaccataagtagtggcttctttcctgctgctcttttacctggctttctgaatcctccttgaaggtctgttaccatccagctttgttctcataatgtccctagtctagccagactgttctcactttcccaatagttccatgtcttcgttttccattagattaccaacccttactctcccacacgtgtatgtcttcctcatctgtcaggttcactgcatccttttaaactttctgttgttatgacagctagatcactgaagtgatctctcatttttataaacttctaaagttgtcttagctttttcaggataattcaactctgccctcaatcttatgtcactggtggtgttcattaattgcattatgtgttaggctttgtaccatcctagccagaaagctccttatattcccacagagcctagcagaatggctgtacatagtacaacctcaataaataatgtagattgtttgacctataaaccttatggattggggggagatgcggaaagcataccgatacagaagtatgaatttagctgctttttcttaaatttcaggctcgtggtgcagagagcattatgttaaacctggcaggacagctcatcatgatgcagagggacaggtcaggcccacagatccgggagaaggacagtaaccctaataaccaaaggaaacttgtgagtaaagtactagtcatttcttttcaaacattaagaaggtatgggatgaggatgaaggaatgaaacaatttaagagaagagtattttatgatttggaaaggagaaattaagtccataaaatcagtcttaagcctctgggtgtaagactgactgactggaggataaggtcccaaaatgatcatgaaatgttccatactccatatgttaactgcttaggcatcattcattgcaaattctaatggaaaaaatagggatagactggtgaagttcatggggtgttttgttttcagatttaagtgtatatactttaaaaggccaggatacttttattaactctaattctaattagatccctttgcttttcccaaaaaaatattatactatcatttgaaagacttagtaaactagtacctaggaacttaagaacctgcagatttaataggaaaacaacttgattcttgtctctccttctccagctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacaggtaacaattctcttcttataaaggggcaagaattaatgagcttaaacttagaaaaatagaaatgtcctgttttgacaccatgattgtgtttaaggaattcatagtcaaattttctgtttatatctttaatttggaagaattcagacagattcctttgaatatcataaagtaacattgcagagatattttttccattgtccataaataggcctaaaacagattaatgagttcagagtagtgttttgaaattttaatatattgaagaaatttaatatgtatattagaatacatgtaataggaacatggaagaaatattacataagattattgaaatattacataagaaacatagcaaagaaagtattatttgagatattagtgagtttgagcttctcacaacagtagatttgtttcctttcagtgtgggttactgaggggacacttattagagcatggtcataacagagcaccttgagctagtcttccccaaagcaagctgagaaggctcaggcctgccacagcaaagaccctcatagcacacagtttttctcaaaataatggcttctttgcaactcctgaaaatttatttcattagctatttgacaaaagggcttgacagttggttatttgataggctacacttaaagattctttccagttactgcaaagttgtttccattgatgtaagaagctaaccataaacctggtttcaatctctgcctgaagcagatttcctgtcagcttctttgcttcatgacaatgaactgaaaccagaggagacactcaagcagaggccaggtggccttgaagtatgattccatggctaaccctaaagaaaaagacatagggttttaaaaatagaatcaaaataaatgcagctgttttttggttccgggtcactccctgcaacttcactgtatctccctgacaatgtaatttttttctgcaacagaattcctaagttgctatggattggcagataataattacaattacagttgtctattaggcacctttccataaagaccaagataggcaggttaaatttgtgaaagaaaaatggaggattctgaatgtgcagcagaactttactacttgctattgcccaaagcaaagattctagtcacatcctcagaaaactctgcaacaggagacagacctgacctattttggagtcaggcaaacctcccttttttttcttccttttctgctgatcttcaacaatttacttaactcagtttcctcacttgtaaaatacaaatgatatgcctatctgcagagtcactgggagaaataaatgaaatgacttaaagtatatgtatgctatctggcatgtagtaggagtttaataaattatagtttacatacaccagaagagtacttgcctcgcttttccttgtatggtactttttaatcttattattaaactaacccctgtggtggtgtggctacattctttgagtttagaaaacgagataaagaattgctcatatcttcccaaattgtgtagtataaaaagaatgctgtcctggttgttttttgtagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggttagttgcaaaagttacacatcttctctaggccatacacccacgtagcatctttctctaatggtactgcatatggtgtgtaatcctaggaacccagttcaagtggtggatttgagttcttcaggaatcgaagcatcagtttatcccagtcagctgaaaatgttcctgccagtaaattcagtttacagaaaacactaagtatgccatctggtccctctggaaaaaggtaaaataataaagagccattactgctttttgggcattcatgacacattgcatttcaagacatttacaaaattaggtcttaatggaaacaactatttaatccaattgcagtttctttttccattcccaaaaagcagaggccacacagaaggcttccctttttccttcctcccaagttcacttcagcaccctctgaatagtttctgcccctttttctggaatagatcttcatgtacctgttctgaatgtaacaaacttgtttaagacagagtctcactctgtcacccaggctggaatgcagtggcaccatctcagctcactgcaacctccgccttacaggttcaagcgattatcctgcctcagccacccaagtagctgggattacaggcatatgccaccacactcggctaattttcatatttttagtagagacggggtttcaacatgttgcccaggctagtctcgaactcctggcctcaaggatccacctgcctctgcttcccaaagggccgggattacaagcgtgagccaccctacctggccaaatgctacaaacttttttttcccataagttactggggtccaggtggtatttggttacattaataagttatttagtggtgatttgtgagattttggtgcacccatcacccaagcagtatacactgcaccatatttgttgtcttttatccctcaccccctcccagcctttcccccaagtccccaaagtccattgtatcattcttatgcctttgcgtcctcatggtttagctcccacatatcagtgagaacatactacatttggttttccattcctgagttacttcacttagaataatactctccaatctcatcaggtcactgcaaatgctgttaattcattcctttttatggctgagtagtattccatcatatatacgtatatacaagtttctttatccactcgttgactgatgggcatttgggttggttccacgattttgcagttgtgaactgtgctgctataaacgtgtgtgcaagtatcttttttgaatgacttcttttcctctgggtagaaccccagtagtgagattgctggatcaaatggtagttctacttttggttattgagggaatctccaccctgttttccatagcagctgtactagtttacattcccaccggcagtgtagaagtgttccctgatggccacatccatgccaacatctactgttttttgattatggtcattcttgcaggagtaaggtggcattgcgttgtggttttgatttgaaaatgcaacaaacttttaaattacctctgatgatagaggaccaaaaggaagatagataaatctgtaggtaatccaaaagccttcttaaagtcgtaattttacctttccttctaattatactttttgatataaatttagtgctaatgcatttgacactcttgtgacctattgattagagaagttattacacagtcggggagccaaatgaattgtatgctggagactgaaactgctatcacccatagatgggatattgtcttctgagagatgactatgaattcacactaacattataaaatcatgagaatttcctctggtttgtgaggcctgtgtattccttcctatgttcttctgttgttgtctcatttttttccttacctaatcctttgttttatattgttcatattctctttttttttttttccccaggacaacatgaacatatgtttatattcttactaccgtgcttgggcacatagtgagagcttattgaacgtttgttattgtcatgttttactgggtttttttgttttttgagatggagtttcgctcttgttgcccaggctggagtgcaatggcttgatctcggctcatcgcaatctccgcctcccaggttcaagtgattcttctgcctcagcctcccaagtagctgggattacaggcatgcaccaccacgcctggctcattttgtatttttagtagagacggggtttctccgtattggtcaggctagtctcaaactcccgacctcaggtgatccgcctgcctctgcctcccaaagtgctgggattacaggcatgagccaccatgcccagcctgttttactgttttttaacaagtgcttactacatgccaggccttattctaagcatttacatacataggtcctattttaaacaactctatgagggttatccacattgtataggtgaagaaacagaggcctaggaaaataaacttagttatgttcacacaacaaatgagtggcagagccaagatccgaatccaggcagtactgcaccagagactaggctctttaccccaccactaaactgcctctcacttaaagcaccacattatccagttaccaaaccagttcccccacattagctcatgtaagtcaggaatgagagactatacttaggcaagttgtaatttttaaaaattggtttcaggactggcaaggtggctaacacctgtaattccagcactttgggaggccaaggtgggaggattgcttgaggccaggagttcaagatgagtctgggcaacacagcaagatcccatccttgcaaaaataaaaatacattggctaggcatggtggcaagtacctgtagtcccagctacttgggaggctgaggtggggaagatagcttgagcccaggagtttgaggttgcagtgagctatgatcacaccactgcactccagactgggtgacattgtgaaaccttgtcatttaagaaaaaaaaagttggtattcttttcatatgtctgcatgactcacactgagaaatttaatttcactttgcctctctatccttagtttctttgatgtgctctccttccctcttttcattgggcttttcaaatatagcatagaggtttgctgcctttctttctgtcagccacccatcacctgcttcctggtctgacttcttctgtcccccttttcctgttccctgtattcattctacaaatgtgtcttaagagccttctgtgttccgagggttgtggtgtaacacggaggagaagcgttgatactttatcttcattgtcaatcagaattagatcttggatctcttatctccttgtcagctttatcagtacctctgcgtaataaggatgtgaaatcctccagtaaagattattctgtagctttcttgtgtttccacttacagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactggtaatgtagacttcatgtcacttgtacaaggagaattgtattttactccgtgtatttacacattttgctattagttgatattcaaggaattattttcattccaaacttaggaatggataaaagccaactttttgtacatgagttggaatgcccactgtttgaccaaagatgtaaataaagtagaacctatgtctctaa

SEQ ID NO: 1476 - DNA, 147439 bp, Homo sapiens; identical to SEQ ID NO: 1474

SEQ ID NO: 1477 - DNA, 31089 bp, Homo sapiens
agccttttaaaacagcagctttaatgccccccagaatcagcaccatgtcatcacaggcttgggtcaaggggcgggtcagacgccagtcacatccgctcactgcccacagccacccccccacagtgagtcatctgccagggtggcaggagccacaatgggggtttgtccacaggggggaaggctagacccacgggaccaagtcactgaaataacggacgtgcacacgcacgctcacgtgcacacaagcctctagcaccaaggggagggacagtggggttctgctgagaccccgactcctccaggggatgctgaatctcagctcattatctgggcctcagtcctgggcagtacctggtgaggacaggttggaaacggtcgtcagccatctgaccttccccggagacgctcaggcagaggcaccgccaaggggagggagcggaggctacaacaggaagtgggggctctgacctcagaggggtccatacttaggtctttaaaggagggaacatggaaggggaccctactgggggctccacggctggggctctatattcagctctttggtctgggcgtctgccccaggtcccctactgcgagggagcgtctcctccaggaccctgacctggaaccctggcccaaggactcctcccccagaacccgatccaggcaggctcagtgcccagttccccacggtgggggctcagcccatacctgtcccctggctctggaccacccggggtgggcagcggcgctcgcaggcctcacgggtcccaaaacggttggcattccctccacagccaccatagacaaaagggtgacaggcctctgtgctgcctgtcacagcccgatggtaccagcgcagggtgtaggcagtgcaggagccctcatccagtggcagggaacaggggtctgggccaatggggtcaagtcagcagggtttgtgggaatcagagagggttgaaaggtcagggggaggtcagcagggctcagccctgcctgcccctccccagaccccgctggcagccccccattctcaccatcactatcccaaggagcttcagggtcctggtactcctccacagaatactcggagtattcagagtactcatcatcctcagggggtacccgctctgcaggtagggcagggtgtgctgggagcagtggctgctggccccggggcaaggtgggcagcactgatttccactgtgtgcacacagtgcccatgcgtgtgccctgcatgcagaccctacgtgcttggcgtgtgccctgcattcatggacacccatgtgcgtgtctcggccccacccatagctgccccacgggttcagctgtcctcaccttcctcctctgcatgagagacgcggagcacaggcacagcatggagctgggagccggcagtgtctgcagcataactagggaggggtcctggagccaagagcaggggcctcagggccctgaagtcaccatgggcagccatcccagccaacccccctgagaggaccccagttgataggcagggcagggcctggggtgaagaaagttctgggagtagaaaactactcacgtgatccagatgcgatgaactggccctggcaggctagagggggcagagagggatagagagacaatgacagagagaaggatgggaagatggagagacagacagagacacacaggcagaggggtagagatacacaaagagatagcaggagagggtaacaggagagagaggaagagagagggtgggaggtagatagagagatggaaaaagagaagaaggcagaggagagggaagttgggaacaggccaacaaaaggcaagagacagaagcaggccagacacagaaacaggcaggtggtgcagacagagacgggaagagacagcttcactctgatgcccctcccaccgggtccaggtcaggcccaaggggaccagctctgctcccaccatcatcccactccccacacagccaagctggacatctgagagcactgcatggcaatcctcatctgcctgtgtgtctccctccactggggacacatgtcatgtgtcagtcctgcagcacatgtgtccttctgtgtatccatccatccccccatcttcttgactgcttgccctgtaagttctaggggcctgcctgcccttgcctagggtgctggggtggagtgggagactgcgggctgggcaccactcaccacagtgctgactcatctcttggcgcacaaagccccggatgtcatcctcctgggagcagaagaccacagggaccataaagaacccatggcccacaggaaggacatagggcacataatacagggactatggtgagactgcatggagccagggcccaggggtcagggtgctgggtgagggaggtagggccccagcccacccaggcccacccaggccctcccaggcccatccaggcccacactcaccgtcagtgcagcttctcccttctcgcctcgaggaccggcaggccctggccgcccctatgtgcaacagatgggaccaggctgtgacctctgacctcagggacaacagaagtcaccccgatctctgacccaagccttggaatccctactcacctgctcccctctctcgccaggagctccagggaccccaggagcccccaccactctctctccggggggacctcgctcaccctgtcagacacagggaccaagtgagcagggtcagaggcagtggggatcagagtcaggcaggttgggggccacagcttcagaggttggggcaggcaggctggaagatggttatgaggttggaagggtagggaaggttcagggatcaggagtcagagctggggccccttaccttctggccctgaagtccttcggggcctctgggaccaacactgccaggtggccctgggggaccagcagagccatcatttccactggggcctgggaagcccccaattcctggggttccctggggagatataggacagagtcagtaatcagaggccccagagatggaccctctcccaaagtgcacgctcccctcaattcaccatgaccatggcttcaactcacccgctcccctttctcgccctggtcacccttggggcctggctgcccgtcaaagcctcggtcaccctgggaacagaagaagcatgagagaccttctgccctgacctccctcagctctggaacctccctgaactcccatgagctccctggcctaatgcccaaaccttctgtaacccaagcacctgtgagccaaccagatgtgatccccatgactccaactccactatagccccctgccctgatgcacatgccccctccacctcccatgctttcatcctaactccactgtgaccccaacccaccttgacacctcgagaccagccccacttcagcccccaaagtcccaaccctctacagccttccttgtccctacacccccatgacccgaccatgagcttccctgccccatcctgactccctgtcatgtccactgtccacagaccctgtaccttgggaccgatcaggccctccttgccaggggcccccgactggcccggcacaccaggctccccctggagaaaaaaagacatgaacttggcccccgtccacccgtggccccctcattctgagcgtgcccacactcaccatctctcctttgtgtcctgccagcccggggcggcctgggggaccagcttctccctgcaggcatcaggcagtggggtgagccttaggccccaggccacgtagccccccagcccccatcccctctgtaccttgtctcccttctctccatcaaggccacaggctcccttcactccccgttcaccctgagggagaaaagcagatgaagaagtgattcccagacacctcactctgtgacccccttcaccctgaaactaactctccaaacaggcctcagctactccaacctctgacccagtgccctaatatctgaccccaggtccctcgcccttcaacattaggccttcctgaccagaaaaaaaccaatcttgtttctttcctaccttgaggccccggggacccatgaagccaacatctcctttttctcctcggataccaggcactccatcctttcctggggatccctagcagggagagggtccatgtgaggtcagaggaggtcagtgagggaccaaagagaatcgccctggatagtgggtagggaacaccatggggtgggagtcacctctggaggccagagccactggggcttgccatggggacaagggtcaccataggcaggggacaccatcataggcggctactgtggaggtgggggaccctgggtgacatgaggacaccatgagagcactgggtcactataaggtcaaaagctaccacactggtgggaccaccatggtgacgggggccctctggggacagggggcccctgtgggagcaggggcatcttaccgggtcaccagggatccctgctgcaccaggttgaccctgtgagaaacacagatgggggagcccttcagtgggactgtccccaacactggcccatccgctgcatgtgtggccactcagatgctcagcggccagggcccaggccacacacagatcccgggtgaacacacatggggccggcagcaagggagccagaacccccagcacttaagaggacccccaggatatgtgtgtgtgtgatgctggctctggacctgggcctgggcctgggcctggggcagaacttgcctggggtcccaggagtccacgcagtcctggcaacccggctgagcccttgtcaccaggctctcccttgctgccctgtgggagtgaccaggagagggattcagtcaggaccagatcaggctgggggcttagaatacaacgagcccgccagctggggcagagctcaagtcactcccgaacggccctagcagcacgtcctcccagcctgtgccatagcgggtggaactgggggctgtagtccacagactggctcatttctcaccccaaggactccagacccttgccccgccctcttatcactgggttcctcatcccatctgaagcaccttcagatggggacacccaaggagcccctttcctgtccctatagggccccttcatagggccagtccacagagctctcctaacctcacaccaaggccttgagccctccctagagcccctcctctcggccactccatagtcagccacagaaccccttccccctaaaccccagaaagcctcctcctgtcctcccctcctgccctcacagatgctgtggaaccaccacagccacaggaccccacagagagtacaccaccctcttccctgtaccttgtcaccagggtccccattgtctccccgaggtcctttgtcaccatccaagccccgaggccctcgttcaccctgggttggtttgggtaagaagtcacggtaaggggctgaaggtccctcaccctctgggagtttgagctctcagatgccctgggccagccccacggggtccctctcgcacccaggggagacccagtccacacgtgggcccactcaccatgtcccccttggcaccccgtgggcctggaggccccaggatcacagctgagtctccctgagggggcaggcaggaatcagaggagtcgggagcaccctggcccctgccctgccctccccatgcccacactcaccttgtcaccctttagtcctgcactcccaacatcaccctattgggcaaaagagtgtgagtcccgcccaaactggggaggccccgcacctgaattctaatatcatacaagatccactcacccccccactcatgccaggaccttccccacgttcctaccttctccccacgctctcccctgctgccagggggcccctgtgtgagagaaggtgaccgtgagctacaggaaccagggcagtggaggacggaggaggatcagggggaggagggaaacagtggggaccagacaaaggggacaggggtagacgaggagggccagagggctagggaggatggcagagagtcctggggtacaaagggcacaggcaggggactgaagtcacagcactgtcactttccccagcgggacccaccgtgagtcctcggggtccctcctggccggggcggccatcttcaccctggatggtgacattaggttcattgactcagaggttggaaatcagaggcaagagctgggatgaagggagttcggctgtggagtaagacatacgtacccggatgcctggctccccacgctcgcctcggggcccaggcagccctactccagggtctccctggagaccaacaggacaccggggatcagtgaggggaatcagtgggggacgcagggtcatgggaggtcagtggaggctgaagggggtgaccagggcacaagagagagtcagcagcacttgtcccacctaccttgtctcctttgagtccagaggccccaggtggtccctgtaggtcagagtgaggtgagggtcctgtggctctcaaagcgcctcccccaacaccccacagtgtggcccgccccatcctaagtcctcacgaggacaggaaatcaaatacgtggggctttagggcacctctactcaccactgaccccggtggtccaggtggccccaggggtcctgggattccttctctccctggggggcctgccagaccctaccagaaaaatggggcaagagaggcagagagtgacttgggaaccctcctaccctctgccccctcaagactgggaacccccaaggcagggccccctcctcacccaccatggattcaccatgcccctacatgctgttcccagcccctcacccgctctccactagggcctggctgacccatctctcctcgagggcctgtctgacccgggaacccaacaacaccaggagcaccgggcaggccagggaggcccagatctccctgaaataaaaacagcaaagggagggaatggtcaatgcaggacccctcccaggactctcatcagaactccctcttcctcctgtgggggcccggcctgctgcccctacaactggtgatggggcattgacttaccttcacacctggagggccaggaggcccaggggagcccgggaccccgactcctgggtcaccctttgaggaaaagaggcatcggatcaagctcagggagtctcacgaccaggaccccagcagggacccttctgggtacacataccttgaaacctttgggtcctggagcccctttctgaccctaagaaaacccagcaaacagcatttgagagggtaggaacatgagcacagagttcagacacgggctgaaaatattcccaggggagttctgatgtgaccatgaacacatgggaactcagacatgcgaccaagaattggctcacaggagctcagacatgaccatggcctatctcaggacagcacagacagagggacgctcagatactaccatagacaggtgggagttcaggcatggcacaggcacagggagcccacacgcgagtgcagacatctggctccacagacgtgagtgcggacacacgggcgctcagaggggaaccccaacacgtccactcccgggtagagcaggcatggccacaggctgaacgctggcagccaggggcaggggaaaggaggattgtaaacacaggaccaaggagaggttcacaagaactcaggtgtgtcctgggatctgggagatcagaccagagcacacgtgtgcccagatgtggtgagaaacagaccaaggatgggcacacagaagccaagacagggcccccagagctcagagtgtggaagccgacagtgtgtggctccctgtgatccagagagcaggctcctggatgttgggacatgcagcccgactcaggggctcagacatgtgccccggcccaagagtggccccttatgcccgccatcacactcctcaggccaggctcgcccttgcctaggccccggactcacatcttccccagggtctccgggctcccctgcacggccagcttcaccctgcacagaatggcaggtgaggggtgtctggactgagccttctctgctcagtagtcaggccccagggccaacccacctcaccttctcgcctcgcggccctggcagtcctcggtcacctttggctccctgttgacagaggtcaggaggcaacacaggcatcagtcacagaaagatgagactccggagggaggcatggggccagagcttaaatatgcggtctactatgaaagctgagggtcatgagggtgggtaaactatgggtcgaaggtcagaagttaggccactggagagacaggacccccagaacatctgctgtcagaagttccctacttaccggctcacccaccaggtctccagcaaggcctccaggggctccctggtaagggggagaggtcagtgggattccttggcccccaccagttgaccccccctcactggcagccccacacacactcaccttctctccctttgctccagggagcccgaccacagcctgtggggaatgctagtgagtttcctcctcctcccccgcccccaccctgccacccccatggcatttggaaacaggcttgtgggtgaggcagaggagttgctgcagggggtggaagtcagggtcaaagatcacctgtccaggggcccccgtggggccaggttctcctttaggtccgacagggccaggcagacctggtgacccctatggcagagcagcgtgaggaactcagtgcctctccaccaccacccctgctgccccactcctcatatttcaggcccacagctgggcaccacaccctagcgagctgcccccagaacacatactggcacaccagggctccctctgtctccatcttttccactggcaccatctcgacctggggctcccggcttccctgtctccccctgagagggaagagctctgtcagggctgcctgtcgacccttgacccctggagcccaacccttgacccccagaactcaccacttgtccaggcaaacctggagacccctgtggaccctgacggagaacaagtcggatgtcagggtgacaatggacacaggacgacatgagagaacatgggccccaaggagtgaaaacacggtgtccctacaggggccacagggactcactcaccacaaggcctgaagggccggggggtccaggaagtcccacagctccagtaggtccagtcaggccctggaggaagagaaagttcagggcagtgccaaccccacccatctccctatgaccctaacctgtgagctaggccactcacccgtcctggaggtcctgtctctccaggctccccctgcaaacaacccagagactgcatgagcagagcccacgtggccagggctcctggagctcatcctcattgcaggagatgacagcccaggaggttggcgcacactaccccaggcatggacacagcttgaaggagcctcctcctcctatccacacacctagactcaccttcaggccagaaggtccttggggtcctgcagggccagcaagaccctagagaaaagggtcaagggcagggaacagggctcagggattaacacagagaaggcctggctcatcagctgtggccaatgcctatcccagcccttccagaccctcaccaggcagtgttccctggtcactcaccggggcaccaggtggtccagggtctccatgaccaccctgttgtggcgaaaaagagtctgatgagggggagttagccgcaccccaccaaggaaactgaggcagtactggtcactggggcagggcacaggatgggggcaagacaggtgaaggttcttgggtactcaccactgggccaggggggcctcttggaccctgcagaccctacatagagagggcactgatgagcctcaatctgggcctcacttgggcctgttcccaacctctgggggctttttccttgggggtcaatttccatacctcaccctttccagtcacagataatacctacccatggactgcctctcatagatagcacacacgggcctgcacacacacatccacatacaaccacacacagacacaggcacacacaggcacacacagacacaggcacacacaagcaggcacacacagagaggcacacagacacaggtacacacaaacacacacacacagacatgcacacacacagcagcagcagcacctagcggagggtccggagcctggggccaggtgcttcagccaccactcaccggcttcccttcaggcccagccataccacgctctcctggtagaccctgcagagaataggtttaaggccttagtttcccagttccaacttcccctccacccaccatccccctagacagagtcaggacccagacagtcccaggcagtacagaccccagccctgcacacaggacaatacatgtgagagccaccttcttgcacatgtgtggctgttgggcaaggacttaccgggttgccgtcctgacccctcggtccaggctctccccggtctcctttgatgcctggcacaccctgaaggcagagtgtcgtgccctgagcccccagtccctgccacgtgcccaggtgcatatgcacaccacctctagtgtgcccccagaaaggagggggactctatggaagggtggagagaggcctcaccctgtctcctttgggaccttggtcaccattgctgcccggctccccctgtggggatgagatgtcaagtcagtccctagtgccatggcagagggtggccccgagctgattccacacactgaccttagcacccttgagtccagggggtccctgttctccagagagtccaggacctggctcatccacagacacctacaaacacaaggtcacaggggagagatgtctctgtcatagaggcatgggggagtcatcacagatctcaggatcacagagggttatagggtcagaaattccagggttatggcacacactaccatatttctggggaccaagctaagggtggcttcctggtcactagtcacaggactaaggcagggatggggtgatcaccttggggccagggggtccggggggcccaggggttccagggagtccaggagggccatctctgccctgcaggaaacaagaaaatggggtggcagccccagcacagcctccagacagcctgccccacgaagcccatcgcagcccacctgttctccacgttctcctttctctccccgttctccctgaaatgcaaatagcgggtgagggccaagcccatggggggtcccacccctcccaacccctcttccctcactctcctggccagcccccagcctcaccctctctcctggccttcctgcctctcccacacccccagccctgcctgggagcccgggaataccaggctttccaggctccccggcaaggccggaaggcccgggggggcccctctccccaagggccagaccaggtggcccctgagggccagggtctccacggtcgcccttcagcccgcgttctccaggaaagccgatggggccctgcaggagtggaagagagaatgctggtggctgtacagctacaccccactccacggggcacaacccactgagccacttctgctcacctccttgcctggggggccctgttcgcctgagtcccccttggggcctcgacgccgttcgggcacaggcaggaagctaccagagctctcatcccaggtctccacgatctcccgcagggcagatgcctgagggacagcaagaggtcagaggagcggggtgcgtcgccgcagcccctatgcctgtgggcaccactagccccaagggcccccacttgtccctacccccagcccctaaacaacccaccttgatgccagcagtttccagcaaccgatccacattctggggacaaagtctgggtgaagggctgcccatgacagagaagctcctgccttctgccccgcacggcctcaggaaagcaccttcacacccttttccctaggcctcttgcccagagcaccctttagcacttggttgaggcatggctggagactcctgggagcccctttctggtgtgtccccactgcccaagttcccttgagtgtgggctacaagaaccccaatggggcagggcactgaacacacagcacagaacctatggagcctcatggcaaggggaaggggatggcaaggtggccccaatgggcatgcaaaacagagtcaaggggacatcccaagcctggctcaccggcacacttccaggctctcctcgcaggccacgctctccagggaggccctggagagatgaagacaaactgctaggaaccagcctatgggtgtgcatgtgcacatgtgggtgctgtggctacctgggcatgtggaaaaggtgggggcctcacctgctcccctttggatccagtctccccacggtcaccctgaaaacaagaatgaccaggtggggaaatggcccccagcctggtcagccccctcaccacgccccctacccaacatccgcactcaccttggggcccgtgcctcctgggacaccaggaaaaccctgagatacggcagaacacaaaggggtcacaaaggcccatggcttcccaggagggttgcccattgaaacatcatggcttctaatgctctgaagtcccagaatgacccaggacactcacctggccaggagggcccactggccctgggaggcctggaggcccctggggtccaaggataccaggagctccacgctcacccttggggccatcacgaccctgtgaaggatgcagccagcatcagcaccctgagacctcagaaaagagtggagtcatattcccccagggtcagggtcaggggtcagaggttgcagaaaactccaatactcacttctctcccagaggcgcctgaatctcctttctctccctaaggaagacaaggatgcttcaggcatggctccaagcagagaccagagagaccccaggtgggggactttaccttcctcccgtcttctccagggtccccaggttctccctgtgggcagaggactcacatcagcccaaacattcactggtgtctggctgcaagacactaccttgctagatttcagatgactgtgactgtatttctgtgcctgtagctccatggttgtgtgtgtcttggagcatggcctgtggccgtctgagtgagctgctacatgtctaagggtgtgcctgcataggcctgctcaccccaacaggcaactgcacacatgtcctttgactctggctctctagaggtagctccacatttatgcatctctgggttggtgatcgtccacatgtcctgggtgtgtgcatatccatgtgtgtcttagtacatgtacccatgggtctgtgtgtcctggtctgtttgcacatcttggcccatgtctgcatatgggcatgggcttatacatgtctccaaagagcatgggcttatacatgccttgagagccatgtgtcttggcatctgtctgcaactcttgtgtgtagctcaatgtgtatgaccataagcgtgtgggtgaccatataaagtcatgggccagcatgtcctagcacatgtcacaggtcagagccatccatgtgtgtctcaccatgtctcaacacaggtccacatgcggtcttgggtccatgtcttagcacatgagtctgggtggaagtgtctgggtatcaacatgtctctaagtgccccaaatgtggctacacaccagtgtgtttgtgcctgtcgacctgtctgtggctcttcacctgtgcctatggctgtgggttatctgggcatgtgtcagcccatcctggcataaattggcccattcacctaactccctatgtgtctgtgaggctgcctgtgtgtgcatatagaactatgtttccaggcctggcgcaatggctcacgcctgtaatcccagcactttaggaggccgaggcgggcggatcacctgaggtcagtttgtgatcagcctgactaacatggagaaaccccatctctactaaaaatacaaaattagccaggcatggtggcgcatgcctgtaatcccagttactcgggaggttgaggcaggagaatcacttgaacccgagagtcgaaggttgcagtgagctgagattgtgccactgcactccaacctgggcaacaagagcgaaactccatctcaaaaaaaaaaaaactatgtttctggatgcatctgtatgtctgggccaggatgcatgtgtctacacgtgtgcctcatgtgttgctacagatcttggctgtgtaggtgtgctggcgtttcttggcaggtttcgccgcagctgccctggacacactcacgttttttccattcaggccaggtttgccatcctcgcctggctttccctgtgggaacagatcactggttggatgtcggggatcgggtgagggtagtaagggggaaaagggggtaacatgaaagtctggtctcaccggtaatccagggggaccagaggggccagggaggccctgttctccacggaggcctggaagcccctggaaaaagtctttgttaagatttatagggcctctgagatatcccttggggcacaccccatggactaagaggaccccaaaaagatctccctccagggtagagacccccaggactgagaggtcccattgagatccctcaggcacagaccccatggatgggggcccctgctgagactcccaagggaagaacccccaggacttggagggcctatgaagacccccaaggcaaagaaggtcagaaagggggattctactaaaacctgtgtgccagggactgagaccctcccaaaggcaaggctgaaccgaccccccaccaactctctcggatgctgtgactatgatgatctggttggagcttacgcagccccgagccccctctgtcccagcatctcccctcacttacgtctctccctgggtccccagctttgcctgcagcaccctgaggagagactcaaagtcagttcatcatggtcatggggtcaggggctctagtccctgtgagcctaaggcctgcatggcaagaacatgccccacccaggcagggctctgggagaagacacagacaacaggtctcgccccagagctcgtcaaggccaagaccaaccaatgaggctggggtctagggtcctcatgtgaaggggtaggggaaggggacaaccaggcaggactaccaagactcacattcggcccagagggcccagcggctcctggtttcccatccagtccgctccggccatccagcccagggggaccccggtcaccctgtggaaaatagagtggtaagaggccaccaaggctgaggtggatctgataacccaggctcatgtcctgagaaacccccacaccctctcaccttttctcctgctgggcctcggacacctgggtccccctggagggaacagggtcagataagaggtgagggtaagatggggacttggcagacggggcaaagtgcatcactcacctgtgggcctgggggtccccgaaacccttcaatgccctgaggataggggaggaagaaatcagagcaggccctcccatgcctgcacccccgaggaccaatcacactcaccctttccccaggggctccagggaggccaggatcacccttgggccctcgaggaccctcttgtccgcggtccccaggctctccctgtggcagagataagcttgctgaggaacagccttgaagccaagccatgcccaaggtagaacctgctgggaggggcactggggtctttcttaccctccacccacagaccctaataccttctctctggctccaggtcctgtgtctacctgtggggggaatgaccagtgagaagaatggctcaacaaggggaagaggagttggcgaggggatacagggtctgtgaggggctccagggatccgcggaggtttcagagggacagtgggggaagtgggagttagtggaaggaatgaggggacatgatgtggagccaaaggggcaagtgagaacaatgacagaggaccagacccagcgcagcccttaccagccgtcccgggggtcctgggggaccctgggaaaggaaatgattatagtcaataggagccctcaggtcccaggccatggctctggtttgccccaggctcaactctgcccccaagttccccgaagcaccccaatgccagcccccagcaggcatgggtggccatccatgcttcccacctggacctccagaccccttgtgtgaaggcacactggcagcagcgccaggggaccctccatcccttctgagcccaggacaccagccctactcaccggctccccacggtcacccttgggtccagatgatccagggctgccctgcagaaaggcaggggtcagggccactcaaggtaggcagcagtttgggagagctttggaagcaccatgaggactcatgggaatgttggtagccttcagatgcgtgtgtgcaggggtcaaaggaagtgaagattgggagggtttagcattacagggttggggggtaggatcaggtattgggaattggctggttggagggttaaggttggggtgaggagtcataggctgggactcacatttcgtccatcctctccaggatctccctggtctcccttttcacccacaggcccccgaactccaggtgccccctaagaagagcagctggcctgagacagaccctcccaatattttgcaggtgcccctatgacccgctacactgccccaggttccccattactccaaaatccacatcagaggttcccatcaccccatgcctccctgcagggactcccatcaccccttacccccctcagcctttcctatcaccttcatgcccacctcccatcacccctgttacttctctctgccaagactcacccgaaggccacgctcgcctgcttttccaggcaaacccgggtcaccctggtgatagagagaaaagtcatactgcacagggcagtcaggatctaactcactcagggagaggggacagagaagggtctgagcagcagctggacaggaggcagggagtggatggatgaactggtggagcaccagcctactgggatcctagttcaagggtaaaggatcagaaaccacagtgggaaggagtctcaccggaggaccctcgtcacctttctctccaacttcaccctgtgaaacatgagagtcagccctggttccaagaacccccatgatgctggcaacagccctactcccttacccgccatgactcccccgactccagcctcttacatctcgtcctcgggggccaacaggtcctggggggccaggccgcccagggtctcccttctctccaggaggccctgagtcaccctgtggaggaggcaagagggaggtgatgcaggacgctcgaagcaagcagttctcaaggggaggggaccccagaagccttgaggttgcccagggtaacgggtactcactgggggtcctgctctgccagtaaggccaatgggaccctgaaggggacagaaggggggcaggacttagtcagggtcccaccacctcatctccctctgtcacactccccattcccacattgattcacccggtctccagggtctcccttggggccagggtctccaggaagaaccaagccgggtgggccctgtggatggaaggataagaagtcaggaagacaaccttcaccaactgccccctaaacacttcgcttcacttacccgttccccttggactccggtagctcctctgggcccagcgggccccacatctccctggaggtgacaaagaccatcagtgctagtcccaggctccagttaaccccctgacccagcaagtcctgtgaccccccaagtcccatagataggccctatgacctagacctcaaccctgtagaaacctccccttgccccataccaggcttaccttttctcctttgggtccagcaacagcaggtccctgaaaacaaacaggacagatacagcttggccctgccttggggttgtatgatcaaagtcttcattggaatggaggtcacatggaattggaagtcatacagctcagtccccgcccagaagtcacagagtcaccgctgacagcagggaaggggttatacaaaatggactgacacaaagagctcatgacctgcatggcggtcttggggtcacaggatcatagccaagagtctgggggcaggttctagcagaaggagagccgcagagctcccagcctgctcacgggcccagcactgtggaatcacagcccagatagtgttctataggagggtcactgctcaagggctgtgctgtgctcagagcgccatcctcccgtcactcaccaccactgcagggtccccagggcgaccaggctccccctgtggagagaggataggagcagggacaggtcagggagtcacctaggagcccaaaatcccagtgtcccatctgccacatccctagtaccagacagtgccacccccagccgaggacccaccttctctccttggcggccagtgggtcctggtggcccctgaatgtagagaaagtgtgagcccaggaggggaagggaaaggggagggacacacaaaagtcccactcctggtcccaccacagtcacagactcacttcaggacccttggctccaggacgtccagcaacccctggcagcccctggaggagaggaagggaagagctgtgcaggtgggtggggacgggggatatggacagacagggctagaggctggggtgggggctggagaggggtcagggaagattgggatttaggttggcaggggtaagacttggcaggagaacagagaccaggtcagtgaaaatcaaggtcagttcagcagggtcagaggttcaaagccaggtccctggggctgagggttagagcctgtatcagcagggataagtggtcattgaggaggggtgaggagcaggggtagcaggggtcaagggcaagaagtcagaaccagaaagggcacagccaggtcagctggtatgagcattgcagccagtgggtttacccgggatcccgctgggcctgggggtccacgttcgccctgatggaaaagaagaggtcagagctgagttgggcccagatcctccagggcccttggcaccccccaggttgcacttaccttctctccagcctcacccaggggccctggaaagccccggtcaccctgaagagagagggtgagagaaagacagagagagagagggttggtggcggggcttgaacgtcaaaccccagacaaggggtcccaaactccaaccaccccctccaaaaccacgacctctgacctggagggaactcttatctccttatcttccagcctcccctaacaccatggggagcccagagtagcacccctcacacctgaatcccccaactggtactcactttggggccaatagctccaggaggtccccgtgggccctggaagggatgaatttgggggttcagagatttgggtttgggcatgaggatggagcagtggttgatgattgaggtaggggctggagctgtgcccaccatattcagaatccctggcccctccactcacctgctcacccggagacccaggttgtcctgggaggcctggagctccatcctcagagtcaccctgaaggagaaacacacgggtgggaagaccgaagggaggccctgcccccagcacgcagcctcccaccccagaactgggacatcatcaagtcagccttcctactttttctcctttctttccaggggggccaacggggccttggggtccagggcttccgggaagaccctaggaagaagtgagtaaaaatatgagccaagaactatgaagcccagcacccaaccactgccccaggagagacccacacccctgagcagggcccccagcagagcctcaaggcccctcaccggcagcccaggctccccaggagcaatgccaccttcacctggtccagggggaccctgggagagaacagcaggtcagggaatgaacaggggaatcagactccaagccacccctagcacaacctgtccctcacttacccgctccccacgatcgcctttgtcaccctagaaaacagatgacgaccccatgaccctgggccacacctcactcccaaagataccaggagtgatgagggtcatggggtccaattggatttcaaggattttgggagaactgaggcgtcatggtgaggatgggggtaatcaaagggtcacaagggccagagtaactggcaggggttatgtgggttcaaatggggtcaccaggtctctgcatcacatggcactcatgaggctgtcaccttcatggctgttccaggaagccctggggggccacggggtcctgggtcccccagtggtccacgaggtccaggggggccctgatggaggagacaaagtataaggtgcaaccccacagacctcactctcgcccccctcgtgttggtccccccactacacatcacttgcctccacataccctgcacttaccgatggtccagggtcccctttccgcccaggaagcccaggtccttcacctccgatgacttgtccgggagccccctgtaaggacagagagcagtgggcaggattcaggctatgggggccttgagctggaagaagcccctagacatgtccagctattcctattcgcgccttaggccctgcacagggtctggtgtggggcagtcctgctcctccctgggacatcccggccgcctcccttcccccttcacctaccggctccccctttgggcctcgaggtcctcgctctccctgaggacgaaacagagcagagggtggtgcttgggctcaggcgaatgtcaacgtgggcactgcaccaccaccccaggctcccaccctgtggaagaaccctgggaagacacttagagagcaaagaagggaaggcaccttaccgggtccccacgagggccaggcaaccctggagagccctgcaaatggaggccagaggcagaacagtcggagccaccccacccactcaggcagcgcccaccctgacctgcaggacaaggcttgctcacctttaggccaggggctccaggggtcccaggattcccggcgcggccagggctgcctggacgcccatctgctccagggaagccctgaggaggtgaagaggtcaggacaggaagggaccctcccccaaggcccctggtttgctggaggggcctcaccccatcaacaaggggtcgcctaccccactgacccccaagtgttattgggggtggaacagtgaggcagagaaatggcccctcagagcttcacagagcccaattccaggcacaagggcagcgacaaggcagagggcttccctgcctctgggacttggagctgctgctcaggctctgcagcggggctagaggccccactggcccttctatttcagagtgtcccccaaagtctctgtggtggtttataacctccagctgggcttctaggaattcccgatgattctaactctgcttcttccttctctcttgtaaaaaccccgagacagctttgaggagtgcctcagagaaacctcgatggtctccacactcaccctctcgcccttggcagtggcacttccagggggcccctgggggccgggagcaccggtcctgccctgaaagaagatagcagttaggtggggataagccagtcagggtgcagggacagatgtgggggacactcaccgggaggccagggtcgccaggaggcccaacttgtcctctcaggccctaggaagggtaatcagtgagacctgtgctgccaacctctcctgccccactgacactcaacccattctctattccccgcccgcaggggcactcaccatctctccaggttcccccttctggccctggggaaagacatgtcagatgtgggtcagagtggctagccccaggtgcagcctctgttcacctctcgatgagggactcttacctttggacaatacactgggcagggctctggccggggctgcggacatagggtctctttgaggttgaacatttctaccaagaacccccagaccccttatattctaccacccagtcccccagaggcctcttccaaacctgagtagtgaaggatgcctgacacagggctgtggccagaccactgactgcctggtccaggcttggcccatcatccacggcgaagaaggtctggacagagtccatacccggcgccaagcgacgcagctgctctgggtccgctccagccattcccaacatcaccacattaagccctaaggtggggtccagtggctgcatgatagccttttcagggccacccctattcccagaccccttccccatcagcctactccttaccagaagcctgggcctcacggatggggctgaatatgtcacctctcaagggttcatccactagcagaaccatcacccctggtacgtgctggcggcgcccaggagcatctggtgccaacatgtatctgtgagctgtgaccacggctgtgcctggaaggaaggacatgtcagaaccctggggcaccaagctcccagtggatagccccaggagtccatgcctgctgcagtcctcacccaggttgttcccacttgggtccatgtagggcatgtcacggatcctttgcaagataatgccaaggtcatgggagccattcagtgggaacagtggggagggccgatgactgtaagacagcaggccaacctggggtggaaggaaacacagagcctgaggaggatgacagagcagggatgggggtgcacagagcctggagaaacacatcagggtgtgtgtgaccaaaccctatctattagggagtcagcagtgatggcaggatagggagccaggcagtaggtgaggtctggagcctgtgagagagctgggagaatgcctgaacctattgggtggtcaggagatggtaactggtatggagcctgggtggggggcctcagggagaggtagaatctggctgccccagggccaaacctgaactgcctgtggcccaagaggcccaagtgccaacaccagacgctccaggaccctcctcgtagcctccgcacggtgagcattgtcttgagtggcatgtggtaggaacaccacatccgccaggccacgggggcacactgtaggaaggggaacaagttactgaagcgggcagcccacccagacacacctttctgcccttcccactacgcccactatacctggcgtctgtgtgacagatgcctcaggaccccgcacaccatccaggacaggcgtcagggagaagatgtaagagacgccaggctctagccctgtcacccgctgggagcttgagatccctggaagtgtctgcggggacccaggcacttctgcaggagacagaacttgattaaaaagctgtctccacagagccccaactgccagcccacccaaatcctggcctccccctcaccctggccagggcctctgagtggccgccaggataggatgtagctggatgccctggacactggagtccaggccaaagtcaccgagtcgatcgaggtgtccaccacacgtagttcaatgcttggaacacgaggtgactctgaaggaggaatgaaagatcgaggatcagaggctgagtcctgagaacccagaagggagagatctgagatcctgggtccggtttgtcttattgaagcatcatgggaggtcatgctggggtcacccagggtcagagggtgaggggtaggggtacaggaggagtcactcagagtcggggtgcaggaagtcagggtgggtcatcagcaggggaggagcacgccaaggtgaggcaggcttaccagtgcgcgcagtcacctctgcagagggcccttctccagctggccctaggacactcagcctcacgcggtactgtgtcgctggctccagcccgtccaggtgatagctgctgagctcgggccccaggacccgggactgttcctggccacctggggcaggcgtgagggtgggggccaagagcatgtgggatagtgacacctgggggcattaaagggcctgcccacttcactggctctgttaactgggttcaccctcctgactgatcttcctcatcctcactgaccctgcccactttacggaccctgccagactgaccctccatgaactcattgatcccacccacttcattgattgatcttacctactgtcacggatcccgcagacccccagtgacagaccccgcccaccatcactgtcctcgcctaccttgcggagtctgccacagccctgcccccaatggtccctaacttcctcctggggacacctctcaccctcaggttgccagtgcagaaggaagccctgcgctctgggcaccggctcccagcgcagcctcagcgagtgctccccgcgctgcaccacgtgaagcgtccccagggctggcggagcctcaggcgctggagagaaagctcaggaatcagggaggctctgcccccatggcccctgcaccaatcccaggcccaccctggcacacgcaccccgcccagcctctcagacccctctccctcctctcagaccctgcccccaaaggctcactaccaatcctggtcctttctccaatccagagcacaagcccggatccccaaaccatccacaccacccatccgaagctctccagcgcatgctctgcctacgcgtagtgacaacaatggagacaggtgtgccctcgcggtccccgacaagtgcagtcactcgcactgagtagctgactccaccttcgagaccccggatctctgcagagtctgtgtttcctgggagtatctggtgcctcatggggccgcctggccaggtgggcatacagcaatggttaggggtgagcagtcccagccaggaaggacaggggtggcgtcagggagccataccttcactccggccccaggccagtctgtaagctgtggctccagtgacccctacccaggtgatccgtagaacgtcgctggaagcattgaggatctgcagcctcgacacacgacccacaggctcaggggctggggacagaggcaaggtaaggggtcctggtagagaacagagaggcagtgcaggaatggttgacgcaggggtgatctgaaagtcagtgtgaggttagtgtggacaggtcactttaggcagccctgaggaggaggaggtcagtgccttggggtgggcagtgtggggccaccaggaggtcaccgtgggtggacacttaatcagtgtggggtgggtcagtgtggacaggacagtcactgagcaggggggtggaggcagctgggcaatcaggaacacacagcagggcagggtagctaatgcggtgtggctagtagctggccagggtccactcaccagtcctcacaaccacagaggcagggggcccatccacgccagccacatgggccctcacatgcaccgtatactcagtatctggctccagtccatccagctcagccaccgtggcctccccagaaaccaactgggatttctctgggcctgggaacagggatggaggcagctccagggctagcaaactctgtgccccagagccccacctggacccccaataaacccccagcccccattccaccctgacctgccccctcccaaaccccagtccccaccgtgggctgagtgccaggaaaccctgtatcctgtggcgccaggaaccctggtccaggtaatggtgacagatgagctgctggcctgagtcacatggaccgtcctcactgggcccagtgggtctagtggggagaggcaatggggagtctgctggaacaggcaggaaggagtggggctatctgataggggaagatgatgggagtctaacaggagacgggaatttgatagaggagatggtgaataggtccagtggaggagtggggaggtggaggttttaggaagcagtgagcaggtctgatggaggagaaagtgtaaatctcagaggagatttgggtccagcaaaaaagggatgggggtctgagggttgaagtggtggatatttgagggcaaaggctgtgggagtcttaggagagaagcggaggaatctgaatacggggagggcttaaggggagacagctgaaactgaagaggaagcagcgtctctgagggaggagggagtgggattctgaagggggaggcaggagttctggggagaagcaagggtctgcaagggaaggcatgggggtctgaaagagcaatggaggcagagagccaagggacgggggcagggcctgacccgttcgagccacgatgactgcagcagggccctcctctctgcctcgcagtaccgacacagccacctggtaggtggttccaggctgcagccctgtgatgtctgtggcagtagagtctgggggcagtgtctggctggactccggacctgaggtcagagggaaatgctggcatggctcctgcctgtcccctctggcacccataccctcattggtccctttggcagtccccccacacaccccacactgaccactgcctgtgctccagctaatccgaaatccactggctccagggacgggtccccaggccaccctcactcgcgttgcatctgacaccacaacccgcagccctggaacagcaagtggagtttccggctctaggagttacagacagaagtcagaagtcagaaccaggaccagagtgaggcaggcagctgtcctccacaagcctcctgcagtactcaccccggcggacagtgaggacactggcactgccctcacggggacccactcgagcagacacccgcacagtgtagctaagcccagcctgaacgtcatccaagtcgaatgctgtctgactcccaggaagcaccagggtccgctcaacccctaagagagaagtcagggtaggtgggcaggggtcagaaagagacagggatgtgggacgatggcagtgatggacagggacgcagagtgagaagggccatgggggtggggatgtggggtggtggggaccagagagctgggatatggctgaaaaaagtgagtgcaagacaaggacataggatgaaaggggccagtgatggtcagggacactggaggacaggagtctgtgggatcttagcatgtaggatgacaggagtcagtggactgcagtgagaactgatgagccattgacagacactgatgtgggatggcagaggtcagtgctggatggggacatgcaatgagaggttggtgtacagtggtcaccactagggtaacagaaagacaggtgattgagcttgtggctgtgcagaggtgaaagccgtggatggggtgtggggcagggaggagattggttggggtagggtaggggcagacacaccctgttgacagttcagggctcagtgccatcttgggaagcagatggataacgagacagggaggagactatagggacccaggtgtggaaggagagggctggaggtacactcagacccctcaggctggaacttcagtgtgtgtggtgggggtgctggctgcgtccacctcaccctgggtgctgcgcacaatgatgcggtactgggtggcaccagggactgggctccaggacactcgcacccgctgcccgggcagctcggtggcttgcaggtctgttacagggctcacaggcagctctggtcctgttggagagcacagcatagaggcagcctggggctccgacacctcccccactcactggcccagcccacagagccctcaccagtgggaaccacggttgcaggggtggccacctcgtggccctccagcagagtgtagagtgtgaggcggtactcagtgcccggctgcagcccatccaactggtagcgggtcacatcagagggcagtaccaccttctgcggtggctccaagcctgcaagataacagggtcagaccagcagaggccatgccctgacccttgcctgtccatcccttcccccgcactgaccagtctcacgccgccattccaaccggtagccacgggcctcaggcaccaagttccaggaaaggaggatggatgtggggcccaggatgaccgggcgcagggtctgctcaacagaagcgtctgcccagggcacatgggatgtcagtggcctccgggccttgccctgcctgcccgtcccagcctgaagaaagtgcccagccttctcaccagtgcgagccatcagggaagtggcgggccccacactgcggccaaatagggtgctcacggtcacctcatagtccgtgccaggctccaagtcacgcagcaacactgaaccctgcccagggcccagctcctgctgctgtgtgggcccacctgcatgggggacaccaaggggccagtgggccttgcagactcaggactctacagccttgtctgaggcgcggggactcccctcagcccacatctctcactcaccactgaggacccgccatgtcacacggtagccagtggcacctggcacactccgccaggccaccaggaggctgtgggctgtggtattctggatggtcagttccggcccttctagggcagctgggggagagtcccaccagggattcatggagtcagaagtgggagggggtactggggtcgggggttaggtgaatggggtcagaggctggcagaattgctcactggtccgagctgtcccgctcacagcctccccgatgctgttggcgtagagggcaatcacagtcacttggtactcggtcagtggccggagaccccgcagccgcacactggtctcaccagctgggacgttcacctgcccagggcaagaggtcactttatcttgcccagccaagtccccagccaccacctatcactcctgacatcctacctcctgccgctcactcggcagtggctgtcccagccccgtcagaggagtgtactggaccttgtagccagtcacagggccactggccgctgtccactgtactctcaaggattggctgcttggctcagacagcaccaggtctcgtggagcagaggtcgagtcatccgctgggaatgcgggatcaggggatcaggcaggaggattggggtgggcatgtatgatgcagagttggggtcggggtcaggagcacataggatggaatcagcactgccaagtggggattggggtccggggtctaggtcagggtacaccgtgtgggcaggaactcacgaggtcgggtcacaggcacgccaccagcagtcgtgcacactctccgggaaacgaggggcagtagtgtcctcaagatgctgaagtcattgacgaagaagaagaagtcactggtgggctgtgaggcaactcgcttcagctcctcagggtcagcattcttgatccctgaagtgacgacccatcaggactcagtcacccacatgctctctgactgcccccaccccccagctgacctgtcactcctgctcggtccttacccacagcaaatagcttgaccccctgccccttcagcctttgggcagctgtgtccaccaggtcctgggacttcccgtctgtgatcaggatgcagacctgggacaggtgcaggggtcaaatcacggttcccctggacacttcatttggggtcatcttgggaggcatggtaggggtagggatcaccttggggacaccaggtcgggccagctggggcaggaagacatggtcagccacatggagaattgcagcccctgtgcgagtgttgccccccttgtagctaagctcacggatggcgcggatcacatcacccccagagccaagtgcatccaggccgaactctgtcctgttggagggtaggggtggcaacaggctaggactcaggatctcttctggccctggccttgaggaggcctctagggtgagggttacgggtatcaggctctcttgaggggtcccttcgttctgtcattctccacacccacttgcctctggaacccccaggttaacaaactccccaggggctcctttgtgcaccatctgcaggtgggcctgggcagacctgaaggagcccttaggggctcacagtctgtggggaacaagatgctgcttaattaaataattgcaggaggaggggtccagatgtaggaaagtggatgctggccagatggagcacctctggtgaacggctgcaagggttagagggctagaacgtggagaatccaacaggcgtgggggccccctcctgggctccccatctccagatcagaaaacacagcctcactgtcttgcaccttcctgtcttgcagtagcctggaggtgcctcagggcacgaaggttctacctagggaatccttacctctgtctccaaaggaggtcctggctagggggtctctaggttccccaaaacttgtttctgcaaagacctggcctggggtttccagggtctcctccctctctggggaaggagtcttggtggggatctcgtggtccccagcccccagggcccctactcaccgtgggtcatcgctgtactgcactgtggcaaagcgcacaccctgtgcactggctgctccagagaaaggcagcaccagcccttcgagaaagctgcggacctcgcggaaattgctgcggccaatggatgaggagccatccagtaagaacacaatgtcagcggcgtaaaggcgcgtgcaggtcactggggcgggcaggagagatcagggcctcttctgggaggccaaccacccgcctacccgcacggtggcctcactgggacttgggatggtggggagagtaggcctcatcttatgcaaaccagggccgaatcggcctgagcctgagggccttggagggagttgagctcggtgggtcccagagcagactcccgcggagggttgggggtgtgcgggggagggagagtcgccagcacgggtgtggacttgggactgaggtcagcctctaggggccggcgtggattggcataaggcaggggaccccgcacgcatccagggagccagaatttgggtaggaacaggataggaggcggtttagggaacccagcaccgatcgcggagggttcggggagtcccagaattaggaggaatccgcggggcgtcgtggagttggctgggttgtgggcggggggtgttggggatgaaggccgagtggagcggagggtggcacggtgcagtgccccgggccgggtcctcccttgcggtgcccacctctctccctgtgctgggctcgcactcggggcgcctctgccaggatcccggcgcagagcgcggccaccagaagccgcagcgtcatc

SEQ ID NO: 1478 - DNA, 77 bp, Homo sapiens
gcatctcccctcacttacgtctctccctgggtccccagctttgcctgcagcaccctgaggagagactcaaagtcagt

SEQ ID NO: 1479 - DNA, 207747 bp, Homo sapiens
tttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggtaaggaggccgccgccgccgctccccggcctctcgtgcttcccggccgtctcgctgcccgagcggcgtcctgcgttctcggggcttcgagcaccttgctcgccgggtgcagccacctgccgccgcccgcctgtgggtcaagttacgtaaagccgggcggcagttccctggcctccgccctcgagttgtttatattttgggggaaaggagagggtcatgagtgcgggatgaaaaggtctatattttccgagcggagcggacttgccgtgggctccgtgggtctggcgttcaagtcccggcgaggggccgttctctacccctggccccgcacggtccggctttagccgcgcggggcgaggaggcgagacgacgccttcctgggctgggtcccatccctgtcctttgcccccctgggtttatgacgaaggccccagaaatcccccgcgtgttgcatgctgcctcgcacgtgaaggcagggcgctgtgaccggggacgcccgcttccttgcttccccagcctcaattcctggcttcacccgtggtgctttctgctctcccccttccggccctaggacccggacgccggctctctctcgcctgggttcggcggataacaaaaaggaaactcaagtgcaaagtaactcaaacagttgcttgtgtggttgcagttaacagcctgacctaggaatgtgtaacattttcaagactttaggatatgtgggtcagagtgaattgccgaattttaaagaaaaaccagggcgtgcggtgcaacgtctcagacctgcaaaagaccgggctgaacagggccctacgctgcctaggtggtgaaggaccgagctttccttgtgtccgtttagtgtggtattctgccttagtgagagcctcatttttagtgtttccatctgtttttgcattatgcgcttgtttattttaaacacccgctagaaattagactcctttgtgaaatgaatttcccaggccaaagtgagggttaattttgtgtgtgaagtgtgtgtgtttaaatatatatttaaagtaatttattcttgtctgtgcacacacttccagtcttcttctaaaatacttaccttgactcttctcgtttatgagataatgtaaacaggtagtttagtttgattttaaagaatgttactaccgtggggacctagtatcatgatggagagtgagtggactacaaaagctagggatatagtgatagctgctcagcctgtttgattagtacaagaaacttgcagtctgtttatgctgcttcttagttgcaaagtgaaaataaaatttgtctcccatgtacctcagaaggaagccttaagaatacttgaggtgaactttgatctgtagtggagtcttgcttccacattcagggtggaggtttgtctagagtgtgattaatcaacttatttatttgtttaaaatttacatgcagtaaaattcactcttgtgatacagttctgtcttgacaaatgctaagaggcatgtatgcaccaccacaataatggcacataaaaggttcatcaagcctcccgaattctctcagctgctcctttgcagttgatctcaccccgccaccacgcccggctaatttttagtagagagggggttttgcaatgttggccaggctggtctcaaactcctgacctcaagtaatccgcctgcctctgcctcccaaagtgctgggattacaggcgtgagccactgcgcccgcctgactgtaagtatttatctgtttgctggttgaagaatatttcagtttttggaggttataaataaagccgtcataaacattcacgtacgggtgtttgtgtgaacataattgttatttctcttggataaatacctaagagtggttttaaattgggttgtacgttttttttttttttttgagatttatttcatataccataaatttcactcttttaaaatgtacaattcagtgttttttagtatagtcacaaaattgtacaaccatcaccactctctcattccggaatatttcagcaccccaaaattaaatcgtatgtccattaggagtgactcccaatttcctcccttctcactactccacctctggcaaccactaatctttctgtctttatggatttggtaattctggacatttcatttaaatggaattatatgatatgtggccttttgtttctggcttctttaacctaatgtattttcaaggttcctccatgttgaaggatgtatgactatttcatttgctcttagggttgaataatattccattatattcatagaccacaatttatttatctatactcaccagttgctggatgtttagattattcctaaacatccaccttttggatattatgaataatgccactgaacattcatgtacaagtttttttgtggatgtatgttttaaattctcttggatatatacctagaagtggaattgctgggtcatatgctgactttgtgtaaccttttgaggaacagccaaactctttttccagagtgtttgttttcttatggttgagttttgagagttctttaaatattaaggatacaatttcttcatcagatatgtaatttgaaaatactttctcagtcttttcccattttgtcttttgcagagcatacatttttgattttgggaaaagcccagtttataaaacatttcttttatgaatcatggcttttggtattcatatctaagaaatcttttcccaacccaaagtcaaagatgttctcctgtgttttcttaaggaagttttgtagttttaggttttggatttctttttgtataaggtgtgtgatatgtgttgaaggttgaggttcatttgtttgcatgtggatgcaaatatccaattgtttagcaccacttgctaagaaagaggatcctttctctattgaattatctttgcatttcgtaaaaaaaaaatcagtagacttaatattgtgtggctttagtctgtctcaatctgtgtgtctatcatttcaccaatactacactgtcttgataactgtgtctttgtagttagtctagaaatcaggtaatgtgatccctctaactttagtctttaacaaataatttaaaaaataacaagtcattgtccaggtgtggtgctcattcctgtaatcccagcactttggaaggctgaggcgggaagattgcttgagcataggagtttgagattacagtgagctctgatcatgccactgcattccaacctaggcaacagacagcgagactctgtctcaaaataaaataaaataacatgtcagtgttttatttatagaaattggttatgttttgataaatgaaactttaaataatagctggagtatttttttaaaatattctttgagaatttcaaaagtagtaatttgataaatttggaggattttttaaaaacattgtttgaaaatttctgtaatagaaactaggtggccaggcatagtggctcatgcctgtaatcccagcactttgggagactggggagggtggatcacttcagaccagcctggccaatgtggtgaaacctcatctctacgaaaaaaataagatacaaaaattagctgggtactgtggcgctcgcctgtaatcccagctactcaggagactgaggcaggagaatcacttgaagctgggaggcataggttgcagtgagctgagatcacaccattgccctctagcctggccaacagagcgagaccctgcctcaaaaaaaaaaaaaaaaaaaaagaaactggatgctgcataggaaaattttaagataatattttatggtctaacgtgaaggacctattggtagttgtaaatgtgtgcttttgctaggcttctgaaataatccagcaaatttcaatattagcatgttactataatagtatcaattagtattcagtcattgctaataatggatggtgctctgaaaatttgttgctgagatggattctttggaaatcagaatgcatttttcccatggaagcattcttatatatgaatgaggacttttccaaaaacctgtttaactataatgcagcagaagagtgctactgtactgggttcaatacagtaagtagactcactgctagaagactctgtcttacaggggatgaaaaaggaattgagcttcattccaggactgactcttggcaaattttgatgttggtaaggtatactttttatacacttctatttataattctcccttcccatatatcatctagttagagaggtggtaatatttcatagactcatctgaaatttatcttcccaactttctccagcaattttctttttctttttcttttctttttgagacggagtctcgttctgtcacccgggtgggagtgcagtgacgcgatctcggctcactgcaacctctgtctcacggcctcaagtgagtctcctgcctcagcctcccgagtagctgggattaaaggtgcccaccatcatgcatggctaatttttgtatttttagtagggacggcatttcaccacgtcaaccaggctggtctcgaacgcctgacctcaagtgatccacctgccttggcctcccaaagtgctgggattacaggtgtgagccactgcgtccggccatttcacatattttctttaagagctaggctgcatcagaatcagccataggtgcttattatgaatacagaacctgcccccagagattataaattatttatctggagtaggacatgaaaatatttttttaaacaaatgacactggggacttgatgcacagttgggtacattttaagagaacattaaggggaaaagtattagaattttaaatagacaaaagcagtagtaaaagtggcttgtgtgatagaattatcatttgtaacacaggaagtacctgtacttcatagccccttcttaagttagcctcctttgtctctattttgttttctccgaaatcacaatacttggacaaatttgtaatttttttttgataatgcctgacatctttatgtaacattagaagttcagatttcttgtctattaactaacatacgtattctgtttttgaaatgttaatctcccagttttccctttataatagaatcatgtgtttagtggccacttagctggataccgccatgataccagaagcagtacaaaagatgaagattcagttaggatacagttttcgatttttaaggagtcattcttctgtgcccagaatacactagggagccaaacaaatgattcttacagtctggtgttaatgaccaattctaattccttatgtattatttttatatttatgttctaagatactttaataaaactttaaagactatgaaacattttattataaaaagtgttaggagattttacagtgcctctccatatacccattatctagattctgtcattaatattatgtattaacagctttattgacgtataattaacatgcagtaaaatacacgttaaagtctacaatttgataagttttagcatatatgtgcatgcaggtaacaatcatcacatgataatgaacatatctgtcatacctagaagtttccttgtgcctttttgtaaaccgtatcttctaaccctccttgtcccttatacccttcttgtccccaggtttttgctgatttgctttctgttactgcatattagcttgagttttctagacttggataaatgggattgtacagtttgtattctttcagtctggcttatttcagcataattattttgagattcatccatgtggtagtacaatcaataatttattcctttttattgctgaccatagcaagtggtggtgaggatgtgcaaaaactggaactctgttaatatgtctcctggggatgtaaaatgttaaacaacttgggaaaacagtttggcaatttcttaaaaagttaaacatacatcaaccatgttatcaagccattgtgcttctacatgtttacccaagagaaatgaaagcatatgttcatacaaagatttgcacacagatgtgcatagcagctttatttttaatagccccaaatgggaaacagtccaagtatccaccaacaggtgaatggataaacaaactggcatatccatataatggaataccattaatatttaaccacacatgttttgtcacatacctgtccatctgtccatctctctatccatgcagcaattcatattattaaatgtatttcagaataagttgtagagatgagctcatttcctcctaaatacttcagcatgtgtatcattagagtgcaatatttgcttagtttttttccttttgaggtaaaatttatgtagaagaaaatatacaaatcttaagtgtacattgactgagttttgacaaatacatacacacatgtaactcaaacccagtcaagatatagaacatgaccatcaccccagaaagtctttttcctgacctttcctaatttattcctaccctcatcttcagaggcaacaaatactctaatttttttctttctgtcatacatacacatctattctgctttgctgagagtgttttcttttccttcaagaatgttggagccaggcatgatggctcatgcctgtaattttagcactttgggaagctgaggtggccagatcagttgaggccaggagttcgagcccagcctggccaacatggtgagaccctgtctctactaaaaatacaaaaattagctgggtgtggtggcgggcacctgtagtcccagctacttgggaggctgagacacgagaatcgcttgaacatgggaggcggaggttgcagtgagccgagatcgtgctactgcactccagcctaggtgacagagcaagactccgtctcaaaaaaacaaaaacaaaagaatgctggattttgtcaaatgtttttttctgcatctattactattatcacaggatttttttcttttttaatctgttggtgtgatacattacattaattgatctttgaatgttgaactagccttgcatacctagaataaatcccatttggtcatgacgtgtatgtttagcactcagtatctccaggggtttagttccaagacctgtgcagataccaaagtccacaacagggagggcatggaagctccccaccaccttactttgctctgtccatctctttatctgtatcctttgtaatatcctttatgataaactgttaaatataagtatttccctgagttttgtgagttatcccagcaaattatcaaaccaaataaaatcaggtgcgaaccctgatttatagctggtcaatcagaagcacagatcacagcctgcgacttgtgactgacatctgaagtgaggggcagtcttatggaactgagcccttaccatgtgggatatgacattatctctttttttttttttgagacagagtctcgctctgtcgccaggctggagtgcggtggcgcaattttggctcactgcaacctccgcctcccgggttcaagtgattctcctgcctcagcctcccgagtagctgggactacaggcgcctgtcaccacaccaggctactttttgtatttttagtagagacggagtttcaccatgttgaccaggatggtcttgatctcttgaccttgtgatccacctgccttggcctcccaaagtgctgggattacaggcgtgagctactgcgcccggctcgatatgacaccctttctaggtagatagtgtcattatttaattgaattatagttagtgtctgttggagaattgtttagggattgggggaaaaacttcacatatctggttatctaagggttctgtgtcgaatatgagagtagagagaaaaacctttattttcctttgacagtgtcttatcatatttatagctgttttctgttttgttatacttgtttcctttttaaacagtcttcccctcctcttttgccctctctggttttaattgatcatgtgatatgatttaatttttttctcctgtcttagcataccaattatgcttcttaaacaatttatttaagtggttgtattacagtttgtgctgttcacttaaaactagtccaagtccacgtccaaataacattataggtcaggtatagtggctcacgcctgtaattccagcattttgggggactgaggctggcggatcatttaaggttaagagtacgagacctgcctggtcaacatggtgaaaccccatctctactagaaatacaaaaaatttgctgagcatggtaatgtgcgcctgtagtctcagctactcaggaggctgaggtatgagaatctcttgaactgggaggcagtgagccgagattgtgccacttcactctagcctgggcgacagtgcgaaactctgtctcaaaaaacacaaaaacaaaaatcccactatactacttcatggaaaatggaggtagtatatgtaatactctatcttacaatacagtatacagattcctcccttctgcccattgtaacattgttgtcattaatttcacttacctataagctgtaataatccaatgcattgctgctattagtattttagacatttttctattaatttaagaataaggaagaaaagacttaatttaccttcatctcttaattctctaatgctcctgtgaatctgagtttttggtttaaatcattttccttctttctgaagaactcctttatttatttgttttttttaatttttgagatggagtcctgctgtgttgcccagcctggagtgcagtggcgcagtctctgcttactgcaacctctgcctcctgggttcaagcgattctcctgcctcagcctcctaagtagctgggactacagatgcatgccaccatgcccagctaatttttgtatttttagtagaaatggggtttcactatgttgaccagaatggtcttgatctcttgacctagtaatctgcccgcctcggcctcccaaagtgctgggattacaggtgtgacccaccacacccggcctatcttaaccattttaagtgtacacttcatgtcattaagtacacttacattgtgcaaccatcaccaccattcatctcctgacttcaccattattcatctcctgaattcttcatcttgcaaaactgaaccacttacccgttaagcaatgactacccattccaccgtcttcccagaccccagtaaccgttattctacttttgatgtctgtaaattcgaatacttgaagtataagtggaattatacagtatttgccatttgttattggtttcttttacttggcataatgtcctcaaggtgcatccgtgttgtaggaaatgtcagcatttcaataatttttcaagctaaatagtatcccattgtatgtatatactgcattttgtttctccattcatctgttgatgaatagttgggcagcttccaccttttggctgttgtgaataatggtgttatgaatgtggatatttttctttgaagttcagtctgtgctgtcagatttttgggttacatacccagaagcagaattactggatcatatagtaattccattatcaatttttttgaggaattatcatactactttctatagtgactgcaccattttacattcctaccaacagtgtacaaaggtcaccatttctccacatcctcaccaacatttattttctctttttttgatagtagttatcctaatggatatgaggtggtatcttgtagttttcatttacatttctctaattagtaatgttgaacatcttttcatgggcttattgaccatttgtatatcttaattggagaaacatctatttaagtcctttgtccatcttttaatcaggttgtttgttttttgagttgtaagagtttacatacaaacatacacacacacacacacacacacacacaatgttagctgcttatcagatatatgatttgcaaatatttcccattttgtgtgttaccttttcttcctttttttccctgctaacttttattttaggttcatggggtacatgtgtgggtttgttgtgtgggttaattgtgtgtcactggggtttgatgtataaattattttgtcacccaggtagagagcatagtacccgatagatagttttttgatcctcaccctccccacaccctccaccctcaagtaggccttggtgtttgttgtttccttctttgtgtccatgtgtactggatagagtttgaatacatgtccccaccaagtctcatatttaattgtaatccccattgttggaggtggggactggtgggaggcagttgggtcataggggtggatctttcatggcttggtgctgtccttgcaatagttcttgcaagatctggttaagtgtgtggcacctccctatgcactccccctcttgctcctgctgtgaccatgtgatgttctggctccgcttttgccttctgccatgattgaaagcttcctgcgtcctccccagcagctgggcagatagatgctggtgccatgcttcctgtacagcttgcagaaccatgagccaattaaacctcttttctttgtaaattacccaggctcaggtatttctttatagcaacacaacaatggactaacacagtactcaagttttaactccgtcttgtgagaatatgcagtatttggttttctttttctgtgataactcgcttaggataatgctctccagtggcatccatgttgctgcaaagggcatgattttgctccttttcatggctgtgtggtagtccatggtgaacatatactgcattttctttatccagtccactgttgacagacatctatgttgattccatgtctttgctattgtgaagtggtgctgtgatgcacatacgcatgcatgtgtccttatggtaggacagtttatggtcctttgggtatatacccagtaatgggattgctggttctaatggtagttcttaattctttggtagttcttagttcttaaatctccagactgcattccaaagtggctgaactaatttacattcccaccagcagtgtgtaagtgttcccttttctctgcagcctcaccagcatctgttatttttgactttttaataatagccattctgactggtgtaggatcgtatctcactaatcattaatcctctaatgattagtgatgttgagttttttttttccatgtttcttggccgcatgtgtcttttgagaggtgtctgctcatgtccattgcccattttttaaatggggttgttagttttctgcttgtttgtttaagttccttatcgattctggataattagatctttgttggatgtatagcttgcaaatgttttctcccattttgtagattgtctgtttactctgtggacagtttcatttgctgtgcaagagctctttagtttaattaggtcccacttgccttttttttttttttttttgtagttctggaattttcatcatgaaatctttgtcagggcttatgtccagcatggtattccctaagttttcttctagggtttttatagttttaggttttacatttaagtctttaatctatcttgagttgattgttgtatatggtgaaaggtaggatccagtttcagtcttctgcatgtggctggccgttatctccacaccatttattgaatagggagtccttttcccattgcttgtcagttttgttaaaatcagatggttgtaggtgtctggctttatttctgggctcttgacctgttccattggtctacatgtctgtttttgtatcagtgccatgttgttttggttattgtagccttttagtataggttgaagtcaggtagtgtgatgcctcaggctttattcttttggtttagggttgctttggctattcaggctacttttttgggccagtatgaattttaaaatagttttttctaattctgtgagaaataacattggcagtttgataggaatagcattgaagctgtagattgctttgggcagtatggacattttaacaattttgattcttcctgtctatgagcatggaatgtttttccatttgtttgtgttgtctctgatttctttgagcagtgttttgcaattctcattgtagagatcttttacctctctgattagctctattcctaggcattttattctttttgtggcgattgtgaatgggattgaattcttgatttggctctcagcttggatgttattggtatatagaaatactactgatttttgtacattgattttgtatcctgaaagttggttgaagttattagttctaggaacctttgggcagagactatggagttttctaggtatagaatcataccgtctgcaaacagggatgatttgacttcctctcttcctatttggatgtcttttatttctttctctttcctgattgctctggctaagacttccagaactatgttgaataggagtaagtgggtatccttgtgttgtcctggttctcaaggggaatacttccagattttgctcattcagtgtgatgttagctgtgggtttttcatagatggctcttattatttccaggtatattcctttgatgcttagtcttttgagggtttttaacatgaagggatgttgaattttatcaaaagtcctgaatctgaaaagatgatcatgtggtttttgtttttagttctgtttagtaatgaatcacacttattgatttgtgtatattgaaccaactttgcataccaggaataaagtctacttgatcatggtagatgtgctgctggatttggtttaccattttgttgaagatttttgcatttatgttaatcagggatataggcctgaagtttcctgtttttgttatgtctctgccaggttttgttatcagaatgatgctggcttcataaaataaaatgagttagggaggagtccctccttctcaattttttggaatagtttcaataggattggtaccagctcttctttatatgtccggtagaatttggttatgaatccatctggtccagggctttttctggttggtagactttttatacaatttcagaactcattattgctctgttgaggtattcagtttcttccaggttcaatcttgggaggttgtatgtttccaggaattcatccatttcttgtagattttctagttagtgtgcatagagatgttcataatagcctctaaggattttttgtatttctctgggtcggtggtaatgtcccctttgccatttctaattgtgtttatttggatctcctctctctctttttttttctttgttagtctggctggcaatctatcttatttattctttcaaggaaccatcttttgtattttttttgttcagttcaactctaattttggttatttcttttctgtggctagctttggggttgatttgctcatttttctagttcctctaggcatgatgttagttgttaactttatatctttctaacattttgatgtgggcatttagcactataaactttcctcttaagactacattagctatgtcccagagattctggtatattgtatctttgttttcattagtttcaaataattcctttcttttcttttctttttcttcttcttttttttttttttttgagacaggttcttgccctgttgccgaggctgaagtggagtggcatgaacacggctcactgcagcctccaccttccaggctcaagcagtcctcccacctctcagcctcctgagtagctgggactgcaggtgtgcactcctacacctggctaattttttttgtattttttgtaaagacaatgtttcaccatgttggccaggctggtcttgaactcctgggctcaagtgatccccccacctaagccttgcaaagtactgggattacaggcatgagccaccgtgcctggcccaaagaatttctggatttcagtgaaattaagatttcgttgtttacccaaaagtcattcaggagtggtttaatttccatggaattgtatggttttgagagatcttcttggtattgttacctatttttattgcactgtcatcttgagaacatggttggtatgattgtgggatttttaatttgttgagaattgctttatggttgagcatgtggttggttttagatacgtgccatgtgcatatgagaataacgtatattctgtttttgttgggtgaggtgttctgtagaactctgttaggtccatttggtgaagtgttgactttaggtctgtctaatactgtcagtgggtttttgaagtctcccactattattgtgtggttgtgcaagtctctgtaggtctctgagagcttcttttttgaatctaggtgctccagtgttgggtatatacgtatttaggatagttaagtcttcttgttgaattcaaccttttattgttttgtaatgcccttctttgtcctttttgattgttgttggtttcaagtctgttttgtctgaaataagttacccatgcctgcccttttttgttttacttgcttgatagatctttctccattcctttactttgagcctatgggtggcattgcatatgaaatgggtctcataaagacaacatacaattggttcttggttcttcatatgaattgccattctgtgcctttgaagtgggatgtttagcctgtttacattcaagatgaatattgttatgtgctgatttcatcctgttatcgtgttgttagctggttggtatgcagacttgattgtatagttgctttatagagttagtggtctctgtacttaagtgtgtttctgtggtagccggtaatggtctttcatttccatggttagtactcccttaaggacctcttaaaaggcaagtctggtggtaatgagttcccttagcatttacttgtctgaaaatattttatttctgattcacttatgaagtttagtttggttagatatgaaattcttggttggaatttcttttctttaaggatgctgaattaggcccccaatttcttctggcttgtaggatttctgctgaaaggtctggtgctagcctgatgggattccctttgtagtagacctaccccttctctctagctccctttattatttttttctttcacattgaccttggagaatctgatgattatgtgtcttggggatggtcatcttgtatagtatcttgcaggggttctatgaatttcctgaatttgcatgtcaacctctctagctaggatggggaaatttttgtggacagtatcctcaaatatgtttccaagttgcttgttttctctccctctctttcagggacaacagtgagttgtagatttgatctcttcacataatctcatgtttttgggagatttttttccattgaaaagttatttttcctttatttttgtctgagttgatactgaagaaccagtcttcaagttcttgagattccctcctcagcttaatctgttctgctgttaatacttccagtgatattgtgaagttcttgtagtgagttttttagctctgtcagatcagtttggttgtttcttaaaatgactatttcatttttcagctcttgactcattttactggagtccttaaattccgtggattgggtttcaactttctcccgaatttcggtatcttctgagttttatgcccatcatttcagtgtgattaagaaccatcactaggctgggtacagtggctcacacctgtaatcccagcactttgggaggctgaggcgggcggatcacttgaggtcaggtgttcaagaccagcctggccaacatggtgaaaccctgtctctaattaaaatatagaaattagctgggtgtggtggtgggcacctgtaatcctagttacccaggaagctgaggcaggagaatcacttgaacccggaaggtggaggttgcagtgagccgagatcatgccactgcactccagcctgggcgacagggcaaaactctctcttcaaaaaaataaatatataaaataagaaccattgctggggagctactgcagtcattttaaggtaagaagacactcaggcttatagagttgctagaattcttgccctgattctttctcatctttgtgggctgatgttcctttaatctctccagttgctatcctttgaatgaggctttttgcttttatattcttggatgccccaagggtttgaccttgatataagttgagtttagtcgactggcatagtttcttgatgatttctgggtaccaaggctcagctcagcactcctggcatgcatgctataaccctggggtgttaggactaggcacatgactttgttctctgtctcctcgaggttaagcacccattgcactggtggggccaaggtgttcccggtctgctgggcaacaacactctgatggtggggccggcaaaagtgcttggttggggtggtgacagtagggtggtaaggcctgcatatacattggaaaagccgtcgggggaggctgtgggtgacggtgtcctggcaaaacagtgcggggaagctgtgcgtgggtggatgctggtggaggcccatgtgcaggtgctctctggtggttacctggggcttgccagcaaaggagctatagtggtggctgtcgggaagtgctgcggttgggcatcagcgtccattgcaattggatgtggccaggcagggactgtggaacaggcaaccagggatgggggttggggggggcgctcaaatctgacaagccctgtgccatgggcaagatagttctgttctgtctaggtccaatagtcagcaaagaccaaagctacctagaggtgtgtggtgagctttgggagatggacatacctggccatgctccactgcagccattcccacaccaggccttctgggctccgtgcagactggagtcctgtttctgccaacttcccaagcagctgtctttgcaacctcaaatgtctgtaggggtcatggagcctccttcagctaggattctagaggtccatgacaagaacaggctactccatgcctgtttaactcatcctttccccaggagcatttggggtcagaatgagtcatggtgctaggggagctccctgtaaggttcccagctttctcctccttcagcccaggatccgcatcctccttctgttcactctcagtgccttccttccaaagatctgctcagagtgtgctggtcttcttgatggcctggtctcttggtggtggaagctcttcctgactctgtgtctacttggccaccctgactcctctctgttgtctgttcactgtatatagtgtcatgtgaggaataaaagttttaacatttgacgaagtccaattcacctattttttttcttttgttgcctatgcttttggtgttatatccaagaaatcattgcaaaatgcagtgtcacagaactttctccctatgctttattctaagttttatagttttcagttttacatttagctcttggatccattttgagttaatttttgaatatggtataagcctgtcacacaggctggagtgcagtggcgcaatctcggctcactggaaactccgcttcccgggttcacgccattctgctgcctcagcctcccgagtagctggtactgcaggtgcccgccacaacacctggctaatttttttgtatttttagtagagaccgagtttcaccatgttagccaggatggtctccatctcctgacctcgtgatctgcctgcttcggcctcccaaagtgctgggattacaggcgtgagccaccttgcccaacctattgatctttttagaaaactaacagtcggtgtcccggtgcagtggctcacgcctgtaatcccagcgttctgggaggctgaggcgggtggatcacttgaggtcagcagttcgagaccagcttggccaacatgacaaaaccccgtctctactaaaaatacaaaaattagctgggcatggtggtgggcccctgtaatcccagctactcaggaggctgaggcaggagaatcacttgatcccaggaggcggaggttgcagtgagctgagatcgtgccactgcgctccagcctgggcgacacagcgagactccgtctcaaaaaagaaaaaaaaagaaaacgaatgctttatttttatttttattttttttccattctctttcacttatctttgctctgatctttattattttctcccttctgctaggtttgcattttgttttgtttttttccctatttccttaaggaataaatttaggtggtgatttgggatgtttcttctttttaaacataaacagttacagctttatgttccttctagcgctgcttttgctgtatcatactaattatgatggtacagtctttttattttcatctcgatattttctaatttttcttggggttacctttttgacccgtttcttatttaagagtgcttaattttcatatatttgttcattgttctgtttccatctgttatttccttatttattttatttatttattgttactagaaaagataccttgcataacgtcaatcttttataattttacaattttgtttttaattgacatgtattgtgcatatttattaggtacagggtgatgtttcaatacatgtatacattgtataaaaatcaaattggtatttagaatatccatcaccttatacattcatcatttccttgtggtgaggacattcaaaatctttcttctagctatgttaaaacatgcaatacagtattgttaaccatagtcactctgctgtgcaatagaacaccagaacttattcttcccatcttactgtaactttattctcattgaccaatctttacctatttcccctctcgccagtattccccagcctctggcaaccactattctatacactacttctatgagatgtcaacttttttagatttcacacgtgaaatcatgcagtatttgtctttctgtgcctggcttatttcccttagcattatgccttccaggtgcgtctgtgttgctgcaaaggacaagattatattgttttgttttgtttttttttttaaatggggaatagtatttcactgtgtatatatataccacattttctttagcagtgcatctgtttgtagacacttgatttcatatcttggcttttgtgaaaagtgctgcaataaacataaagtccaggtttctcttcaacaaactgatttcatttctttgggatatttatacattagtgggaatgatggatcatatggtaattttatttttaaattttttgaagaacttccatagtgtgttttataatggctgtactaatttatactcccaaaaacagtgtgtaagagtttccctttctccacagtcacaccagcatttatttttttgtctttttgatgatagccagtctaataggttgaggtaatatcttcttgtggttttgatttttatttatctgatgatgggtgatgctgagccttttctcatatatatacctgttgaccatttgtatgttttcttttctctttacaaaaattttgacacttgttttatgacctcacatatatcctggagaatgtcccatgtgcacctgagaaaaatgtgtattctgctgttggtgggtggagtgttctgtatgtgtcttttggtccagttggtcaatagtattaagtcctatatttccttattaatcttctgtgtggttgttctgtccattactgaaagtggggtattgaagccttctactgctaatgtagtgctatctgtttctctcctcaattctgtcagtgtttgcttcatatgttttgctggtctcatgtttggtgcatacatgtttataattgttacatctttttagtgaagtgtcggttttatcattatataatgcccttctttgttttttgtaacagattttgacttaaagtttatatgtctaatattagtataggttgaatatgccttatctgaaatgcttggaatcagaagtgatatggattttggattttttttttcttcagattttagaatacgtacatatacataatgagatatcttggagatgagacccaagtctaacacaaaattcatttatgtttcaaatataccttgtacacatagcccaaagataattttatacaatattttaaataattttctgcatgaaacaaagcttgtgtaccttcaaccatcagaaaggaaaggcgtcactgtctcagctgcccatgtggacaatctgtggttgtttggcatcatcgttattcttgactgaatttatatgctgatcagcaataattttctcacatttattcacacgtaagttgttaacagtaagacatatgaggtaccattaattcagtgaaaatacagtgtgttcagggtgagtaagcagcacagtagcatcactgggaatatatgtatccactgttaaacagcagcagcaacaaacagtggcaggcaggctctcagtctccacctacaatgctgtgttttgattaaaaggtaactgtagaatgtactgtatttatttattttttttttcaagtgagaagaaacattagaagcagttgaggggcccggaattggatcctcaggggatgaggaggcattttgctagatggcttttaaaaatgtttcctccagaaccatctgcctcactaactcttttttgtctgagaagtctctgattttataaactgtcataatttattgttctgttatgaatgcctgctgctccagtcctttaataagcccatcacacattttcaccatgtaccatgtggtctataggtacctttttgcattggtaacatcatcatctttatcttcatcatccacttgtggtattatgtctgcactcagaaagtttccgattttggagttttggattagtgatgcccaggtatctttgctcttttggttatttttgcatgggcttacttttttttaaatctttttgcttttgacctatgagtgtccttagagccaaagtgagtttcttgtagaccacgtacttttattttttttgtctctctctctttctctctatttatttattttgagatggagtctcactctgttgcccaggctggagtgcagtggcgtgatgtcggctcactgcaacctccgcctcctgggttcaagcaattctcctgccttagtctcccaagtagctgggattacaggcatgcaccatcacgaccggctaattttgtacttttagtagagatgggatttcaccattttggtcaggctggtctcgaactgctgacttcaggtgatccacctgcctcagcctctcgaagtgccaggattacaggcgtgaaccaccgctcccggctgggatcctgtttattttaatccattctgccaatctgtctttttgtaggagagttaagccatttatatttgaagtagttacagatagggaaggacttaatattgccattttgctaattactttctatgtgtcttacagcatttcttctttctgttttaccccttagtgcctttcctttggtttagttaattttttatagcaactttgattcattttgtgtttaattaactaataacataattaatattaacatcaagatagcaatgaggtctcgctgtgttgcccaggctggacttctaggcttgtgtgatcctcccacctcagcctcctcaagtagctgggactacgggtgcctgccaccatgcctggatgacttttgtgtatgttctaaaggtattttctttgtggttacgatggggttacatgtaacatcctaatgttatagcagtgtattttaaactttcattaatcccattacctgtatgttacagcttttgcaattgtcctatagttcttagacattctgttctattatttttctcattttctttttttattggctttgaattgggaagtttttatttacgtatcttggggcttactgattttgcattaaataattttttctcaatggtttattgcaagtatatttaaatgtagtttactttttgcatgttgatcttgtatcatgctactttgttagactcatttgtataattctgattaaaatgtttgtatatattaacattgagctacaattgcagaggtcaaaagatacaattagtgaagatttggtcaagcatactctgttagactatgtagaagaatgaaggtgagataataagattataggcagattatattatctgttatgcacattatttatatatttttcctgattatgacaggaatgaagcatacatattaactttttaaaatgaaaaatatttgattgtttgaatcttttttttaatcttttttaggagctgtggccctcaagaatcttcaaattaaagaaaatgccctggtaggttttgactatgaaaaatttgtaaagttattgcatttaattatgtataattcttcctgattcagtttgtcaccttaaattatttaaatttgagaaagttttttgtaaataatttttgcaaaatgtaaattttgctaaatggagttttaatctccctgaaagcacaaatggacagtgtgattttttttctatttaaaaatacatattgttttaggctgggcatggtggctcatgcctgtaatcccagcactttgggaggtcaaggcaggtggattatttgaggtcagtagttcgagactagcctggccaacatggtgaaaccccatctctactaaaaatgcaaaaagcttcgccaggcatggtggtggacgccagtaatcccagctgccagggaggatgaggcaggagaatcgcttgaacccaggaggtggaggctgtagtaaatggagatcgtgctactgcactccagcctgggtgacagagtgagactctgtctcaaaacaaaacaaaacaaaaacaaacatacaaaaaatacagatgtttttatttcaaatttttaacttgttttctgattttttttttaagacaggctcatgctgtgtcaccccaggctgcagtgcagtggtgtgatcatagcttactgtaggcctcagctcctaggctcaagctgtcttcccctttcagcctcctgagcagctgaaaagtttttaatctgataaagactagttcatttttttaattgcttgtgcttttattgtcatattcaagaagtctttaccgaatctaatgtcgtgaagattttcccttatgttttcttctaagagttgtatagttttagctcttaggtttagatcttagatccattttgaggtaatttttgtatatggtataggataagggttcagtttcatgtttttgcgagtggatatctagttttcctagcaccatttatttaaaaggctattctttgaatggggagaacgttttgaaagtttattttttacaaaacgcgtattttgcaaaatagagttttaatctccctaaaagcataaaatgacattgtaattgccacttctttttcttaaaataatataaaattggtaatgatttgatatgagtagattttctggtcatttttactgtagacctttatccccaattattattaaaagagcagcttccctggattttatggatttgatagtaatattgcagttatatgtttatatatttaaataaatgttgatgataaggaaatgtgtaagtttattaaaaaatcccttgaaataatttttggaagtaaagagtattcatttatgttgttaaactctatatctactaatgttttgtgtatatataaattttttctgtagagtcaactggatgtaccatttaaagttaaagttggtcacataggtaagccatattcattattgggatatcctccttcctggacatgcagccagaataatttgcctaatatatctattatgtgatatttttcatgtttctgagcatcaattaaaaataatcatgtgtttttgtctcagtagagctttgttgtgcaacttaaaaatattgtccgatacatatatcccttgcctagtatttgatatcctaatacattacatatctctttaggtggtaaattgagttaattcaaaggattacctctaagggagagcttaactgtttcagtttcctaggtttctgtctagttaccactgctatattttgattaacattggatatattgtgtaaagaataggttctgcatcatccaggccctgtgactaggggccgatttgaaaactaatttctgctctgcaagtttttgtatggtttcagaaaatactgtgctttttcttgtttggtattatttttaccagtgtttactgtttatatcttaaatatattggttgagcagtaaatgattggaatttgaggttttaacatctttaataaaaacttatctgtcatgtttcttgtgttacagttttactggtttaaatattgtgcaagataatagtgtctttagttgggacttggagatatttttgttatatagatagttttgtggtaggatgtatacattgttattgaagctatactgttgtcacttggggaacaaagtattctgaaaggttacctagattacatgataaaggtcttcataattatgtgtacttatggttggtattagaccacataccatagaaaactttcatcatcatatgttactgacagtagaattctatcctccccactcctaccttttaaagactgtttactgtaagagggggagaatgtcacccatttttatctacctaacattttaattttttcatatttctgattatttacatgtgtacattttaaatacttacaagtttatatgtattgaaatacttgtaattatgctatttttacagttttatattttttcattagcgtataaaaaggatttctcataatctgagttgatttgatctcatttattctgtaccataataatccagtgaatgcatatttggatattgtagaataattttatttttccattggtacagaagtattacaatacatatttttatataacttttaaacttttaccaaaggtcattgaattttacagtgatgattgtcgtatttcagtgtatgtaaatttaacctcaattcaagaacagtcaaaaaatatatcaggagagtagatagactattttctttagaatctgcccgccttctcttttcttgcctaatcttgtttaaaaatgataaggtaatttttagtgataatataagatagtagaaagtacactgaactaaacccaagataattttgagagtcatttaaggtgttgtgtacctctgtcgtagcacctgtcttttaaaaatatcactgttttttcccccttctagtagacatcgagtttcttgagaagaagtgggtttaatttttaatgtatcctcaccacttagcacattacttggtatatatagtaggggcacaatttattgtatgaaagtaatacatgtttccaaatgaatgatacagtagtacaatcagttttataggaatgtatgtccccttgctattattgggtattgatctttcaaaatttccctcgtttagaatgcagaattatagatatatcaaatataaatacacatgtacatattataaaagaggttgtcttctgtggaaggtttttggaattacatctgtgtatttttttgaaatttgccaaattttctactaggagtctacattttataagggaaggaagaaaaggtttgtttgtttgtttggtttttgagacagcatcttgctctgttgcccaggctggagtacagtggtgcgatcttggctcattgcaacctatgccttcctggctcaagtaaccctcccacctcagtccccgagtagctgggactacaggtgtacgccgccatgcctggctaatttttgtagtttttgtagagacagggttttgccatgttgcccaggcttgtcttgaactcctggactcaagggatcctcctaccacagccacccaaaatgctggggttacagatgtgagccactgcgcctggtcaagtttggattttttaaaaaaacatttgtggtgaaaatggcacactgttaatatgtgtttattatttttacagttttgtaattgctctttgtccttttgttcatttactttttttgaagtattactgtatgtattttaagcagtctgttggtacatttataaataaattaaccgtgtcaaatttgttacagttttttcacaatcttattatttcattttggttatatttttggtctgtacagaaatttgaaatgatccccatgttctctggtttaaaaacttagaaagttattcctcttttagaaatcagatagtttagaggccgggcagggtagctgatacctgtaatcccggtactttgggaggcagaggcaagaggattgcttgaggccaggagtttgagaccagcctgggcaaaatagtgagactgtgactctacaaaaaatataaaaaagaaatcagatagttcatttttctctgaagtgatattatatgatgaaatctttttctcagtttgaagttttctacacatggagtttataaaatatcatgagatggatctaagtggatttaaaaaaatttcccaatcactaaccagttttagcaacatagtatatttaataatctattccttacacaattatggcagctgtataaatctagacactcataccatttaaacaattctaaaatattttaaaactctctattacgaaaatattctcaagatacaaaactagagtgagtagtataagaaaccccatacatagtgtttttgtagttcaagaacccttacgcttaaaaaaaaaattctttgctgtttgattttcttaggatgttttcattagtttgcataattttcaaatattacccagaatattttattattactttatgtgtagttttcatatatatagtttatatgtatgattattaccatatgtgtatatgtgaattactatacatacatacatacgtatgtaacacacatatacataatgaaaaatatacatacacacacttatttaaagtatacaatctacctttcattgcggggaggtaaaggtctcactctgtcacccaggctggagggcagtagcatgatcatggctcactgtagtcctgacctcctgggctcaagatcctcccacctcagcctcccaggtagctgggactacaggcacatactgtcacgcctggctaatttttttagtttttattcatagagacagggttttgccatgttgcctaggctggtcttgaactcctgggttcaagcgatccacctgccttagcttcccaaagtgctaggattccaggtgttagccactgcgcctggcctaatctaccatcttaaagcattaaaaaatataggtttagagtaagaactggggaaattcaaagttatgatattaaggattgttgattaagggaagaagaacattgttttgtttatggtacagagaactgtaaatagaaacttgtatatttcgaatataatctaggttttccaacagtactgatataaatacaataatttcaaatcattacaacaaacacttgttgtttgtagttgtaaaatagctttcaataaagtgattaaacgcttaaggacaaaggccactttattatctcttcaatgcctgacagaaaatagactaaccataaatgcaggttgaaggagtaatattttttgtcctttttttttttcccaaaaaaatgtaggtaatcttaaacttataattccatggaaaaacctttatactcaacctgttgaagccgtattggaagaaatttatttacttatagtgccttcttctagtaagttaaatttaaaaaaattataatttaagttattcttttttatggatggaaaaatatttatattcaaaatacttttggaatttttttgagattttaatatttaaatttgatatttgttaattcaaattaaattggtttttactctacatttttggcaactttgaattatttattatttatttattattatttttttttaagatggagtctcgcactgtcacctgggctggagtgcagtggcaccatctcagctcactgcaacctctgcctcctgggttcaagcgattctcctgcctcagcctcctgagtagctgggattataggcgcctgccaccacgcccagctagcttttgtatctttagtagagatggggtttcaccgtgttggccaggctggtttcgaactcctgacctcatgattcgcccagcttggcctcccaaagtgctgggattacaggcatgagccaccgcgcccggccaattaatgattatttgtaaggatttttttggaatgactatatttaaatttaaggtagttatgattcttcctttttaatcttcctataggaataaaatatgatcctttaaaagaagagaaacaactcatggaagcaaagcaacaggaactgaaaagaatagaagaagcaaaacaaaaagtagttgatcaaggtaaagaaaacagtaaataacaatgctaataagagaagtagaaaagacctaaatatttatcataattgaatattatttttctctggagatgctgagattatttcagaaatatgatagaatctcattgcatggggaattttaatgtggtttgtatgctttgttatgtgtacaggaattttaccttatggaaatttatcttaaggcaaataatatgtctagcttattattattattaggtttacatattttttatatatatatatatacacacacacacatatacatactaggtaaggtcagtttttaatgatagcaattaattttatcaagcatattttcttaattttctagcctttgcttttgtattccttttatatcaattcttcacccttttggagatacttagtttcttgacatatttctatttgcctctatctgtttatttaccctctggcttcacatattttccaattaaacttagacaatatgttccattactgcaacctctttttcattattggaagcggtgtcctgaagaaatctaattccttttcacctgttctctgatccttactgccagctactttttaaactctcacctagtgggttttttgccttggcatgtaaatacgctgttctttatcttgaaacatgaagtcattttcttaacctagtcatctgtttatgttcttctcctctgtcattcatttaatagttaaacatcttaaaattaaaaagtttactgacttcactgtctctgaaatgcattgattttcttttaataaaaaataataagcttcaataatgttttacttgttggcaaacattaatagagatttaacatgtaattcttggcaatatctcttgtaattctgttttttctctgtaacagttactttatattatgtgtagtcatttatccttacctccagtcctctttcctaagtctcttaggccttttctttttaaaaattatttttattttatcaagataatatatatacatagctttaaaagttaagcagtattatagtgtccggattaaaaaaaaaaaccaactgttcctggcccaggcccgcacctatattactaaatatggtgctcaaacctctgtgtcttgatttatttagatattatatatatatatatatatatatatatatatatatatataaaacgtgttatatgtaacataacatgcatattatctataacataacatattttataacatataattaatgacattacatattttaaactcatctcgtgtttcattggcatatatatgacatatataatatataacgtgtaatatatatattacacacacatccttttatgatgtactatgaagattgaccctattttttcatcttctctatatagttctgtcacatttttggttaaatcagaattcattgttaatagtatcatggctatatataaatgttttatttatatataaataaagtggctttaagtatgactgtttattttgtaggcttttagttaacctccctgttctcccatgtacaaaatttggatcctattagggccattttctctaaaataaacccttgtgttctcactagggtgggaaagggatgttgcttggatattgggctgggagagaaggggacctaacttaactgctccttatacagatttaaatcagttcttgtgttatcttcctctctctccactgtgttccatgtttgctattttttgtttggtggggtttccagttcctgtgtctttccagggttctgtgacttggatttttgttgttgttgttgtttgttttaaactcatcttgtgttttgtttcattaccctgcaagatataggcattgatatgcttttcatgtaaaatggatagttggttttattcaggattggtactttattgacagtaatatgcaaaaaaagagcaaagggatttaaggtgttggtaaaataacatatcatggaatctgagctgcataaggaagtcaggaggaagtagtgggtagagaaagaaagacaacatttaatcgaatgactaaatgaatttataaaagaaaagattttattaggtagtggtgagagtcaaagattaaaatatgatcctctgtctttaaagagcttgtattctgttgtctacttaattctataatctatttatatgtatatatattcatttaactctggtgtatttgaggtacatatgattagtatcttcagctttcctttatctaaggcctcctgggccagctgaatttgagagtaataggcaattagaggaaaagatagatttatatgtattatttctatataggagtagaaatatgaaaagaggaacagaattagaaataaagaatatagctttcattggcatttttaaggggagaaaaaggataataactatgattatcaaaggcatatttcaaaaaaattaggaacctcaattctttattcttctttattcttggtttttctttttttttgagacaaagtctcactttgtctcccaggatggaatgcagtggtgtgatctcggctcactgcagcctccacctctctggttcaaacgattctcctgcctcagcctcccaagtagctgggactacaggcatggaccaccatacctgcctaatttttatatttttaatagagacggggtttcgccatagtggccaggttggtctaaaactcctgacctcagatgatctgcccaccttggcctcccagagtgctgggattacaggtgtgagccaccttgcccctccaattcttgattctttctatttctttggaaagtaatggaacttgagatagttaatgctgttttctgaacatgaaatagttgatgaacttctttcatccttgttcaaaagaagaaagaagatcttatttcctattttgtatttactgggggaggaggatattcaactgttttacacatctatacacaggcaacttaatggtggtatcactaattttgagagagatttctgctttgctgctgttagtggattttctcatttaagtctattgtaattcttacccaataatcttcatttttaaatatatttttgtactcaggcataggttaacagaaattataaaatttaatgccagtaaattctacatggtctgctttagtctcatggcacaataaactagcttttgaaaaatgtttacttgcttttgaaagacttttggaaagcaagctattagtgttctatttacatatatatgtatatttcagcaaggcaacgtaagcatgttacttcagtatgtggatatttatagagtatatttttcattcaattttaaaaaaggaatatttgcaattgtagaacaacatctgccggaaaaacaggacacttttgcagaaaaattagttacacagatcataaaaaatcttcaggtgaaaatttccagtatccatattcgttatgaagatgatgtaagtattttaatatgtgatatttgtttttatatttatatgtaagttattttactatttaatgacacctactttttaatggccaatctgttaaatcccaaaaggttacagagctaaagatgatgtgatccttcttttctataattatagttgtaatttgcagtccttagtgttgagtgcttgattttacactttcccaaaatgttcagacattagatcatgaaggaaatgccttgggaattatgaatttagcagttatgtatttttaaaatactttaaagtatgctatatttacctcctggatggagtactggtctagcaattagtggagctagccttaaataattccttgatcctgaataggtcatttgttttctcttaaccagataattatttgctttataatcctattttgttagtcttttttaataattttttttgtaaactggaaaacatgcagtataatattcctgtgtaacacgaatacattaataattagtattctaatttgttttaggaaaaatataggaatgaaagtttttctggaaagtaataaaatgtttctgaatgtttgaaataagttacttcccaaaaagttatccctccctcccttcctccccccacctccctctctctctctctctctctctctttctctttctctctttctttctcttctcctcttctctcccctcccctccccttgcctccccttcccaagacaaggcctcacactgtcgccaggctggagtgcagttgcccgatcatgactcattgcaaccttgacattccttgctcaagtgatcctcccacctcacccccacccacccaccctgcagtagctgggactacagttgcaccccaccaggcctggctaattttcttaacatttttttttgtagaggcaggatctcactgtgttacccaggctggtctccagagctcaagcagtcctcctgccttggccttccagagtgctgggattacagatgggagccgctgcacattgacagttttttctataaagtggattttatccaactactaaaaatctgaataaattttactttctttcctctttagatcacaaatcgggacaaaccgctgtcatttggtatttcccttcaaaatctgagcatgcaggtattttgtttataaaagaatcttaaccatatttaatgtgcaatatagtctattaaactgctactatttgtatatgccagcatcagaaataggtgtctatgtagaacgggtgcacaaagggtcttcattggattggaatcgagggtatgtagattcacatttcaaaaaatggttgaaaatcaaattcagaaatatgaggtcctattattattggtaattatgatgttagatgcttttgcttactttaagaaatccatttccaagtttgtaatgagtaagtaccaaatacaagtaataaatgttcatatctgaaacttcgataagccttgaaaaacaaaaatcttcagtttttctcaatatcattattaatattgtagcatagtgttttcctgtttaatttttgaaattgaggaattttaaaaatataagaacatgtagagaattttgaaacatatgcttgcctccagaatggatggctgttaaattaagagcctattaaaatagcctatttgcttaaagtcttaaatatttttataggaataagctgttttggataaagtttgaatcccttttgttttctacttccacccacccgtccttccccagagataagtatcctaaattttaaaacttttatataatatatctattaaaaatgtaggattataaaagtttacgcgttttatatgactcttttatgagttcctttttgcactttccagtgttgttgacatttatctgtgttaccacatgtaacaaaattcattcagtttaactgctgtgtatttcattgcatgattttatttgttgtatctattgggttttgtgtaagatttctttttaattttattattatttttaaattgggcagcctcccaagccagagcaggctcagagagactccacagtttctttttaaaatgtggccccactgcaacgaaaaaagaaaaaatgccctccaaaaagttactcaaatactctcattaagttgaaaaataagaatggagaattagccattggattgggcaatgtgaagatctttggtaaccgtgataacagtagttactaatcatcacctttggaaacttgtctgccagcctagacctgttcagttagaaactctaggatttggttgcagcaatctgtgttttacaaagccctctaggtcagggttcctgggccacagaacaggaggtaaggcctgggagtgagcattaccgcctgagctctgtcagatcagaggtggcattcgattctcgtaggatcctagcgaaccttattgtgaactgcgcatctcagggatctaggttgtgcccctgatggaaaagttatctcctatgaaactggtcgttggtgccaaaaaggttggggaccactgctctaggtgatcctaatgcatgctaaactttgagagctactattctaattatccattcagttcgtctccacatagaaacgaaaaccatctttctgaaataaagatctgatcactttattcctctcagtggcttttcattgctcttagttttatccttaaacaacttataaaccctttttaaaccgaccccaggcaatatacctggttttactttttttctctgtctgttttgcattatattctcctgcatactgagctacttcagttgcctgaatgtgccatatatttgtgtacttttgggctctgcctgttgtgaatcatattccctgtcgaccttagaatcaataatttttagttacatgttatatattaggttatatataacatctctttatccatcacacccctgaattggatgctcctgccatgccctctcaatgaaatgagagggcattttttttgtagagacaaggtctcactttttgttgcccaaatttgtctcaaactcctggcctcaagcaatcctcccaactcagccttccaaagtgttgggattacaggtgtgagccactgcacccaatgatacctgcaaatctaaatagctcctagaacattcttttataagttaaatgagttatgagttttagaagttaaatgagtatttaacttctgctgtggcacttacctgttggaagttgcctgtttctttgtttgcttttctgacccgcaatgagctccttccttgaaagcagacactttactgtggtcagttagtattttttgatggagtgatatgtctttaaaggcattttcatgaaagggacattggtctagggtatggtagataatgatttattactctgctgtttcaaatggaatgacctttttactgccattgttttttttccttttcagacaactgatcaatactgggttccatgtttacatgatgaaactgagaaactggttcgtaaggtaaataaatactgtgtttgtcaactcatggacttaagagaattttggaaagccaaatgataatatatagataaggatgtatgtgaattttgcttatttgtttaactctgtgatatggctcacttaattatttgagacttctgaaaatagtgtatgataaaaattcttcaaagaaaatgagacatctaataaattttattttcagttaatccgattggataacctgtttgcctattggaatgtgaagtctcagatgttttatcttagtgattatgataactccttggtaagtaaattttttctgtatgtatttgttggtatcatattttgcatgaggtttaattcattgtcatttatctaatatactgtagtcagtattttttcctaggcacaatctattagcagaatttacagatacaggtgaagatgtgtgtaactatacacaaacatgaatacatacccccatatctttttttttttttttttgagacaaggtcttgctctgttgcccaggctgaaatgcagtggcacgattatagctcactgcagcttctaactcttgggctcaagcaatcatccttcctgcctcagcctcttgagtagcgaggactataggcacacgccaccatgcccagctaatttttaaatttttttgtagagacaaggtctcactttttgttgcccaaatttgtctcaaactcctggcctcaagcaatcctcccaactcagccttccaaagtgttgggattacaggtgtgagccactgcacccaatgatacctgcaaatctaaatagctcctagaacattcttttataagattagtttggtgagatgttgtttaactactttaatattttgccatagctaagttctaagtttgaattggtttttaaaattgcttttaaacatttttcttttgcagataataggattttttaggataaagacatattggcatgaatatggctaggcgtggtggctcacacctgtaatcccagcactttgggaggccgaggcgggtggatcacttgaggtcaagagttcaagaccagcatagccaacatgttaaaaccctgtctctactaaaaatacaaaaattagccaggcacggtggggcacgtctgtaatcccagccactcgggaggctgaggcaggagaatcgcatgagtccatgagacaggggttgcagtgagctgagattgcaccactgccctccagcctgggtgacagggggagactccatctcaaaaaaagacatattggcatgaatataaataaaagcaatttgtcttttaataggacgacttgaagaatggcattgtcaatgaaaatattgttccagaaggttatgattttggtaagtacattttataagataaaaaaagtagttaaagtaattggtataaattttaaattagcattgttgctatcactgtgctagttcctgttaaatttccttctatatagttaaatgtatttataatgtatatacaaaagcaaataatattatattttttagtaacgtattttattgttatgaagcttttgactatatttcaaaactataggggaaaatgtccaacaaaagatgttaataaattatgataaacctctaaggattattcagtaacaattagggtaatatttatgaagacatttcaaaatggcaagtaaaatttaataaggctagctagtacagcctttttcgaaatagtaagatcacgctgcatttaaaatttttttaatttatacttttctatgttttcctaattttccaaaatgagcatccattacttttacaatcggaaatgaattactaaaacagaaagaaaaaaatcagtgctgtttctcagtttcccaagtagctgggactatgggcacacactgccacacctggctaatctctttcgtattttagtagagacggggtttcaccatgttgcccaggctggtctccaactcctgagttcaggcaatctgcccgcctcggccttccaaaatgctaggattacaggcatgagccacctgggaacctgggaggtagaggttgcaatgagccaagatcacgccactgcactccagcctgggtgacagagtgagactccgtctctacaaaaacaaacaaaaaaaagtgctgttttttctatgataagggcacttaataaaagttggtgatggataacttaattattgaatttgcatgcctgatgtcattaaccatagaatatccttcctgaaagtatttcctttcttggctcagtgatacttttctgtctatattatacaccttcatgactactcaagtgattcttctttttgtgcccactcttaaaataattatttttattggtttgaatttagtttcattttcttgattctcttctcataggaaatattcagaacagatgagttatctgtcatatgtgtttatgattttcaaatccataatcgtaaattcgacttatttctcctttgccctgaagtcatttttgttgtatcagagttcagtgaggagagagaaagtactgagtaatttgaagaggacaaatttaatataaagaattaccaactataagaggagactggagtaacaagggactgtctcataaaaatgctaaagatatagacagaagaaacatcccctaccctagggctaagacggggtgcccaaaagagagggtccccctccttcaggactgagttgtagaccttgttggaggacatagcgtggcttattgaatggcaggaaattatctgtggtgctgtgccagcaaaacctgttggtacttcactctctggaactttctggaaattacttttagggagcctcatggaggggtgtctctctgaatgcactccagtacaaaactgccttagcaaggtgctgggggaagttgctggcatctggctgcatctagctgccatgtactgcataaggccggtgctgaagaactccgtgctggaggaaccagacactgcagaagctaccggttctgtaggagctgggtgtgggagaagccgtgttcttgcaggagtctattgaatgaacatactggaaccaggcagcataactctttcctcctgcagtgtctctccagtgtcctctactgataaagcttaacattacgccagctggaaaaagaaaaaaaaattttttttctctacattctctgccttcaaaggaaacatatttaaagatccccaaatcatttttcagagcaggctatgaaggagaagtttggagctcagaagtaaaaaattgataactggcatacctgttggagagcgaagggggaatgaagggtttctttttgtttgtgtttatatttaatcagggagatgacagcttgtttttaggctgagatgggaatgatccagtagaacatgacaaattgacgatgcaggagaaacgggggacagtttctggattgatgtaggtgaaagagaatggtgtctagtacgcaagtgaagagctttgctgcatataggagcatagttaatttatatgatagagtttagttgtgagagaagtccttatactgagtagatgagtagatatggtgataagagttgatgtaaattctcttctgagctcttcaattaaaaaatatgtatctgaggtatgttagggttctctagagggacagaactaataggacaggtgtatatttaaagatgagtttattaaggagtattgactcacatgatcacaaggtgagatcccttaaataggccatctgcaagctgaggagcaaggaagccagtctgagtcccaaagctgaagaatttggagtttgagaagaagaatttgaatgtttgagggcaggaagcatccagcacaggagaaagatgtaggctcagaggctaagccactctggtctttccatgttcatctgcctgcttttattctggccatgctggcagctgattagattgtgcccacccagattgagggtgggtctgcccttcccagtccactgactcaaatgttaatcttctttggcaacaccatcagacacacccaggaacagaagttgcatctttcaatacaattgagttgacagtcaatattaaccattacatgagatgttggaggtttttggagggaaaagagggtatgaaataggaatgctaggggagtgagagagtgaaatgacgagggcagtattctcaaagtatggttcaaactagcaacatcatttagaaatgcagatttctagggcctttcccagacctcctgaataagaacctctggaggtgaagctcagcatttgatgtttttgtatttaattttttatttgtataaaattgtggagtacaatccttacatggatatattgcatagtagtgaagtctaggctttcagtgtttccatcacctgaataatgtacattgtccccattaagtaatttcttatcatccacccctctcccatttctctacctttctgagtctccagtgactgtcattccatgctctatgtccatatatacacattatttagctcccacttacaagtgagaacatgcagtatttgttgttctgtttctgcattgtttcacttaagataatggcctccagttccatccatgttgctgcaaaaaatgtgattttcttctttttttggctgaaaagtattccatgatgttcatgtaccacattgtccggttacctgttgatggacactttggttgataccatatctttgctattgtgaatagtgctgtggtaaacatacaagcgctttttttttcttttttttttttggatagaatggtttcttttctttcgggtagatacccagtaatggaattgctggattgaatagtagttctgtttttagttctttgtgaagtatccatactgttttccacagaggttgtactgatttacattcccaccaacagtaatcccttttctccacatcctcaccaacatgtgtcattttttgtctttttaataaaaaagacattatagttttaattttcatttctcggatgatgagtgatgttgagcagtttttcatacacatgttggccatttgcatatcttcttttgaaaaatatttatgttctttgcccacttttttttttttttttttggagacagagtcttgctctgtctcccgggctggagtgcagtggcgcaatcttggctcactgtaagctccacctcacgggttcatgccattctcctgtctcagactcccgagtagctgggactacaggcacctgccaccatgcccagctaattttttgtactttaaatacagatggggtttcactgtgttagccaggatggtctcaatcttctgacctcatgatctgcctgcctcggcctcccaaagtgctgggattacaggcgtgagccactgcacccagccctttgcccactttttaatggagttgagttttttgttgttgctgtttgagtttcttgtaaactctggatattagtcccctgtatgattgatggatagtttgcagatattttctcccattctacagtttgatattttaataatctctccaggtgattctaatgaatactaaagtttgagaaccactcagatagactagggttcaataaggttctcatactttgagaacattgccttttttttttttttttggaaagggacatgtagtaagttaaatattttacattttgcaggccatatacagttcctgacacattcctctttgtttcttttaaacaactctaaaagtgtatgaatcatctttggctcactggctatacaaaaataggctgtagcatggatttggatgattcctggactgaaggactgttgtgtaattgctcagcagcattaaggatgcacttgagatttatgacactaaagtgagacccagcagtatgtttttacccccggccgtgttcagctccttaggggcactgtggagttaagttggttactccacactgacgaagtgagaagttaaggagtctatgcaaaggaatgattaaaataactgatggtggaacttcagtaaggtggggatggactgaggatgtgaagcagaggtgaagggcagagaaaggttggaggatcagtgaattgtaggtccagggtagcttctgtcaccagccactaaatttatttatttcttctgcttttttttttcaatgtaagaagaaatacagaagaaagaacaagatctttaagcatttatttatattcaaatgaacatattcttgaatgtttaatgtttaagaaattaaatgttagtccatatcaatgattaaaataaaaggaatatatcatctttatatacagattagcttataatttaatgatggatctttgtctagattctgctattactggtcttcctctgaattgttcttattctttttggcaccaaacacaaagagttgagaggaatttatcttagattatgggttcagccaagcaggtaatccagagcaaactttcactcttcatctctctccttttaccaattaaaaggaagaacacagatggatctagagaaattgatcagaaattcagaaattataattatataatggaaaccagtgttaatcctcttagcatttctaatgttcattcattctgtaaaactgtgtacttgtattaaaactatttttttgattttttttttcttaaaatgtttctgcttttaagtatcatattggtattttgagggggagttcaatttgcctttattgtatttatggaagacagtgaattttaagtaggaaaaagataaagaatcttctccacacatggttcatctgactgaaccatggcagtgtgaacatctgggaactgtagaaggggtataaaataaatggaaatcagtgttttcaacttcatcactttattgccttgagactttggaaatataactcagttttttttccatttttattatttttcagtatttcgtcccatatctgctaatgccaaacttgtgatgaatcgccgatctgattttgacttttctgcccccaaaataaacttggaaattgagttacataacatagcaattgaatttaataaaccacaggtgattttctttaatataattttcaattgtgaattattgtttgataaaagcaaaactaagattttaaatgtttcactaaaattcatgatgttatatggtagcatttccctaaaaagtcagtaatgtaacttttatcttcagcaattgaacaaaaaaatgtgatacatttaagagctttaattttccattctttagtatttcagtattatggagcttcttgaatcagttgatatgatggcacaaaatctgccatataggaagttcaaacctgatgtgcctcttcaccaccatgccagagaatggtaaatgccttgatttttttttttttttagattttaaaaatacaacataaaaataaatttctcgacttcaagaataatctttaagatataccatttttaaggtctgatacaaaccataattgatttatagctagaaatatatgtagctgctttagcttattgagttaatgaaactgatttaagggattcttgctaacacagtttacaactcgagatgctcgaataccatagttttcatttactatggacgggtcagtatatttagaattattacaaaaacaaatcctggtttgttttcttgcattgtctctccccaacccccacctcagcttccctatcagatacactgaaccaatattattaaacctgtattttaaaagctaaaaatgttacggagtctatgcaggataatcccattttaaaactcaaaagtcttgttattccagtttttaagctattccctagtttctagaagttacaattactctttcagttgactatttcagttattattcagatgactaaatgttatttgccaattaatgccttaacagttcttgtgtagaactatatttaacaaaatggagtgattttgcttattttcacttaagaaagaggaaagattaatattgaatggattattaatgcaaatggagttgggtaaaaaggaagtactcagataatatatcattttcctaatctttgtattatagttatgtatgttgttagagtagaagcaatgtcagtaatgtttcatactgttgatttgagggtgttaaatgtttttctttttttaactaggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggttagcatttaaaatgaaattgttgagtgttttatactacatagctccttattggtcttcagtgactgatactccctacctttcattccaatttttattgaccttttcatctcttttacttagacttttttgtgcttctgttcttaacttcagctgaataatacaagatttgttgaaattctccagtgagcttttgaaattcgagattattctcaatcggaaggaatttgggttcatgcaaatagtatgattatgtcatttttaacctcaaaagtctaaatagtgtttgctacattgattccaacttctctgtgttggtttcaaagccttttatgtgtcaccactacattttccctatgttacaatctgaccatgcactaatttaatgtttcctgtactctgtatatttaatgctcattcttttagccacgcctatgctcataaatgctacctgcctttatctctctacctactcaattctactcatccctgaagttctacttaagtcttagtgcttgcatgaatgtctctgaattttctgcttatacagagccctttttctcttaatttttgtggtatctctagtctctaccagtagttttacatttaattatctatcttgagatattatttttgtattaatcttgtcttttagcattatgacatatttcaagagggactcttttacaaattgatgaactatagcttagagagattaaggggagttagtctcttgaagttaatgtaaacattctgaatccagaatgaatttctaatttatagattagattgacttttacttttattttcaatgtgggagactttctgaagacctagggctgttaggaatgcctgggcttagagtctttgggggatgggttcaggttgtcttagtcttgaatcataacctgagtcctccaagtctggataggagaaccctgaataagttattctgaaataataatgggttgtagttacttctcttgggggaaacatagtttgatcatgaaattctcaaaagtaattatgggtatgtcaagatagctgtgatgaaagatttagctaatctcagcttatttcaatagctatgacaactatgaaaagtgttaagtattaaaaacaagttttaagtgtatctgggtctacttgaaatacaggcatacttcactttattgtgctttgcagacattgtgttttttacaaattgaaggtttgtggcaacactgtgtctagcaaatctgtcggcaccatttttccaatagcatttattcctgtctatgtgtcacattttggtaattcccacaatatttgaaactgtttcattattattatatctgttatgatgatctatgatcagtgatctttgctgttactgttgtaactgttttggggtgccacaaactgcatccatataagacagctgttaaattaagtttagactaaagctgcctccttacatattttaagtttggccaaaaggtttctttgtacgccataaactatagcttaaatggaagtataaacagactctagtctactcttgtgccaatcaccaagttttggccaatcacatgtggccagttgttcaaaccgtgttcaaataaggtgaacactaagctataaccaaaccagctgtttctgtacctcacttccattttctctatgtcagtttcctttttctgtccataaatcttccaccgtgtggctacaccagagtctctgagcctcttctggctctggaggctgcccaatttgcaaattgttcattgcttaattaaatcttttaaatgtacttcggctgaagtttttattctaacacagcaaacttaataaatgttgtgcgtgttctgactgttctgctgactggctgttttcctgactccctctgcttgggcctccttattccatgagataaaatattgaaattaggccgattaatagccctacaaaggcctctaagtgttcaaatataaggaagaatcatacgtctctcactttaaattgaaagttggaaataattaagcttagtgagaaaggcatgttgaaagcagagataggccaaaagctaggctgcttgtgcccaatggttagctgagtcctgaaggaaattgaaagtgctattccagggaacacatgaatgataagaaagtaaaacagcctgattactgatgtggagagtgttctagtggtctagatagatgaaatcagctacagcattcctctaagccttatccagtgcaaggccctaaacatattctcttcaatactataaagactgagagaggtgaggaagctgcagaagaaaagtttgaagatagcagagattggttcttgaagtttaagggaagaagctgtctctataacaaaagtataaggcaaagaagaaagtgctgatggagaagctgcagcaagtgatcctgaagatctagctaagatcattgatgaaggtggctatactaaacagattttcagtgtagatgtaacagccttttactgagagaggatgccatctgaactctcctagctagagtgaaaaagttaatatctggcctcaaagcttcaaaggacaggctgactctcttgctagatgctgacgtagctagtgatttcaggttgaagccagtgattctttgccattctgaaactcttagggcccttaagaatatgctaactctactctggctatgctctatacacggaacagcaaagcctggatgacaacatatctgtttacaacattttaaacccaagctcagacctactgctcagtaaaaaaagatttttttcaaaatattattgctaatagacaatgcacctagtcaccaaaagctctgatagagatatacaaagagatgaatgttgttttcatgcctgctaacaccacatctgttctgccacccatggattgaagagtaattttaactttcaagtcttattatttaagaagtacattttgtaagatgatagctgccttatgaagtaggcagctatcattcctctgatggatctgggcaaagtaaattgaaaaccctctggaaaggatttgccattctatatgccattaagaatatttgtgaatcatgggtggaggtcaaaatatgaacattgacaggtgtttggaagttgattccaaccctcatggaagaccttgagaggttcaagatttcagtggagaaagtcactgcagatgtggtggaaatacgaagagaactagaagtggagcctgaacatgtgactaaattgctacaatctcatgataaaactttaaccaatgaggagctgcttcttatagaagagcaaagaaagtggtttcttgagatgaaatatactcctggtgaagatgagaacattgttgaaatgacaattagaaatttacataaaattagttgataaagcagcactgctgtttgagaggattgacttcaattttgaaggaaattctgtaagtaaaatgctatcaaacagcgttgtacgctacagataaatcagttgtgaaaagaagagtcaattgatgtggcaaacttcagttaagagattgcaatagccaccccaaccttcagcaatcaccaccctgatgagtcagcagctatcaacatcgaggcaagatcctccatcagcaaaatattacaactcgttgatggctcagatgattgttagcattttttagcaatgaagtattttaaaattaaggtatttatgttgttttcttaagacaatgccattgcacccttaatagactataatgtagtaggaacataacttttatatgcactggaaaaccaaaacatttgtctgacacttgccatactgtggtgatctggaactgaatctgcagtatctctgaggtatgcctgtatcttaatgataacatacaggctgtacacataatatgaaggatttacgattatatatctttgtatagattttttttgagacagagtcttgctttgtcactcaggttggagtgcagtggcaccatgacccctcagacttaagctgtcctctcatctcagcctcttaagtagctcggactacaggcatgtgccaccatgcctagctaatttgtatatgttttgtagaggttttgcagtgttgcccaggctggtctggaactcctgagttcaagtgattcgcctgcctcagcctcccagagtgttggggttacaggcatgagccactgtgcttggccttgtaattatatttttagttgaaaatgtaactaatatgtttacccttatctgtagtttaaacccaaataaaatcattttaaacaatgcatgtacatattttaatatgtgtttataacttgaagagtttggaactctttatgcagaatatgtattatttcatttttcaaaaaattactctctaatttactaatttccatgctgatatatgttcaagcattgcttcccagaatttaacatatgtattatattgatgaatgttctgttgtttgcttcctattatatcttttctttagtgcagccatttgatagattatgtgcttaagttaattatgtaaagttatttttgtaaagttaacacatttttgtttatatttttcaggagttggaaaaaaccttggatgtctttaatataactatagctagacagacggcagaagttgaggtaattcttggcttttcaattagtaaaaataattctgaattccatatagatatgacagatgtgatattattaatcttatactgtaacatattgtttccaaaaagtggttcaatttgctttttagtattataagaaaattatttaatattttttggcacatccatttaaatcagacagatttctatgggaaaaaatctttctaaatatttgggcttttcaaatattcagttatgaaggtaaaagccaatttattttttttcaatcatcatttcttataagatggtggaaaaactatgtggtactcctaaattcttatgttcgactaatgttgcagtttctgtgttctgttattaatgtgtatattgtttacattcattttgctcaagaggataagttctcagaatgtcttgcttatatttgtttcagttgctaaataaaggataatgtgtcatttatttgaaaatttattcattttaggtaaagaaagctggatacaaaatttacaaagaaggagtaaaagatccagaggataataaagggtggtttagctggctatggtcttggtcagaacaaaatactaatgaacagcaaccagatgttcaacctgaaagtatgtccatttcattttacagcatagttaatcactgggtgtcaaaataaagttttgccattttttgcctaattaaagtaaatagacattgaaatatatttatttaattatatataaagttattacaaataaaactattaaaacattgaaaatgtgtattagtttaaaaataaaaaataatttaaaaatcatgctagtgcttacaaaaagagctttatgcccagagatttagtgaatgcatatagcacagtaataaataaataaaaattccaaagtgttctccattgtaaatttttattgaagttgtttcttggaaagatttttgatttttaactaacagcttaagagtatagctttggaggtttagagacttaggtatatgttttagatctatcacttattagcagtgtgtctctggcaagttatttaagtgcactaaacttcagttttatcatctataacatgggaggaaattacaatgttaatactacctactttttatactaaatgtgttgattagcacagtgctattgtctaatatagttagccgtttttgagctcttgcttaatacaaatattataaattaatgttgctaaacttacatatttagcaatttatattttggataattacttgtaaaattgccagccccattcaaacattcagtgtttataatttcttaagagcgttcaagaaagtaaatttcacattctgtttattaaaggcagatacattgtgttaattttattgtttttatttaagaacataaagcacttctttctgatttgtagctcttgaagaaatgttgacacctgaagaaaaagctttactctatgaagcaattggctatagtgaaacagcagttgatccaactttactaaaaacagtaagatgttttcttgccttataccttagaatatatttatttatttatttgtttagagacagggtctcactctgttgcccaggctggactgcagtggtgtgatctctgctgccagccttaacctggcctcaagcaatcctcccacctcagcctctcgaatagctggagccacaggcatgcaccctcatgctagctaatttttgtggttttttttttgttttttttttttgatagagatggggtttcgccatgttgctcaggctggttttgaacttctgagctcaagcaatccgcctgcctcgacttcccaaagtgctgggattataggcatgaaccactgctcctgaccttatgctttggaatttaatgttacatatgtccatttttaatcctttcaaaaatatatgttactgacttgttctgtgatcttttttctgggtctgtaattgcatttattttaatttctaaggtagggataaatattgtctctttttttggggtcaatgtgatgattcttgaagaaataaaatgtccttaaaatatttggtggtttttgaaatgaatgtactataagaatatttgttatgcttatatatatatatatgttttcattttattcttctgaatataccttagtttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaagtaagtattaatttatctttttttatcatatatgaaaaaacttcactgtgttcttagacattaggtcacaatcttagtcttttgtaaagagcactatagtttcatatatccttttgtggtttcaggaaaaaggttttttttttaattgttaagataatacatgttcaatagaaaaccacattccagtgaaacatagggcattaaagaataatacaaaaatgatcagcaactacactacacaaaaagaaacagcattaacaatgtggtttttatctgagagtttttagttttattttttttaaagtagctttgagatgtaattcacataccctacaattcatttaaagtgtgtggttcattgatttttcacaactatattatatagtaatttcacattggtatatttacgaagctgtacaaccaccagcactgtattagtccattttcatgctgttaatgaagacttacccaagactgggaagaaaaagaggtttaattggaccaacagctccacatggctggggaggcctcagaattgtcaggggaggcgaaaggcacctcttccctggtggcagcaagagaaaatgaggaagatacaaaagcggaaacccctgctaaaaaccatcagatctcatgagacttattcactaccatgagaacagtatggggaagccacccccatgattcaaattatctcccaccaggtccctcccacaacacgtgggaattatgggagtacaattcaagatgagatttgggtcgggacacagagccaaaccttatcaactactatctaattctagaactttattttattttatttattttttttgagacagggtttcactctgttgcccaggctggagtatggtggtagggtcttggctcactgcagtctctgcttcctgggctcaggctaacctccagcttcagcctcctgagtagccgtgactacaggcgcgagccaccaacaccttgctaatttttagaatttttgtagagatggggtttcaccatgttgcccaggctggtctggagcttgttggctcaaagcagttcgccagcctcagcctcccgaagtgctggaattacaggtgtgagcctggctcattcgagaatatgttaacaactcccaaagaaaccctgtaatcattagcagtcactcccaagtgcccccttacccagcccctggcaacaactaatttactttctatttgaaaggatttgtccattttggacagttcatatgaatgtagtcatacaatatctggtcttttctgtttggcatttttcacttagcatgatgttttcaaggttcatcctgttgtagcatgaattagtacattcctttttattgcctagtaatctctattatggacgcatcacgttttgtttatccatttaactgttgaggatatttaggttgttccttctttttggctcttctgagtattgcagctatgagtattcatgagtaatattttgtttggaggtgggttttaattttcttgggtagacacctggggtggaattgctgtctcatatgctaatactatttaaccttttgaggaactaccagactgtttcccaaagcagcctcaccattttacatttccatgaacagtatatgatgtttccaatttcttcatatcttcatcaacacttgttattatctgttcttttgattacagccattctagtgagtatgaaatggtatctcactgtggttttgatttgcattttcctgatggctaaggattttgagctttttttctttgtgcttattggccatttcacgtgcatatcttctttggagaaatgtctattagattttttttcctattttatgttgggttgtctttttattatcgatttgcaagagttctttatatattcttgatacaaatctcttattagataaacaattttcagttattttctctcactgtgttttctttttatttttcttaatggtgaagtcaaatttatattttttttgctacacatgcttttcattataactcagaaatctttgcctactccagtggtacaaatatatactcctatatattcttataagaattttatgctatttcctcttatatgtagggttagaatccattttgagttaatgttagtgtgtggtgtgaggtgggggattcagcttcattctttttcatgagattattcagttgtcctagcaccatttgttgaaaaaactattttttcccattgaatgatcttggcaggcttgtcaaaatttataagttgatcataaatgtaaggatttctagactcttaattctaatcccattgttctatatgtctagccttatgccagtaccctactgtcttaattatggtggctttatagtagaacttgtaatcaggaagtatgactcttccagttttgtttttttgttttagctgtcctgatttccttaaacttctgtataaattttaagattatgttgtccatttatgcaaaaaaataagctcagatttgataaagattgtgttgaattttgtggatcaattttgggtgtactgaacaaattattcagcacaaattattcagctacttatctaaacaatattaagtcttccaatccatgcacattggatatcttttcatttatttagatttttaaaatttgaacaacgttttacagttttcagatacagtacacctcttaggttaaatttatttgcaagtattttattgtttttgatgatataaatggaattgttttcttaatttcattttggattattatgtgtatagaaatacaattgagttttgtatactgcacttgtaccctgcaaccttgatgaacttgtttcattagttcaatgagtttttttagttgattccttaggattttttatatacatgatcatataatctgcaaatatagttttacttcttccattccgatgtggatgccctttcttttgttttcttgcctaattgccccggctagaacctccagtagtattttaaatagagattatgagagtgggcttctcttcttgtttctgttcttcgaaggaagtgttcatcctttcaccattatgatgttagatgtgagttaggtgtggtctgcatcattttacaatcccaccagcaatgtacgtggattcatattttttccatatcattcccaacacttgttattttgtttttttattttaaattatagccatccttatgggtgtttagtatcatattgtggttttgatttgaattcccttaatgactaatgatgttcagcatcttttcatgtggatattggccctttgtataagttcattgggtcttttttttaattgagttatttttcatttgttgttgaggtgtaagaattcttttgtattctggatactaaactgtcaccggtacatgatttgcaaatatttccttctattctttattttgtgatttcacttcattgatactgtcctttggtgtacggaagtttttaattttgaagctcacttcatccggtcttatattttgttgttcatgcttttgatgtcttatctcagaaggttcacctaagccaaggttgtgaacgtctactccagtattttcttctaagagttttatacttctgtcgcttacatatacgtttatgacctgtattgagttaatttttgtaaatggcataaggaattggtacagctcatttcatttgcatgtggatatcccggtgtcccctcacacttgttgaagacactattctttcctcaatgaacactcctggtaccattgttgaaaatcaattagccatagatgtatgtatggctttatttttggactctcaattctatctcatttttattctagactttcactgtgattatcattataccaatatcgtactgttttgattactgcagatttttagtaagttttgaaattgggaagtgtcttccctattttgttctgctctttcaagaatgttttagctgttcaagggttgcttacaagaccttatgaatttgaggattcacttttccatttctggaaagtgtctctttgaaatttgatagggattgcattcagtatgtagattgcttttggtagtattgccataataacaatattaagtcttctgtgaacatgggatatctttccatttaaataaatgctaaatagatgctttttctgtttttatgaagagtttcagaaggattgttattaatccttctttaaatattttgtagaattcactagtgaagccatttggtccttgtattagtctgttcttatgctcctaataaagagatacctgagactgggtaatttataaaggagagaggtttaattgactcatagttcggtatggctggggtggcctcacaatcatggcagaaagcaaatgaggagcaaagtcatatcttatatggaggcaggcaagagagagcttgtgcaggggagctccctttataaaaccatcagacctcatgagacttattcactatcatgagaacagcactggaaaaacctaccctcttgatccagttacctcccatcaggtctctcccacgacatgggggaattatgggagctacaattcaagatgagatttgggtggggacacagccaaaccatatcagctgaattcttctttgttgagagtttttggttactgatttactccttactagttataggttttactataagtaagtttaaaaggttatagtaagttttactatactaaagtttatagtaaagttttactgatagtttataggtttataagtaggatctgtaggttacagtaaagtttactataggtttttaaggttatagaaaagttttacttcctattagttatctgattttctatttcttctcgaggcagtttttgtaatttatatatttctaggaatttgttcatttatctattttgttggtactgttttttgcagtactcttttgtagtactttttattcctctatggtgtgtcataatgcctccactttgatttctagttatagatatttgcatctttagtgttttttttcttattttaggtaaaggtttgttaaatatgttaaccttttcaaagtggcaactttgattttttttcattctctctggtgtttttgttttctgtatttcatttgtctccactctgacatgtattattttattcatactgtgagctttgggtttaatttgctcttctctttttagttctttaaagtgtaaagtgaggttattgatttgataatctttcttttttaatgtaggcatttgcaaacaaaaatttccctgtgagaactgctttggatacatcctgtatgttttgtaatattgtgtttgattcgcatccatttcaacgtattttctgatttctcttgtggttttttttttaacctgttgcttgtttaagagtgtttaatttccacataattgtgaatttttcagtttttcttctattgagttctaatttgattccattgtggttggagaagatgcttggtgtattattaaacttgttgagatttgctttgtgacctaacatttggtctatcctggagaatgttccatgtgcttgcacttgagaagaatgtattttgctgttgttgggtagagtagtccatatttgtctgttacatgtagttggtttataatgttgtttaggttctctgttactttattgttcctctgcctaaatattcctcatttaatggaagtgggagattgaaatttctaagtgttattgtgagctatttctccctttaattctgtcaaggtgtgattcatatattttgaggactttggtgtataaatgtttataattgttgtatctttgatgaattgagccttttaatcaaactataatgaccttttcttcttgtcacagttttctattgaaagatatttaagttaattaattaattattaatttagatacagggtcttgctttgccacccaggcttgagtgcagtggtgtagttatagcctcactgcagccttgaactcctgggctcaagtgatcttcccaccacagcctcctgagtagctggaattaaaggtgtgagccaccatacctggctaaagattattttatatgttagtataaccacccagctctctcttggttatgagttgcatgcagtatattttttcatcctttcactttcaacccatatgtgtctttggatgtaaaatgagtctcttttaggcagtatgcctatggtccctgacttaggctaagtatattaaatacatttttgacttggaatattttcgatgggtttattgggaaataattagtcataagttgaggagcatctgtattgttgtatcatgtttttttcatccattctgccagtctctatctttcctttgatgagtttaatttcatttacatttaacatgtttactggtaggcaagaagttctgccattttgctatttgtttattgtatgtcttataccttctgtaccctcagttcctcagtactgtcttcttagtgtttgttaattttttgggggatatatttttatttcttcctcatttctttttccaaacatattttagtcattttgttgagggctactatatagggattacaattaacagtccaaatttaagacagtcaaatttgaattgacactaacttaactttaatagtgtataaaaactctactcttatgcagctccattcttcatctttacgttatcattttcacaaattactgctttacatacttgtgttcattagtctaggtttatatttgtttttatgtgtttgtctttaaatcatagaggaattaaaaagaggagttaaaaaccaaaaatgcaatattactggctttcttatttgcttatgtagttacaattacaacagttctttatttatttgtatggctgcaaattactatctaatatcctgtcattgcagtctttaggacttcctttaacctttcttgtagggcaggtctactaatgacagacagactcagtttttgttcatctggaaatgtgttcatttttccttcattttagaaggatagttttgtcatatatagatttcttggttgacattttttttcatttagtgctttaagtacatgatcttgctgccttttggactgcatggtttctgaggagaaattagctgttaatctattacatatcttgttatgtgatgagttgcttctctcttgctgctttcaagattttccttgttttagcttttgacagttggattataatatgttgctgtgtgagtctctgagtttatcctaattggaggtctttgagcttcttggatgtataaatttgtgttctttatcaaatttgagaagtttttggccattatttctcccagtatttttaatgtctttttctttttctcatgtccttcggagagtcccgtagtgcatatgttgttccacttgatggtctcccactttaggcactgttcattgttcttcattattctttatgctccacagactcaataatttcagttgtcctgtattcaagtttgatgattctttctttgggctgcttagatcctctgtgaaacctctctgcagatggttcccaaatcatgattgttcagcttatgatttttttgattttagaatggtgcgaaagtgatccatatttagtagaaatcttactttgagtatccatacaacctttgtttttcacttttcagtacagtactgaataaattacataagctatttaacattttattgtaaaataggccttgtgttagatgatttttcccaacgtagactaatataactattctgagtacatttagggtaggctaggctaggctatgatgcttggtaggctaggtgtgtcaaatgcattttaaacttatgacatattcaacttacaatgattttattgggacataaccccattataagtcaaggaacatctgtagtgaagttttcatattggctgttgtacttttcaccttcaaaatttctgtttggttctttttaataatttctgtcgatttatattctgtgctcaaatgttattttcctggttttctttagtctttgagtgtaagcttatttaacatgatggcttagtgaacataatgctagtcttcccttttctgtgtaagctttgtacatttttgtttaaaacttgatgttttgagtggtataatgtggtaactgtggaaattagatgtcccccctctccatggttagttgttgttgattgttgaaggatgtagttttccatttgtttacctactgtagtgggtagaattgtatcatccaaaacattgtcaatttctaattcccagtacctgcaaatatagccttatttggaaatagcctttgcagatgtaatcaagttaaaatgagttcatgctgtattagtgtttgctctaattgaatgatgtgtgctcttcaaaggaaagagaaatttgaacacagactcagaaaataagacagactagagaagacaatttgcagacagacataaagaggagaatgccatgtgacgatatcttcttagctgcgcccatattaatgtagattttctgtaacgtggtgtggggattagaggtgggaaatgatcatagctcagatgccacaggctctccctgttcttatcaagttttagtagatttttttgtttgttttgagatggaatgccactctgtcgccaggctggagtgcagtggcacaatctcagctcactccacctcctgagttccagagattctcctgcctcaggctcccgagtagctgggattacaggcatgtaccaccacacccagctaatttttgtatttttagtaaagacagagtttcaccatgttggccaggatggtctcgatctcttgacctcgtgatccgcctgcctcagcctcccaaagtgctgggattacaggcgtgagccaccgagcccagcctagatttttttgaataaaagtttttctgtttgctgtatgcccttagattgatttccagagattttataattttcaccagttctttccctgtttggtttgctggggagaagagttgctgagctcctcacatagtcattctcgaagtcctgcctcatccttggtttttaaatgtttattaaattgttttatttttttgagacagagtctcactctgtcacccaagctggagggcagtggcatgatctcggctcactgcaacctccacctccctggttcaagcgattttcctgcctcagcctcccgagtagctgggactacaggctcatgcccccacacctggctaacttttgtatttttagttgagacagggtttcaccacgttggccagtttggtctcgaactcttgacctcaagttatccacctgtcttgacctcccaaaatgctgggattacgggtgtgagccacatgtctggcctttaaatgtttatttttatttttagaagaaaacatgtttatagacttgtgttaaatatgcaaaacttttcagttttacattaagcattgtagatttactgtcattttaattttagcttatcataacttttttacatataagtcaacacaaataggattctttgtgaattaatctatgtcaatttagaggaatcattgtatgtcttctttgatgggaatggactggagtcagaaatgcaaagtgaagttgtcttcattaattttttaaatcattttcaatttttaaaatccttcacaattttactgatcgctgacttttttcttttttttttaatgcagatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcagtaagcatttttttaaattactaagttttaatataatttagtttgctttgagtttgtgttaatgatgtttattttaacagaggacagtgaatagtatagtggaattcttcagacctccaaaagaggtacatctagcacagctcactgcagcaactttgacaaaactggaagaatttcgcagtaagacagcaacaggtaaatgccaatattaatgttggtgaattaaatactgtatcctatattaaacttttatttatggtagaatgtttttagtaaagtttattttaaatttattatatttctagactggttttagtttaacagaaactaatttagtacttttatgtttaaaggcagataaaaccataatcattttttacactcagaaagttcatacctagtaaccacatttaagttagttgcaaaattttgcttaggatacttggacctctatttatgacaaaaactggcctctcgttttcctttcttagaatgcgttccagattttgatatatcagcctcagggaaaaaagttctatccttttttattctctaggagagtttgaataaggtcgggtacgatttcttccttaaatatttggcagagcttaatggtaaaaccacttggttttggagatttctttgtgggaaagtttaagattacagattgaactttttaattaaatagttgaccatagagattatctgtatgattttaatgctttgtaattggttgggacttgttttctagctcaatgtatgatattaaaaaaaatgttcctcatatgctgaaaaggctgtcttttcatatctatacctattcattaggtatggattgttaatcctttacttcaaattttttgtatccttactggattttttttttccccttttgtcaccttgttctaacagttattaagagaaatacatgaaaaatgcctcattatcaatgtagatttttctatttctaatagatctgtcagtttgtttaaaaaaataaatttggctgggcgcggtggctcacacctttgatcccagcactttgggaagccgaggcgggtggatcacctgaggtcagagtttgagaccagcctggccaacatggcaaaatcataatagagacggggttttaatagagaccaggtttcaccagcctggcgacagagcaacaccctgccacacacaccaaaagtaataataataaaaattaaaaaaaaaataaattttaagactgtcattaagtacatgcaggagtaaattatttttcctcctataaaccacatctttaatgctttaatttttttccctttgtacttttttattttattttatttttgatctgatgtcagtatgaagtacaaagtttcttttcgttagaatttacctggtatatattttttcttatatttttactttttccctgtgttttcagatgtgtcatgtcaacaacatgtaataggattttttccaatctagatttatggtccttattttttatttatatctactttttgcatttaattaatttatttaggcttatgtctaacatcctattttgtgcttttgaatttggttttccttgttttatttttcttgccttcctttggataaattctaggatacctttcttcccccttccctacaatctactattgggaagttaaatattctctatctctttttattttataaattacagtatacatttttgtaaaaatataaatttaatgaaaaattttatattctcctagtcattatatggactttagtactcttgaactttatataccatccccatatactattttttttacttaaaaatactttattgtactgtatgtatatagttcatggtagtttacaattacttgtgcatttactaccttctttgctcttcatttctcttatagcttacactttttatttgattttattttctttctgttggaagttcattttttttttttttcaacctctgcctcctgggttcaagcgattctcctgcctcagcctcccgagtagctgggattacaggcacccaccacaacgcctggctaatttttaaaaaaatttttaatagagatggggtttcactgtgttggccaggctggtctcaaactcctgacctcagatgatctatcctcctcgacctcccaaagtgctgggattacaggtgtgagccatcggacctggcctggaagttcatttgtaaacttcccttgtaaatattttctcttgtaagaatctgctggtggcaaatctgtggtttgtttttgttatgtttttgttttttttttttttttttgacagtgtcttgttctgtcagccaggctgggggtgcggtggcataatctcggctcgctgcaacctctgcctcccaggttcaagcaatttttttgcctcagccttctgagtagcttggattacaggggtatgccaccacacccagctaatttttgtatttttactagagatggggtttcaccatgttggccaggctggtctcgaacttctgtcctcaggtgatccatctcagcctcccaaagtgctgggattacaggcatgagccaccatgcccgttgcatattagcttgacatgatactactgtatgtagaattaaaggttgatgttcattttctccttaacacattgaagagggcattctgtctttaggttttcattactgatgttgagaattcaggtgtcagtgtgtctgctgtttttttttgtacattatctacccttttcttttacatataagaactttttatcttttgtattctgttgtcgcaatttggtgtatccagctatagatttgctttatatatcctttttgggattcactggatttcatgaatctgagtactgggatttttaatgagttctagaaaatctatctggaaaattcttagccactaactctttacatatattctcttctggaattctggctaaatgaattttagcctttcttactccatcttccattctccttaacttctgtatcctgctttctttccatctgtttcttctctgtgttacatgctgggtaatttcttctaatttatcttctcatttactgagtccttctgtagccatgcccaatgtggtatcaaatctcttcattaagtttaatttcagtgattatatttttccctttaggaattctgttttgttaaatttaaaatctgtgttgtcattcttttttggttttgtatttcccacggatatctttacacttgtcttttttttttttttcagagatcataagtacagtattttatattctgtctcaccagttaattctctctcttcagatagtccgttatatgaagacttttgtggttctgtttttcctatcttctgtcttttgtttttgttggtacttacttatggtaacgtgtgtctttttatgcttggtaatttttaattgtaatctgctcattttccttagaatattatttgggagaattctctgaagcctgagataagtgggccttcatttcgggaagatttatatttcttctgccaggtaccttgggtatgttggtggcatagctaaattaattgcttaagatgttctggactgccaaagaattcttgggctacatacctccttgaggaatatatcatacttatcattcacagaggtattacctttttctcctaatttttctcacagcctttgtttgcatccccctgtgagagtgttttagggagaggaaggttttacttcacaattattctttctttgagtgagtgtcctttaagatttcagatttgtgaggagaactcttgcaagactctccatctttgtcttctgtttcctgtgttctgagaggctgaaattatctttggagtaagatccaatttcattgtcaaagttttaaaattctggttttgttaagcctgggagtacacttctaattgaactcagaatttgtcccattttggtggctataaaacctggcatgaaattatgatttttctcttgccatttttattatattcactttatccttattggtagatatgagatatactatctgtcattttcctttgttctctttcctaagataaaataatttagatgagtcaagaaatcacattttgataagaccttcaggaaatgtctaactagttgtcttttgttaggcaatattataataggcatcttgattcattattaatttttcttttttcacagaaaagtgtgtgttatattcttcaaaatatatgtgtcttctctggcttttgctcatttttctctactatttttatatctgaatagttttaaattagattgtacatgaataccttacctctagaaactgtagggtttgcatttattcctgtattctttgttaaaatctgggaattccattcctagtttacattctgtatattggtatattatatactgagtagaaaccaaagcataagatcaggctacttctagtcagtttttcttgattgatagaaactcatagttaaatacaaattaatcatattggaaatccactatagacattcagattttgagattttttatctctaagatttatttacctcaacttttattacttaaaaaaattaccaaacagtaaatatccacaatataaagttcacatgttacagaaatatgttttagaaagtggaagtcttcagtattttaccttctgtacataataacctttaaaatttgaagtctgttcttccaactttgttttcttttctataccaatagtataaaaatgctaattctatgaaaaaaaatggaaagcttctatgataggtttttgcacttaatttttaaaatttaatatattttggattttttctagaaagttaaaatttacctatttgtgaagagactcatatatattataatgattctggttacttaggttctttccttccctcatattcctcctttcttccttttattttgttacattctcctctattaacatcctggtttctttcttgtattataggttgagtatcccttagcagaaatgtttgggatcagaaatgtttcagatttcagatttcttcggatattggaatatttgcattttacttacttgttgaacatccttaattgggaaataggaaattcagagtattctaagcagcattttctgtgaatatgatctttgaggatcatgttattgtggtgctgaaaaagttttagatcctggagcgttttgattttggattttcagattagggatgctcagcttgttattttccccttcctttctaagaactcaaggtctttcaggtctttttgttgtcaactatggcatgagcttacagagcctgctcaactagttatcctttgtctctggcaggaaaacagatgtggtcgtttgctaaaactcttctttcagagtacaaggttctctgataggatcatagtgaatcattttctttcagttatttcatttatttactcatttaaatatatatcaagagcctaatctatatgtcagacactatgctaggttttagggaacatagcaatgatcagaatggatgtagttcttgcctattgatagatgttatactcttatggataggacaaatataaaactaagagcaatatactggaaatttttgattaatgctgtatgggtccaatcaggaaagaaaaaccacacagtaattttgataggtatgtttaatgtaatgaattattaactgtaatgagggactgttttgttactccaaagagtaactttaaagaatgtaacaagaggccaagcgccatggctcatagttgtaatcccagaggttttggtggccgagcggggaggaacacttgaggtcaggagttggagaccagcctggacaacatagtgagaccttgtctctacaaaaaattacaaaattagtcaggtttggtgacgtgtacctatcgtcccagctacttggcaggctgagactggaggattgcttgagcccgggaggtcagggctgcagtgagctatgatagcaactcctacattccagcctaagtgacagagtgagatgctgtctccaaaaatacatatatttaagaagagtagttatgaggaatatagaactgagacagcgttccctaggaagaggtctctctcttccctgagaattgaaatccacactttgttgggagaaggaacctctgtgagtcattgaatggtagaaaagccattcttgtgtctttctggtaatctgctctctaaaactttctggaaatccatcctctgaggtaaaaaggaaaaatattcatggggcaatgtctcactgccctcgttctgctgtgaaaccacctgaggagggttctaggggcagaatactggcttttgagtgctgttatgtgcacattatgcattgtgttggagaaaggcacagtgttacaggatattgctaaatgagtgtactggaaccaggaagccagctcttttctcctgcagtgtctctcctgtgttctttatctatttcagtgctagttggcaaaggaaaatcatttaagcaactcagatctactttcacagagcagacaagtgggtgaatttggagctgagtgaggaaacaattctataatcagcccaaatgctgtgaaagaaatgagaatggatagatgccccaatttagtcttggtggtagtgtcagagaagatctctgaaaattcaacattaagatcagatatatatgtaggatccacactgctaaagggtataagaaagagccttcaaggtgatggtccactgtgaagagcttaacttagcaaacaattgggtgaatttggaagttgtagaaagctgaattggttctaatgtaatgagtgaggggagagtggagggatgttaaagatgcatactcttgattatgcaaatatgaaagtcatattaagcagttaggattttgttgtaagtgcaatggaaaataggggagagacccaatcaacctaaggtcaaaataaaatactccccactcccttccattaaaaacaacttagagaaatcattgtgtcctggtatcaagaaaggctttgttgaaactaaggcttgtggtaggacttccagggagtaccagaacttagatttgtagaagccagaatacttgaggaatccttagactagagatggaaatgaagatagagaaatgcttaacagatagtctctggagaatcttgaatgtcagattgacccttctggatgcttcttgttactttagtaaaatcatgccatctgtgtttgaatccaaatcatttggggaaaaagaatgaataactgtttgagtcaattctgctcttaagtttcaggctaattggatggtcttcagaatttttgatgatctgtcagtctgttttcaaacctctatctcacctcaccttccatcctcattttaagagatttcacttgaatttgcttcttacaggctatgggaaatgccagggttttttcttcctctctctactagagtcttgcttgggctacctgtgcaaggccgttggaatcccttaaagatgacacagttttgataacagtttctcatatttcaaggaagagctgtcccagatgtaatttattagtgttatttttataaagactactggaggcagcgtaatttgtgaagaaaagaggtttatttgtttcatggttctacaggctgtacaagaagcatgactccagcatctgcttttggtgagggtttcagaatgcttccactcatggcagaaagagttggggagcccacatgtgcagagattacatggcaagagaaaggaaggaggtgccaggctcttttaaacaacaagctctaactaaaagagcgagaactcactcattaccatgaggacaacatcaagccatttgtgaggactctgcccccatgacccagacaggtcttattagggtcccacctccagcattaaaaatcaggtgtcagcatgagttttggagggctaaaatcccaaactgtagcacaggcttaggttatttattttctattttaatttaaatagatatttaaaacagaaggtattttaattacttttaatttattcattttctttctgttggcttgtatatcaagctgattatgtgttggcacttgacacttgctcaatgtctgcttttaagctttataattgtatatgtattttatttgtaattttaagtacattaaaattgttgacatattctttaatttgaacatgtattctttaataataaattcttaactttaaaggttatattcaaatatactgacctgcctacattttgtgtgtgtgtgtgtgtgtgaaaaaatgtgcctttttgtttgagtgtcagatctttttaaactttttaagtcaaatatctttcatttactctaactgatttgatggctgctcatataattttttctttaagaaagggttcacatctcatagaaaataatttgtttagatttaaaagctgatgctgatactggacttagggacataaaatagatgaatttggtatactaatcacatgcaagtgaatgaattaaatttattagactaaaaaactccaagtgaatgaaggacctagggaatggaaaactctggtttgttgccttttctggtttgcatatgattttattgaagatgatttgataatccaggattttttatattctcagaataatattaagatcaagtgttattgttcagtatggtaaatgtagcttatgaagtttatgaattgagaagtatctatgtagattctaagagttgttgtgagtaaatattttatgccactgaaactttttttttggtctgtatcttcccaattttacccaaattgagtttataggttaaaaattttttttggaagaatcactccaattttgtactcagctatatttaaataggagtacatgcattggcaggtattttaaattttatattggaagtattttgctgaggtcattttaaaattaatactaattttacattaagattgttttatcagttcatatatttagtgattctgtatttctcgagtaatttgtgaaaagtattcatagaaaagatttacatttttccaggtctactgtatattattgaaacacagaaagttcttgatctcaaaattaatttgaaggcttcatatattattgtcccacaagatggaatttttagtcctacatcaaatctgcttcttttggaccttggtcatctaaaggtatatactaataatatttgatttatgatacagcatttggggtgtttctttgttttaaatgtattttgttttttaaacagtttgatttattgctttttttcctagatttgtggtagataagtaagatttgagaaatctccctttctgttaaataaagtgaagtctcaattaggtagttttcctacacttatgaaagcaaaatgaccaattaaactctgcagggcaggtttgaatctaagcttgattgactgattgattgattgattgattgactgattgatttgagacagagtctcactctgtcgcccaggctggaatacagtactgcgaccttggctcactgcaacctctgcctcctaggttcaagtgattctcaggcctcagcctcctgagtatctgggattacatgtgcccgccaccacgcccacctaatttttgtatttttagtagagacggaatttcactatgttgcagactggtctcgaatgcctgtactgaagtgatccacttgcattggcttccctaagtgctgggattactggcgtgagccaccgcgcctggcccgaatctaagatttatatttgtagtatttgagagttgtgcttgagaagcttatttctttctcaatttagacctattacttgattacttaaagtatatagaatgatagagaattgtggaaacaatcaaatacgtcttcatctttctgaaattttttgtgcataaaactatatatatattgacattttaatatttgtatttaataattctaaattgagaaatggccttcttctgtttacctaagtcatttccctttttttctttcttttttttttttgagacagagtctggctctgtggcccaggctggagtgcagtggcacgatctcggctcactgcaagctccgcctcctgggttcatgccattctcctgccccagcctcccgagtagctgggactccaggcccccgccaccacgcccggctaattttttttgtgatttttagtagagactgggtttcaccatgttagccaggatggtctcgatctcctgacctagtgatctgcccacctcggcctcccaaagtgctgggattacaggcgtgagccaccatgcctgaccctttttttctaattatatacttttttctttccaaattttcagtagagaatacatttttttggcggtattctagatctgtgctcttcactatagtacccacttcccagccacatggggttatttaaattaattagaattaaaattaattcagtttcttagtcatattagccacatttaagagtttaatagtcagaagtggctagtggctactgtattttttgtttttgtttttgagacatagtctcactctattgtccaggctggagtgcggtggcgtgatttcagctcactgcaacctctgcctcccgagttcaagtgattcttctgcctcagcctcccaagtagctgggatttcaggcgtgtgccatcaagcccagacagtttttgtatttttagtagagatggggtttcaccatgctggtcaggctggtcttgagcccctgacctcaagttatctgctggcattgacctcccaaagtgttgggattacaggtgtgagccaccgcgcctggcctgtatttgacagcattgatatagaacatttccattattgtagaagttctactggacagcgttgctgtaaatcattaaatgtagaggaatatctatcacaatttaaagaaccaagagaggtggataatattagaatgctttttctggccacttaacaaaaatacgtgcctgtccttgatactgacatcttcccttatcctatttttaaaaattctgcatttgttaattgtgtaaacgcccactgggtatatatttataataaaatttatacagcttattattcatatttgaattttattcagttgtttcaagggcagtgtggtataatagagcataaggttaggagtaaggatatctaattttgtgactttaggcaatttgcttaacctgttacctaaaatttattacttttcaaacagagataatctttttttgagtgtttacttcacatgagctatatagagggaaaaaaagttaaaaaatgtatgtgtacacacatgtatttttatgagtaagatctttatgtactattgtggagtcatctccaggatgtttaagtgaaaaaagtaatgcgcacagtatgccaataaaggagagatacaaatataacttgcctggagttgcataaatggcagagttggaactaaaattcagctatcctatttaattctggactcttttacttcttattgtacagccatgtcagtatttgtcatcatgccatagaaacattttataagctaaatttgtctcttgatcttgctcttaatcagaaggcctcttatcacatttaaaaaatttgtagacatattattcttcaggaccatcttggtttcttttaatgcaagtaaatgggaaatatatcctaatatgtaaaaatttactttatcgctctccttattattatatatctcatcgatgaggacctttctaatagccttattatgtatgcttacttgtgaatttatcctctcctattaacattttataagtctaaaaattaaacactttatacttacattttgaagtattttgcatagtctaaactattaaaattaacttgaaggtgacgagtaaaagtcgttctgaattaccagatgtgaaacaaggtgaggccaatcttaaagagataatggatagagcttatgattcatttgatattcaacttacaagtgtacagctgctttacagtagagttggtgagtataaaatgcattatttgttgattgattttgttgaagtgattaattaggtttttagacactttgaagaccttcctcttaaatgtgttagaacgtctatatttttgaattagaaatgatagtaaatattgtctagctgttcttaccaggagcagtcttgcccccccaagagacatttgtcaatatctggagacatctttggttgtcacaggtagagcatgagtggcactcctagcatctagtgggtaaaggtgagggatactactaagcatcctacgatgttcaggccagtccctcataataaatatcagtagtgctgaggtcgagaaatcctgatctgtaccaatgttttccagcctttgaccaaagttggcccatattgaaaatgatattggtattactacacagttggataaccagaagacattgctcagggccagaagtaagcagcctaggggctctgacagtcatggacagccatacaaagacgagggtcactctcctagacatacttgtatctcattcactgtggtataccagtcaggagtctgatttagagctagttttgaagatgaagtcaaagccagaaattcacttgccaagagccatttaagtagttagggagagaccccagactcgttcagctttcttttcgttctgtcatactgcttttgaatccctagagtgttagtgaacatgcagataattcagtaaaatttgatctgttgaagagatccatatgtagagatctaagtgtttgtatgcagtcagattttaattacctgagctaaccaataaaaggagaaacaatgagaatccaaagtagttgttatcaaaattgttaatttgtataggactgaaacattttatttcttcaattatatttgcttcaggatagtgaatgtagtttgtatttttatcatattctaattgtggtggaggaaacccaaaggtatagtgggtggcagaagtacgttattttcagaattccacaaattctttttcagggaataaattactgggtttggttttccttgactgggattttatctgactcatagaattattatgttcaaatgagatagtatatatgaaaatgcattatatgactgagatcccattaatcttgttatgaatttttaaagttatttctttctgattatacctatttcagaaaatctgaacaactgagaaaccaaaaagataaacctttatgttactgcttaggcaggaacactattgatattttgttgcacatccttttagtatgtttttcagtgtgtgtacctgtgaatatatgggatgtgcttgtttggtgtttatattggaggtatttgtgaatgtattttttttacatgatttatatagttttatatccaggtattttttcttttaccagtaatattttggtcacttgaactcatggtttttattgtctatattatgctatatggctatggtctcagttatttaaccattcccttatggaacatttaggctcgtaactctgcagtgattgttgccaatcaacaacatccaagtagacttggatgtgaatttcagttttatcactagcagattgatcataggcaaattataaattcttttgagtctcagttttctaaagtgggattattatacagaattttgagaattaacatttaaacattacctagaagagtagaaattataaatcttgaataaatggtagcttttattagttactgttaaagaacctcactttttactaccttttgcattattgctttactgccatgttacttttttgggtaaggtatgtggttggtgtagtgattgtcagtggatgcgcagtagatttgataacctactgattgtatgtacctgagaatgtgacattaagattacctagatgtggggaaatttcctcatataatggaatgtgtgactatgaagtattaatagttattttaggttttgtgtgttatagttacgttaaatatgaactattttctgtacttaggtgataattggagagaagcacgaaaactcagtgtatctacccagcatattttggtacccatgcacttcaatttggaactgtctaaggccatggttttcatggatgtaaggatgcccaagtatgtactgtttgtttcatgtgaatatggattttctgggtaattctgtagctagggaaataccatacttaactgactcttccttgtgtgtgtggtgaaatgtatataactgactcttccttgtgtgtgtggtaaaatgtatataaaatttaccattttgataatttttaagagtatagttcattgtcattaggttcacgcatgttgttatgcaaccatcaccaccattcatttccagaactgtttctcttccaaactgaaactctgtactcaattaaacaataacaccccatttcaccctgcacccagcccctgacaacaaccattatatcttctgtctttatgaatttgactattttaggtgcctcatataagtggaatcatagaaaatcagattttgtgtgcctgggtttcttcacttagcataatgtcttcaagattcatccatgttggagcatatgtcagaatttcatgtatttttaaggctgattaatattccttatatgttgtatatactatgtttttatttattcatccttcaatgaacatttgtgttgttaatgctgtttggctgttgtaataatgctgctgtgtacaaatatctgcttaagtccctgatttcagtatttttgggtgtatactcagaagtagaattgctggatcatattatagttcagtgtttaagttttagaggagtgctgtgctgttttttatagcagttacaccattttactttcctaccagcacaagagtttcaatttcttcactgcctctacaacacttggtattttctgtttttttattttaatagtcatcctaataggtgtgaagtgatgtcatttttctaatgcttagtgatgttgaacatctgttcttgtgtttgttgaccattcatgtatttatttggagaaatacatattcaagatctttgcccatcttttaatctggttatttatttttttctgtttttcgagatggagtctccctctgtcacccaggctggagtgcagtggcatgatcttggctcactgctacctccacctcctgggttcaagtgattctcctgcctcagcctcctgagtagctgggactacaagcgcatgccaccacgcccagctaattttttgggtttttggtagggatgggatttcaccgtgttagccagggtgggcttgatctcctgaccttgtgatccacccgcctcagcctcccaaagtgctgggattacaggcatgagctgccgcacccggctgagttgtgagagttttaaaatatattttggatattaactctttatcagatatatgatttgcaaatattttttctcactctgtgtttccttatcactctgttgattgtggcctttgatgtctaaaagtttaaaatttttattgtccagtttatcttagttgcctatgcttttggtgtcatatccaagaaattattacaaaatccaatgtcataaagcttttcttctttgtttaccttaaagagttttatagttttagcttcttttatttagatctttgatccattgagttaatttttgtatgtgacatataggataaggaccggcctttattcttttttttttttttttttttttttttgagacagagtctcgctgtcgcccaggctggagtgcagtggcatgatctcggctcactgcaggctccgccccccagggttcacaccattctcctgcctcagcctcccgagtagctgggactacaggcgcccgccaccacgcctggctaattttttgtatttttagtagagatggggtttcaccgtgccagccaggatggtcttgatctcctgacctcgtgatccgcccgcctcggcctcccaaagtgctgggattacaggcgtgagccactgctcccggccttattcttttgcatgcaaatatctcatttcctctatacaatttgttgaaaagactgtccttttctcattgaatggccttggtaccctagttgaaaatcatttatccatatatgcaagagcttatttttgggctttctgttttattccattggtctctatgtctttattttcctgtaccacactatttagattactgtagctttataggaagttttgaaatcaggagatgtgagttatttaactttgttctttcgattgtcttggctattcgggatcctttggtattccatatgaatcttagcatgttttcttttcttgtaaaaaatgttatagagattctaacaaagagtgtatcaaatctgtagatccctttgaatagtattgacatcttaataatattgactgttatagtccatgaacatggaatatctttctatttatttgtgtctttgatttcagcaacattttctaggtctcagtactaaagtctcttgcctcatttcttaagtttattctttgtgatgctattgtaaatgaatttaaaaattttggggggattgtttattgttagtatgtgggaacttaactgatttttatatcctgcaacttgtgaatttgtttacaattctaagttttaggattctaaagttctaacagatttaagattttccacatataagatcctatcatctgtgtatggagttaatttttttccctttctgatatgggtgccttttatttctctttcttgcctaattggtctgtctagaattttttagcactctcttgaatagaagtagtttaggttggcatcctcaccttaatcctgagcccagaggaaaagctttcagtatttcaccattgagtatgatgtcagctgtggggtttttatggatgacctttattatgttgaggtagtttccttctgttcctagtttgctaactttttattatgaaaacgtgttgaattttttcaaatcctttctgtgctttgagatgatcatgtgatcatgtaaaaaatgatcaagatgatttttttccttcattctgttaatggggtatgttaccttaattgctctctatatattaaatcatatttcttgagtccagcaaaaaatccttttattccaggaataaatcctcttattctaggaataaattccaagagtaaatgatatataaaccatgtaatgggctattgatttaggtttgcttgtgcttttgggttttgcattaatatttttcagatatattggactacagatttcttttcttctagtatctttgtctggctttggtatcagggtaatgctgtctttatagaatggattagaaagtattcctgcctcttcagtttttgattgtttggtagaattcactattgaagcgatcagatcgtgggaggttttctttattgggaggtttttgattactgattcagtctccatagtagtttatccagattttgtttcttcataattcagtgttggtagatttgtgtttcttggaatttgtttcatttaaggttatccatttgttggtgtaaaattgtttgtaattgtctctctcttaacagccctttttgttttgtaaaatgagtagtaatgttaccactttcatttctgatttaaattgagtcttttctgtttttttctcagtctaactaaaggttttcaatctcgatcattttgaagaaccaactcacatttttgttgatttttttctctattgtttttctatattttatttatttctgctttcatctttgttattttttttatttcgggtagctttaggtttagtttgctgttctttttctagttccttaaggtgtaaagttaggctattgattttaggtctttcttctttattaatgtaggtgtttacagctataaagtccgcttttggcagacttttgctgcatcctatgaattttggtatgttgtattttcattttcatttgtcttgagttattttctaatttcccttgtgatttctttgatctcattgcttgtttaaccatctgtttttaaatttctatacacttgtgacttctacactttttccttctactcttgcattctagactcatttcatcattattggaaaagatacttcttatgatttcacttttttaacattttttgacgcttggttttttacctgacgtataatctgtcctggagaatgtttcatatgcacttgagaaaaatgtctattttcctggatggagtgttctatatatgtcattttagtccagttggtcaattttattggtccagtcccctgtttccttattaatctactgcctggtgtttctattcagtattgacagtgagatattgaagtctcctattattatcaaggaactgtctgtttcttcttcttaattgtgtcagtgcttgctttatatatttttgaactctgatgtttggcacatatatgtttataattgttatgtcttcttggtgaagttatactttcattatcattatgtaatgtccttctttattgcttgtaacagtttttgatttgcagtctattttggctgtttttgttacaggcatccctgctctcttttggtgattatttgcatggaatgtctttcttcattttttttttcacttttaacctgtgtgttttctatgagttaacgtgatctcttgtagacagtatgtagttgcatcctgttttttaatccattttgtcacttgaagtttttaattgagaaaaaatatatttacatttaaagtaaatacagatggggaggacttacttttgtcatattgttatttgctttctgtatgtcttacagcttttttgatccctcatttcctcctttaatggtgccctttgtgttcagtggatttttgtgtgtgacatgctttgattcctctctcatttccagttttgtatattctacaagtattttctttgtggttaccatagagattgtgtataatatcctcaagttataacagtctatttatttattatttctttatttttttagacagggtcttgttctgtcacctaggctagagaacagtgttgtggttgtagctcactgcagcattgaactcctgtgctcaagtgatcctcctgccttgtcctcctgagtagctgggactacaggcacacgtcactacactcagctaatttttaaatttttttgtagagatgggtcttgctatgttgcccaggctataacagcctatttaagattgaggcaggttgcatagtcttatacctgtaatcccagcactttgagaggccgaggtggtaggattgcttgaggcaaggagtttgagaccagcctggccaatgtagtaagaccctgtctctacaataagtaaataaataattaaataaaattagctgggcataatggtgcatgcctatagtcctagctacttgggaagttaaggtgggaggatagcttgagcccaggaggttgaggctacggtgggttatgattatgtcactgcactccagcttgggtgacaaaaattttaaaaagtgaaaaataaaactgataccaagttagcttcaattgcatgcaaaaactctacttgtttcctgttttgccccctccagtttatcttattgatgtcccagattatatttttatgtattctatacccattaacaaagaattgtaattatttcttatgcatttgtcttttaacttatgtagaaaataaatagtagagttataaaccaaaattctaataacatttgctttatactcatccatgtatttacatttactgggattattatatttcattgttagctgaagctatgtgcctgagatcctaagtagagaagtctgttgaactagactgggccatttagattatttatttctaaatagttttagactgtaggtagtcatttaacttcttccttgtaacagcaccttttttctcccttacaaatattcagacctcaggcacagatctattttaaaatttaaccaaaggcttttctcatctaacatctaccaaacacttccaggagagttgctactagcaaggcaacatgagaaggcttcatgcctagttaaagtgtactaggaagaatagagggaattagagagactctggccttttcctatatggtacatggggtggacattgtttttaatacttattatacttaacatgtaaaagggagagacccacactcttttttgttgacctttacctcatagtgactctatctactaacaaatattgtccagggccctaaatcttactctcctagattttcttttcttagaaaatcaaagcatgcactgagagtcttgaggcagaggaatggctagaatttggtttaagagacagaaggaaagaaaaccatgctacgcattcccttgttttttttcaaatccagctttagatatggttcaatttaaagagaaaaggcttaattcttttcatttctcccaaattatgtctgctgcttgtttactcttttctactgtttcttgtaaagtttttcattctgtgataaagattaaagatctgtgcgatttcttgttgtaagcatatgactaagaattgattttttttagcatagtttaagtacttttcttcttggtaagtatgctataatcttggaagttacagggtaccagaaaaagtaggtgatatttctctgagggaagaaaagggcagcttttatcttggtttggacttgctctgtcagtatatgcttaggaagaatttatgtcttgtgatgcagggaatatgtacagcatagcaggaattaaaatagctgattataagggtacagggcagaaatgacaatgacttaacttagaaagatgaaatcttagaagttatttggtttctattttataatattgtgagcagtataaagtggatatgatatgtcaaatcctgaaactccacaggtgtcaggaacattcccttgaaagttgagctgcgttaagttgaaggcaaataaaaggatgcttgctatttggtagatactgttttggtacccagcatctttagactgcgcaacttgcagatttttcaagaaagtgaaaaaaagtttaagtgcattaagagaaccgattcataatgtttaacaaagttaaactactactacgcttgtgattaattacaaatatttaaggtattggaaataaaagaaagcttgtaattttctgtaggactccagtacatttttagaaagataacgtaagtaatcagtgtgcgtacgtggaaaaagtaatttttagggaaaatgcagggataaaaatggggagtgaaaactttctctctctctctctgatagtgaaaactaactttctgtctctctcaaaggagactgtcaaggcaattaaaagaataataaagcactctgatgtggttttgctcaatgatctttgatacatagtctcatgagcaggctatttgcactgccaaaccttagttttctcataggaagcatgtacatataggaacttaaatagagagcaaaaataggttgtctgcctcatagattgtgaggactgtttacaataatgcatgtaaagtgctttcctcagtgcctgtcacatgagaaacacttgattagtagtaattgtcaattgtatatagcaaacagtagaaggacattacatgaaataagaacataaacctctgaaaaataatgagtttagcccatctaatgaaactggttaatacggtaagacggaaattggaatagagatttttagtgtttaaaatcacatttgattcagataatttgagaacagtctttttaattagtgcacttaaatcagaataattcctttataattacttatttttatcttttcaaaacagattcaagatttatggaaagttacctcttatttctttacgaatctcagataaaaaactacaagggattatggaattgattgaaagcattccaaaacctgaaccagtaactgaagtatctgcccctgtcaaatcattccaggtaatgttactttcaaaattaatataagcatgaattaagaaagtccacaaatagtatttcaaacaatcacaggaattttatataagacaatttgcaatttgttttgaatagacattaagaaaattactttttttttttttttttttttttgagatggagtctcgctctgtcaccaggctggagtgcagtggcgtgatctctgctcactgcaagctccgcctcccaggctcacgccattctcctgcctcagcctcccgagtatctgggactacaggcgcccgccaccacgcccggctaattttttgtatttttagcagagacggggtttcaccgtgttagccaggatggtctcggtctcctggtcttgtgatctgcccgcctcggcctcccaaagtgctgggcttacagacgtgagccaccacgcccagccagaaaattacatgttgagagagaaattgaaatggtaaaaagtataaatagttaagaaagatataaaataataaatctacttttctaatttctgcagcctccaatccctctcctgagcaataacactgttaactactgcttctctagtttttaaaaaaatttttgtggcatatactagtacacacatgcacaagaacatgcatgtgtgtgtgtatgtagtatgtgtgtgtatacatacatgtatatattcattttttttttttgaaacagagcctatctctgtcacccaaggtggagtgcagtggcgcaatctcggctcactgcaacctctgtctcttgggttcaagcagttctctgcctcagcctcctgagtggctgggattacaggcgcccgccaccacgccagctaatttttttttgcatttttagtagagacagggtttcaccatcttggccaggctggtcttgaactcctgaccttgtgatccacccgcctcggccttccaaagtgctgggattacaggcgtgaaccaccgtgcccggcctgtattcttttatttttaaaattaaatgaaatcattatacacactattctgaatctgtattattttcaccattattatcatatatgccttagataaatttttatgttagcacatacagatctacctcatttgtttatggtgatatagtatttcattttctgcatataccatcttttgcttaatatatcttcttttgatggatattcacattatgagtgtttacagttatgaaaaatactgctttgaacttcctcatatatatacatatatatgtgtgtatatatatatttgcttatacttttattcataggataaattcctagaaatggaattgttgagtaaaagaggatgtgaattttaaattttgattattttgccaaaaaaaaaaaaatttttttttttttgggacgaagtctccctcttttgctcgggctggagtacagtggcacaaccttggctcactgcaacctccgtctcccaggttcaagcggttgtcccatctcagcctcccaagtagctgggactacaagtgcgtgccactacacttagctgatttttgtatttttagccgagatggagtttcaccatgttggccaggctggtcttaaaatcctgacctcaagtgatctgcctgcactgggctcccaagtactgggattacaggcgtgagccactgtgcccagcccagatttgcttaacttatagtttgctaacagtgaatgaatatctttctctgctttcattactgagtattagcaaatgttaaaattttattcgaagtgaaaaaaatgtcttctggttttgatatgcttttttaaataagtagaacatactttcctaagtttactattttaatttctgtttttggaaactgctgttcatgtcttttttctattgggttatggttgtctaattaaggaagtaacctgcttgtcatttaaaattactgttttttcctcattttattgtttggttgttttttatctcatatgtaaatttatttttgccaggcagaagcgttttattttttacatagtcaatttttttttccttcatgatttctggactttgtattatgtgacttttccctttccaagagaatttcagaaagaaaaaaaatatattcacatttccctccattttcgggggtaacagggggttctttactcatgtttaaatgcttttcttttgaagtagtttcaaacttgaaacattccaaaaatagtgtaaagaaggtttttttttattattatattttaagttctgggatacatgtgcagaacatgcaggtttgttacataggtatacacgtgccatggtggtttgctgcacccatcaacccgtcatctacattaggtatttctcctaaagctatccctcccctagcccccgacccctcgacaggccccagtgtgtgatgttcccctccctgtgttcatgtgttctccttgttcaactcccacttatgagtgagaacatgcagtgtttggttttatgttcctgtgttagtttgctgagaatgatggtttccagcttcatccatgtccttgcaaaggacatgaactcatccttttttatggctgcatagtagtctatggtatatatgtgcagcattttctttatccagtctatcattgatgggcatttgggttggttctaagtctttgctattgtgaacagtgctgcattgaacatacatgtgcatgtgtctttatagtaggatgatttataatcctttgggtatgtacccagtaatgggattgctgggtcaaatggtatttctggttctagatccttgaggaattgccacactgtcttccacaatgctggaactaatttacactcccaccagcagtgtaaaagtgttcctgttttgcaacatcatctctagcatctgttgtttcccaactttttttttttttttttgagacggagtctcgctttgtcgcccagcctggagtgcagtggtgcgatcttggctcactgcaagctccacctcctgggttcacgccattctcctgcctcagcctcccgagtagctgggactacaggtgctcaccaccacgcccagctaatttttttgtatttttagtagagatggggtttcaccattttagccaggatggtctcaatctcctgacctcgtgatctgcctgcctctgcctcccaaagtgctgggattacaggtgtgagccactgagcccggccccttttcccaactttttaatgaccgacattctaactggcatgagatggtatctcattgttgttttgatttgcatttctctaataaccagtgatgatgagctttttttcatatgtttgttggccgcataaatgtcttcttttgagaagtgtctgttcatatccttcgcctactttttgatggggttgttggtttcttacttgtaaatttttttcagttctttgtagattctggattttagtcctttgtcagatggatagattgcaaaaattttctcccattctttaggttgcctgctcactctgatgataatttcttttgctgtgcagaagctcattagtttaattagatcccatttgtcaattttggcttttgttgccattgcttttggtgttttagtcatttagtctttgcccattcctgtatcctgaatggtattgcctaggtttccttctagagtttttatggttttaggtcttacatttaagtctttaatccatcttgaattaatttttgcataaggtctaaggaagtggtccagtttcagttttctgcatatggctagccagttttcccaacaccatttattaaatagggaatctttcccccattgcttgtttttgtcagatttgtctttaaatagggaatctttcccccattgcttgtttttgtcagatttgtcaaagatcagatggttctagatgtgtggtgttatttctgaggcccctgttctgttccattggtctatatctctgttttggtaccagtaccattgctgttttggttaccgtaggcttgtagtatagtttgaagtcaggtagcgtgatgcctccagctttgttctttttgcttaggattgtcttggctatacgggctcttttttggttccatatgaactttaaagtagtttttttgaattctgtgaagaaagtcaatgataacttaatggggatagccttgaatctataaattaccttgggcagtatggccattttcacaatattgattcttcctatcagtgagcatggaatgtctttccatttgtttgtgtcctctcttatttctttgagcagtgttttgtagttctccttgaagaggtccttcacatcccttgtaagttggattcctaggttattttattctctttgaagcaattgtgaatgggagttcactgattatttggctctctgtttgtctattattggtgtataggaatgcttgtgatttttgcagattgattttgtatcctgagaccttgctgaagttgcttatgagcttaaggagattttgggctgaggcattggggttttctaaatatacagtcatgtcatctgcaaacagagacgatttgatttcctttcttcctatttgaataccctttatttctttctcttgcctgatttccctggccagaacttccaatactatgttgaataggagtggtgagagagggcattcttgtcttgtgccagttttcaaagggaatgcttccagtttttgcccattcagtatgatattgtttgttgctttgtcataaatagctgttagtattttgagatacattccatcaatacctagtttattgagagtttttagcatgaagggtgttgaattttatcgaaggccttttccgcatctattgaggtaatcgtgtggtttttgtcactggttcagtttatgtgatggattacgtttattgatttgcatatgttgaaccagccttgcatctcagagatgaagccaacttgattgtgatggataagctttttgatgtgctgctggatttggtttgccagtagtttattgaggattttcacattgacgttcatcagggatattagcctgaaattctcttttttgtgtgtgtctctgccatgttttggtagcaggatgaggctggcttcataaaatgagttagggagaagtccctctttttctattgtttgggatagtttcagaaggactggtaccacctcctctttgtgcctctggtagaattcggctttgaatctatctggtcgtgggctttttttggttgataggctattaattactgcctcaatttcggaacttgttattggtctattcagggattcgacttcttcctgatttagtcttgagagggtgtatgtgtccaggaatttatccatttcttctagatttttgtagtttatttgtgtagaggtgtttatagtattctctgatagtagtttgtagttctgtggaatcagtggtgatatcctctttagcattttttattgtgtctgtttgattcttctcttttctttattagtctggctagcagtctatgtattttgttaatcttttcaaaaaaccagcacctggattcactgatatttttgaagggtttttcgtgtctctatctccttcatttctgctctgatcttagttatttcttgtcttctgctaccttttgaatttgtttcctcttgctcttgcttctctggttctttaattgtgatgttagggtgttgattttagatctttcccgctttctcctgtggggattttagtgctataaattttcctctaaacactgctttagctgtgtcccagagattctggttgtgtctttgttctcattggtttcaaagaacttacttctgccttaatttcattatttacccagtagtcattcaggagcaggttgttcagtttccatgtagttgtgcggttttgagtgagtttcttaatcctgagttctaactggattgcactgtggtctgagagactgtttgttatgactgccattcttttgcatttgctgaagcttgttttaccttcaattatgtgatcaattttagaataaatgtgatgtggttctgagaagaatgtatattctgttgatttgggggtggagagttctgtagatgtctattaggtccacttggtccagagctgagttcaagttctgaatatccttgttagttttctgtcttcttgatctgtctaatattgacagtggggtgttaaagtctcctgctgttgttgtgtgggagtctaagtctctttgtaggtctcttaagaacttgctttattctttaagaatgttgaatattggcgcccactctcttctggcttgtagggtttctgcagagagctctgctgttagtctgatggtcttccctttgtgggtaacctgacgtttctctgtggctgcccttaacattttttctttcatttcaaccttggtgaatctgacgattatgtgtcttggggttgctcttattgaggaatgtcttagtagtgttctctgtatttcctgaatttgaatgttggcctatcttgctaggttggggaagttctcctggataatatcctgaagagtgttttccaacttggttctattgtccccgtcactttcaggtacaccagtcaaatgtaggtttggtctttgcacatagtcccatatttcttggaagctttgtttgttcgttttcattcttttttctctaatcttgtcttcatgctttatttcactaagttgatcttcaatctctgatatcctttcttccgcttgatcgatttggctattgatacttgtatatgcttcacgaagttctcatgctgtgttttcccactccatcaggtcatttatgttcttctctaaattggttattctagttagcatttcctctaaccttttttcaacactcttaggttcattgcattgggttagaacatactgctttagctcagaggagtttgttattacccaccttctgaagcctgtttctgtcaattctgcaaactcattctccatccagttttgttcccttgctggcaaggagttgtgatcctttggaggagaagaggcattctggtttttggaattttagcctttctgcactggtttttccctaatctttgtggatttatctaccttgagtctttgaagttggtgaccttcggatggggtttctgtgtggacgtcctttttgttgatgttcatgctgttcctttctgtatgttagttttccttctaacagtcagacccctttgctgcaggtctgctggagtttgttggaggtccactgcagaccctgtttccctgggtatcaccagcggaggctgcagaacagcaaagattgctgcctgttccttcctctggaagcttcgtcccagaggggcacatgccagatgccagccagagctctcctgtatgaggtgtctgtcgacccctgctgggaggtgtctcccagtcaggaggcatgggggtcagggccccacttgagaaggcagtctgtctcttagcagagtttgagtgctttgctgggagatccactgctctcttcagagccagcaagcaggaatgtttaagtctgctgaagctgcacccacagccgccccttcccccaggtgctccgtcccagggagatgggagttttatctataagcccctgactgggctgctacctttctttcagagatgccctgtccaaagtggaggagtctagagaggcagtctggctacagtggctttgctgagctgcagtgggctccgcccaatttgaacttccaggcaactttgtttacactgtgagggaaaagctgccttttcaagcctcagcagtggtgattcccgctccccccaccaagcatcccaggttgacttcagactgctgtgctggcagtaagaatttcaagccagtggatcttagcttgctgggctccatgggagtgggatccgctgagcaagactggcttcagccccctttccaagggagtgaaaggttcatcttgctggcattccaggtgccactggggtatgaaagaaagctccttcagctagcttgatgtttgcccaaatggttgcccagttttgttcttgaaaccctgggccctgttggtgtaggcacccgagggaatctcctggtctgccggttgcgaagactgtgggaaaagtgtagtatctgggctggagtgcaccgttcctcatggcacagtccttcagggcttcctttggctatgggagggagttccctgatccctttgtgcttccggggtgaggcaaagccccactctgcttcagctcgccctccgttggttgcatctactgtctaaccagtcccactgagatgagccgggtacctcagttggaaatgcggaaatcactggccttctgcattgatattgcctggagctgcaggttggagttgttcatattcagccatcttgccagccaccagtgtagagaagttttatccccagtctgttagagagtatgttactacctgggcgtggtggctcacatctgtaatcccagcacttagggagcccgaggcaggcagatcacttgaggttaggagttcgagaccagcctggccaacatggtggaaccccgtctgtactaaaaatataaaaattagccaggcatggtggtgggcatctgtaatcccaactgctcaggaggctgaggtaggagaatcacttgaactctggaggtggaggttgcagtgagccaagattgcgccactgcactccagcctgggcgacagagcgatactccatctcaaaaaaaaaaaaaaagaaagtgagttaatgtcccattactcctgaatactttagtgttttgttgtattcttttcctagtctgttggtgagtttttttgtttctttaattgtcttttggagggcaaaagtttaattttgatacaattgactttagcaatattttctctagatattgagctttttgtatcacatctctgcaatttttgcctaatttaaggtcaagaagatttttccctatgtttttttctagaaattttttagagttaggttttatacttaggtctctcatccatttaatttttctatatggtgcttgtgatgggatcctctttctagttttacatctgcacttagttatttccattttgtttgttaaaaagactattcttttactattgagttgactatatatgtgtaagtctatttcagactcttccagtgatttctgtgtctatcatttccatctgtttctgtccttttgttgatatcatactgtcttaattatactataacttcatgtcttgaaatccagaaaggttagtcctccaactttttgtatttccaaaatgttttcgactgattcctttgccttttagaatcaacttatcaatttccacaaaaattctggctgagatttggatagaaattgtatcattaatttgggagaattaacattttagcagtattgagtctttcagttcattaacatggtatatctctccatttgcttaggtctttttaagtttttaaaaattggttatttgtagcttaagcatccgtttgctaatatatgttgttaaatttgtacatagtgtatgggctgaattgtgcccttcaaaatttatatattgaaccctaattctgctatttcacattgtgactgtatttacagataggttctttacagcagtgattaagttaaaatgagaccactagggtgggcgctaatccagtttgactggtgtctttataagaaaaggaaatttggtctcacagagacaccagagatgcatgcacactgaggaaagcccatgtgaggacacagaaaggaggtcatctgcaagttaacgatagaggtggcctccagaactgtgagaacatagatttctgttgttaaagtcacccagtctatgctattttgttatggcagctctggcaatctcatatacgttttggtaccaagcagtgagttgttgcttaacaagcacttagaaatgttgaagtggctttagaactgggtaatgggcagagactggaagaattttgaggcacatgttagaaaaaaacctagattctatcgtttaataaattattgatataaaatatggacgttcaagctgtttctgttgagacctcaagtggaaatgaggaacatgttatttgacattgaagggaatgtggtccttgttataaagtggcaaagatcttggttaaattatgttctagtgatgaagttggatatttagctgtggagatttctaagtaaaatgttgaaggcatcgtcttatttctcattgcagctggtcaaatcacttgaggccaggagttcaagaccagcctggccaacacgatgaaatcccgtctctactaaaaatataaaaattagctgggtgtggtggtgcacacctgtagtcccagctactcagaaggctgtggcacaacaatcacttgaacctgggaggcggaggttgcagtgagccgagattgtgccactacactccagcctgggtgacagaaggagaatctgtctcaaaaacaaaaaaaaaattgtacaatatgtggttaatatgtgtttgatttattacaaagatgccagcctagctaagtgggggaaggatcaccttttcaacatatggttctgaaacaaccggatttccatgtggaaagtaaattaatttcaacccttatcttatatgcggaatttaacttgaagcatagacctaaatataaagtccacaagtgtaatttctggaacaaaaaatgtaggttaaaattttgaatccttgcagtaggtaaagataccttaggatataaaaagcgcaaatataacaggagaaaaaaataaataaattggactttataaaaattaaatttttctgctgtttggaagacattgttaaaaaaggtgaaaaggcaaaccatctaaccatccacttgggaaaaatagttgcaaaaatatttttacaagtccagacttgtatctagaatatatgagaagactaacagctcaataataaatgactaaacaggtagcatgaaaagatgttcgactttattactcaccagaaaaatgcaaatcaaagccacatagaaatactactacacaatggttagaatggctaaaaataagaagaatggcaataccatgtcaaggtgttgccatgacaaggatttaaaactctcatatgttacttgtgaaacttgaaaatagcataaccctttgtaatttagtttggtagtttttaaaaataaggttaagtatatacttaccatatgacttgggaattctactcctaggtttttacccaagagaaatgaagtcacatgcctaccaaaagacttgaactagaatactcacagtagggttattcataatagtaaaaagttgcataaaacccaattgtctatccagaagtgaatggataaggaaaaatagtatattcatacagtagactactactcaggaaaaaaaatactaatacatgtagcagtgatgggcagtgattgagtgtagggggagcttccctcaaaactccagggcattttagggaatagaacgcaggattacttggcaattcatttaagaacttaacaaaacttgtattctaaaacctaacaactacattataaaagaggaaaataatagcccagtttcactaataaatgtaagatacaaaaatttcaaaacattaaaagttgaaattaaggtaacatagttgttacttttgggaggatgcctaatgattgcaaggagcttaagggaggcttatgagttgcttgtaatgtttcatactggacctgggtggttggtaggttgagtgtgtttactttctgaaaatgtattgaactttagagtttatgtacttcgtgtagtagattataatgtgcttaaaaaaaatgctgctgctgcttccaaaatgagcagaatttcacagaatggcaaacacaaataaccaaggaagctatttgtgtttgatatgatatgtaaccgttatgcatttgtgaaattgtaattaaaactaggatgacatggccaatgagactgatataatttgaaatctttgaacaccctaagcattgtgaggatatggagagatagaaactgtgctgctggtgttagtgtaatgtcttatcaccacttttgaaaatggtttgatagtgctcaataaggtgaacatatataattttactgtttgggaaagttttatccacaagcacctatgggcatatcaaggatgtttatagtagtgctacaagcaaaagcaaaaatctataagcaacacagatactcaccaacagtatagtggacaaataagtagtggtttcttcatcagtgcaatacaatatcacagtaaaattcagttaactatcagtgtggttaaaatttaaacattgttttgtaaaggaagtcacaggaaaatgtatgtcatatatgctacagtttggaaagaggcaggggtaaacgatgcattatttagataatcattcataggtgctttagtacaaacaactaaataaaagcaagatcatgatgagaggtagggaacgtgacaaggaggaatgagatccgggaggaacacataagaagatgcttctaggtcaggatgtggtaatgttttattgcttggctgggttggaaaattcagatgtgtcttttattattatttttttaaactgcaaaatttgtttttatatatgctgtatttctccaaactgtaaaaaagtaaatttcctgaaatacctttcagagatcaaaaataaaagtaagttcctcaattctagaggctttaagtattgtgacttgtgtgttcctcacagatgtcctgatttaatactatgttgacttaaaatataagatctgtttctactcaaagcctgtcatcaaggacattattaaaacagttctacaatttttatttagccttaaaattgtaaaactacttctttaaaatctgcgttttataatgtatttttctaatttaaacctgattatcttctcagttaattcaaattggatagctttttgtcaaaactgttgtagaactttgaataaacattttttgaataagcggtgaataaacatttttgtgctaatcaacattgaattacttttctttcagattcaaacatctacttctttgggaacatcacagatttcacagaaaataattcctctcttggaacttccatctgtttctgaagatggtaaaatgaaactgcttaaggatatttttcttattttattaaaataatttctgttttgaggcatatttttctcaaaggaccacacagaggaaggaaaatatcttttccttttaaaatctaggttcttgactgaggctctatgaatggaagacagattaacatgagaaaacaagcagatttactagcattcatatttcatgggtacatgcaagaagctcaggaatgagtaactcaaggtggtgattaaaatttgggtttatataccagtttgggcttaaacaaaggaaaagaggttttgggcttcagggataggggttgctggggaggcaaggtatatgggaaggcgaccagaaaaagtatggtacacaagggtaaagtttgttacgcagatatgtcagtgttttctccgttgataagaatgtcttgggagtaagagtcatcttccctggtacagaaaggaagatacctttacaaggtagatttctcttataaatgttaatttcccttagaaaagggaaacttaggatctgtcttcagagcttttcctgtgtctgctgtttcttaaaataattgactcagtgtaatccttatgccaaaaagacatgttttcgagtggcgtattttggtcttctgtagtcatataagaaatttaaggcaatagcagatatttgtatattttcaggaaattttaactaaaatttattttaaatagcacaattccttaaagttgcttttgcaatgggatttttttggtataaagttgaacagaaaatgacaaggaccagccaggcgcagtggctcatgcctgtaatcccagcactttgggaggccaaggcgggcggatcatgaggtcaagagatcgagaccattctggccaacatggtgaaaccccacctctactaaaagtacaaaaattagctgggagtggtgctgcacacctgtagtcccggcgactcgggaagctgaggcaggagaatcgcctgaacccaggaggcggaggttgcagtgagcagagatcgtgccactgtgctccagcctggtgacagagcgagagtccgaatcaaaaaaaaaaaaaaaaaaaatgacagggaccactaataagttaattatctttatttggctgtgagttaaaaaacaccacaaaacttcacagatgtcttaatttctaatgtgttttttagttatttggaaaattttgctatagtatatttaaaacatttttaaaaatataattattaaaggaaaatcatcaataattatctacatttacatataaaaatatataactattctgataccaaatatgtgctttttaatgaccgtattagaaaaggtgtatgtctatatttttaagactttaaaaattgataaatgttaaataacagaaactgccatgtcgattcttggtttcttagagaacaatttttctttatttatagtcaccagagagaagttgtttgtgagatcatctactttaacttcagtcttagtttattagggatatacttctgattgtttcatttaaacctagttttaatggttttactaagttatctaatgctttttcagtcctttttaatatcagcatatgtgtatgctgatgtgtattacatatcaacgtatatgtacatatacctatatttgtgtatatatatgtatacaaagtagtgcttgatctcagtttacttcattcagactctgctgctaatattgcagagtttatacctaagtcctgttacactatccaggtagagtgagcatattaacatattactttgagtattcatggtgtgtataatcatcggcattggcatttcctgtaaaatttaagcaattttaaaatagactatttcaaaagatgggcttcttaagctaaagattacatcttaataatgttccatgcttctttataaccaagaatgttatttaaaagtagagtatccctttgtttaaaatggacaataaaaaagtacagtaatgtctatattattttctgtttatttcggttctcatgttaatatttgatatttaaaagagagccttagtgttttagtgttcatatttatttctattgaaatactgttaaattgatcattttaattattgacttaaataatgttctgtgaaatgtagattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggtaggtactacggtaaaattaacatggcttaatttgtttgctgtttctatatttacagcttactatatagtctcattgttaagaagcactatctttttcaccctaattaaagtaattccagacttgctgtgtgattcttggtcactccccgccccccccttttttttttaaataagattaacttccttaatcaagagtgaaggatttaaatttattcagtacatgtttttgtgaaaacgattatttatgttgtgtgtgtattgtatgtctgtgtgggtataaaatctctcctaaattttaaataataatatatcaattgtatgtatacctcatatattcacatgtaaccactatgcacataaacatgtttttgttttatgtagtggtaatttcttttttctttcttctccaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttgggtaagaatctctattttttaaaataaataaattaatttcattgtttgactacctgctagagagttttcaattctttaggctctgaatcagtacatttgctgaaatattctcagagaaccattcctttttgagttaatctttaacttttatagttggtaatgtggggggcacaccggagataaaatgaagataattttattcattatggaaaatcagatgataatggttgaattttaaatctacttaactgagtattggaacacttaattagttttctattgttgctataacaatttaccacaaacttagtgcttaaaaacaacacaaatttattatcttagagttctgtatgacagaagtctgacacaagtctcactgggcaaaactcaaggtgtcagtaggacttccttttaggaggctctagaggagggtccatttcattgttcagtcaggtgttgacaaaattcatttacacatggtttaagtctatgtttccttgttgcctgttagcggatggctgcccttaggcctcagttgcttttttgcacgtagctgctaaccacaataaggcatcagatcctcctcatgttgccatatctctaacctcctcttctgtgttttgcttccactcttaaaactccagtgattagattggacacacctctataattcaggataatatacctttaaccttaaccttaatcccattttccaaggcccttttgccatatgagttaacatattctcagattccgggggattagagcgtaggtatctttgttgggggcagagggcagtattctccttactgcaaaccttttgtgttcgtaatggatatatgatccctaagaaactattctgtttcctatgttaggtaattaggagggttgtatttatatttcttcatttacattttttggatttttccttgaaagataattgtgaatagtagaggcaattattaggacaccagtttcattttattaaactcctttgtagcataataatattatgtatgagcagaggtggaaataaaattttttaaatagactattttttagagcagttttagatcatgggacaattgagcagaaggtacagagatttcccatatactccttgtacccacacctgcatagcctttttcattatcaacatcctccactagagtggtacatttgttacaactgatgaacctacactgacacatcgtaattaccaagagtccacaatttacattaaggttcactgttgctgttataccttctgtttggacatgtataatgacatgcatctaccattaccttctcatgtggagtagtttcactgccctaaaaatcctctgtgctccacctatttgtccctccctcccacttaacccctggcaactggtgatccttttagtgtctccatagttttaccagcatgtcacataattggaatcatatatatccttttcagattggcttctttcacttagtaatatatgctgaagttacctccatgtcttttcataactgggcagcccatttcttttttagcaatgaatgatattctcttgtctggatgcaccacagtttatttatccattcatgtactgaaggatatcttggttgcttccacggtttggcaattgttaataaagctgctgtgaacatttgaatgcaagtttttgtgtagacataaattttcagtttcactgggtaaataccaaggaacatgattgctaaatcatcaagaaacagtttgctctagtaattggaaagaaaagtaaaccaacgtgacagtgttccctagtaacccaggaactttatagcagttactaagttttttttattattattagttttatttatttttattttttgagatggagtctcgctctgttgcccaggctggagtgcagtggcatgatctcggctcactgcaagctccacctcctgggttcatgccattctcctgcctcagcctcctgagtagctgggactacaggcgcccgccaccacgcccagctaatttttttttttttttttttttgtatttttagtagagacggggtttcaccatagtctcaatctcctgacctcgtgatccgcccgccttggcctcccaaagtgctgggattacaggcgtgagccaccgcgcctggccacacttattaagttttatgtttattcttatgtttgctttgccaagaacaaaggattaaaaaacccttgcaaacagaaaaaagagtatacaattattattgcgcttatttctgtaatatttttgtttctgttttctcagagggagtgaatagcagtttcttgcacaaagtaaatgatcagtaaatggttcaatgaatgaataaatgtgtaaacaaagtgggaacttttttaaggcttcaagtgtggctagcacttggagtagaaaacaggtttatgtgctaagcattaggtttggagaactctgtgcaatttgtggcatttttttctcaggaattgtaggattagtttgtagtcctttcttccagtctttagatactaattttctagcaaccgtaagtcatttggtgatgagagttttaaaagctttctataaattctcttctacactggttttcttagtatagcacattttgagcagaagcagtaatattaaaatgggagagttcctttattcccctcgcaggacatgccacaggggtgtgtatttccctagagggagcatgcagatgggcaggtgcagaggctgtggggagtgcttttgggctccggccccaggacagcatctaggggtaggtgtctacaacccctgaagcccaaggggcatgtgttacagtatgctctttcaactttgccatctgcagacagcttttgttaatcacctcgatagaccgtcttccttatcgcaagggcagggggccattgtgactgcctgagttcttgcccagtgtaccagaagaattggatgacatgtgggctggaaggatgagtgcaaggttttattgagtggtggaggtggctctcagcaagacggatggagagccggaagtgggggatggagtgggaaggtggtcttcccctgaggttgggccacccagcagatggactcttcactgacagcccctagttgaactaccccagcgtccggacgtccacgtccttcctcttctctctttttctgccatgctgccctgccactctctgccactctccaccactcttttcctctgctcttctcaatgctcagctgcttgtatctgtgcccactaaggccttgggcttatatgggcacaggatggtgggtatggtgggccaaaaggcaacttttcaggtgcaaaaacagaaatgcttgttctcgtttagggcctccagtttttaggcttgagggtggggcctttgctggggaactgccctcttctacccagtatttccctgtctgctgtccatatcagtataactaataaagactgattacatggtaatagggtttattttaatctaaactaatatacagaaaacttaatgtttcatctcattcccggtctgtcttctgaacagctgggttttcaaggactctgatgatttcctttttagttatttcagtgatccagggccagaattctcttcctgccctttcattgttcctaaaaaccattctagtttctctttagttgattcctgttttttcttaccttacctcctatctaggtttagaagggtatgagacttcagtgttgtggcacatgaggaggtaagggaattgtgaggagaaattaaatttttagagtttaaagaacaaagaagtaacttgacttgggtgaggtagaatccaaggtccagaactcatataggaaagccttcttttgcaattacataattaataagattgcttgcatttattttcagttacctttccgatgaaaagataatttttaaaaaattatttttagatgaaaacaagaaaccagtttatttggttacaaccctggataacacaatggaagacctgttaacgctggaatatgtaaaggtaagcagtttcatttatatctgcttaatatggtaagtatgctgctgaaatgttaagttttgtaagtttggtattattcagtttatttaatcttcactgtaacataatctctttgtaactcctaatactaaggttttttttattttgtcatcttgtattaaatagttgtgatttataaatacttcatatagcaaaataagaagattgtgttctaagtagaaatgacctggagtttgattttttttttctcccaacaggggtactgagaaagaaacacactttttagtcttgttagagtgtattgttttatgtgatacaagatgatgctttcactttcttttccactgttttgtgaagttacttgatattcctagggtcaataactccattccttttttattgatttatgatattcattttatcgtttgttaagcttttctatgtactatggtctatttctaatttttccatgtttctgctgacttccgtgtttctgcgtcagactattttaataattactttataataagaataatgcagaaagcatttaatcactttaaaaccatttttgctatccattattgactagatgtcttaagatttttgttgtatatgcattatatagcttttatgtagcaaaagtattctagacctaaagaaaatggataaagaaaatgtggtatatatacaaaatgaaacactattcagctttaaaaaagggggggaatcctgtcacttatgtcgacatagatgaatgtggaggacattatgctaagcaaaataagccaagcacggaaagacaaatacctcatgatcttctttatgtgtggaatctaataaaactgaacttatagaagtagagagcacagtgatggttaccagagggtagcagggatgggagggagggaaggagagggaatagagagttgtcaatcaaatggtacaaagttccagatagacaggaagaataatttttgagatctgtatacagcaggggaactgtaatcaataataatgtgttgtttattttaaaacaaccaagaaagtgaatttcaaatgtctcaccacaaagaaagataggaaagcgaggtgacagatatgttagttagcttaatttaatcatttaacattgtgtacatatatcaaaacatcacattgtcctccataagtgtatataattatgatttgtcaatcaaaaatattaaattttttaaaaagaaaaagaaaacacagagtatttggatacttggtggacaattctgtcacaaattttgtttttaaatacaggaagaattaggaagaaccgtacagagttgttgatgaccgaatgattattctccacacttgataatatccaacatttcctctcttaataataagaatgatagtacgtaacatttattgaatacttgctatgtgccagagagtccaatacttacattttcttttgttctggtgaagcggttgcttatttaggtaattatatgtgtgtgtatatgtgtatatatatatatatatatgtatatgaacagctggaaaattatataaatgtgtattaggactataatgtgattgtatatgtatgtcttcctaacgtgttctaacagatttgttttctctttggataggctgaaaagaatgtacccgacttgaaaagtacctataacaatgttttacaattgattaaggtatgagtagataatttattttttaattatgtactatttcttatggaaattattttctaactggaattgtaagatccttaaagataagaaaatattataaattatatcctttatgccacaaagcatagtgccttgtagagagctggcaagcaaatatttattgacctatcactaaaatcagctttgttctttaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattaggtatgttttttaaaaatttagcatcaactttttttttttttaaccatgtaggtcaataaatctagaccctgactttattattaacttcaaatattggcttcagaattctgttgcctaggttaatatctagaaggattcattatatgccaggataattttagaaaataaaggaaactactggcgaagaaaatgttgcttttgtttatcgtatataataattgtttttagtttaagattatatagtaggagtattagattaaaaaattttttttcttccacctcccagtaggaggattagatttaaattaaaatttatgcatttcatgacattattttagattagacaaatatgactaacaaaatttgagtattgtcagctgggtgcggtggcttatgcctgtgatcccagtgacccagggaggtgagcgctgtggggattgaggctcaaggatcacttgaggccaggagttcaaaactagcctgggcaacatagcaagaccctgtctccaacaaaattttaaaaattagttgggcatggtggtgtttgtctgtagacccagtttacttgggaggctgacacattagaatcactggagcccaggaattcaaggttgcagcgatctttgagctacaattgcaccactgcactccatcctgggtaacagagagagactctgtttcgaaaaaaaaaaacaaaaaagagtatcagagcatattttaaaatcagagtatagtactttcgaagcagtgaaaagttgcaattttgataatgacaagtatcacctagtaattattggttctcaaaaaattttgaaatttatagctacagtgttttagtttcaaatgtttagtttcttcttgaaacagtgttgtctatttgcttttgtttttgttagattttattgttttttagaattttcaattcagtagggaatatcataccttgctttcaactgaattgcagatcaggttttctctgatatcactatttgtggtgatatttcagttactttataagtatagtgaggtaactactaaatgtttttcctcatgttttataatatgaatttttttttgcagctttaaaactatccacaaatgaagatatcattactttgcagattttagcagaattatcgtgtttacagatctttattcaagatcagaaatgtaacatttctgaaattaagattgaaggtaataaaatttcacaaaaagcaaattaaaagacattaaatgaaagaaaaggcagtcattcttttgttcccttagggcttgattctgagatgattatgaggccttcagaaactgaaataaacgcaaagctaaggaatataattgttttagattctgatataacagctatatacaaaaaggtaagaattcttttaattaaataatagtacatcattaaataggattgtcctttaagagtggtcataggtatcatttggacatttgtcagaatttagtagtatggcttattatgtgcatgggttttggagtcaggcataattgggttcttagctctactccttagtagctgtgtgaccattagcaggttacctaatcttggactctgtttctttatttgtaaaatgaggattacagtatctcataaatgagataagtacgaataatgctgcaggaacaaagttttgggagagaacctagtaaatacctttttcactttttttttttttttttggttcatgtactctgaatcttgtaatgcattttagatacatttgagggtctgaagtctgaggaagtgagattttttataaagcttattgtcatcagcgatcactagtatcgttgttgtaataatgataagagagtcctttgaactggatgattagttgttgaaggttaggtaatttgttactggttataaaacagtgaggttcctgctgcagagttgaacaggcaacatcctacctgaagcaggcaggattatgtatttaaggaggttaaaggaatatcagatagtaggatcaggaaaaactgaagtacttgttgagtcaggaagtcagcatttggaatatgttgagaagaaaggaaatagataaatagattttgccagtaatactgtagtgatgaactgatttttatgtttaaaaaattcttatttctaatatcttcttgttatggcttatttagtgggatagaaaaacagttccaacatcaaaaagaagtgactcatagcaataaggaacaagaaattttccagaagccgtggttttatttgcttctattgcttttattttaaaaatcataagtatcagagtatttaagaaataggttatccattttattttccctatctagaaagtaaagctcacagaaataaagtatctacgaaaagttatacagaactgagagcatgatccaacccattgatttttttctctgtaattttattttattttatttttttattttttttgagacagtcttgctctatcacccaggctggagtgcagtggcgcagtcttggctcactgaaacctccacctcctgggtttcagtgattctcgtgcctcagcctcgtgagtggctgggattacaggtgcgcacaaccacacccaactaatttttatatttttagtagagacagggtttcactgtgtttggccaggctcatctcaaactcctggcctcaagtggtctgcctgtcccggcctcccaaaatgctggtattacaagcatgagccactgtgcccggcctgtaattttatttttaatatatctacaaggttaaaaattcagtttacagaaagttacaaaataaaaaaaatctttctccttgtcttcttgcacgattttcatttccctttccctgtttctttgattccattgtacatggtttttaaacaaactgccttgtttagtaactttccacgtgtcaaagaaccagagaggcataaggtttttgcccttatgaaatcagacctgattatgaatcagtttcataagccttgtacagcgatatatattattgtgccagttttaagtgtactgagacattgaggccctcaactttaagggtgggagcccccagaccatttgtttgactctgtcttggagcagcatcctccatttactgtagcaccattggacaaatactgtttttatttatatatgccataaggtaaaaaggattcttgctgacctgatagtctcatgaaaaacatatcatagtaaattagtttctgatatcttcttcataaaaaatattttgaaagtaaaggcttaaaaaaatccaatttttaatgcttaattcttggtgatgggtacacaagtctttctaattattctcaacttttctggccttgttattaggccaacacttgcttcatgaaatgagttgggaaatgctttcttcctgttttctgaaaaatttgtatagaatttgcattattccttaaatgtttgatggaattatcagtgcaaatattttttgtgtatagttgagtctgggattcactttattttattttccatatggcattcagtatccaaaggagatccacacactgcatttgattgatataccacttaagtctgttatagtttatgaatttcctttagtttcttctctgcccttgtgttagccatttgttgctatcttatttattctgtacaattttccatagcctgtatcttgctgattatgttttcatgctatttaacatgttactgtatcctgtgtttccttaaatcggtatttaaatctcagggcacagtgagattcagggtttgggagtaggggttggcaagatacttcatagttggtagtgtgtgttttcataggaggcacatagtgtgtagctgtcttttttttcttttctgttttgcactgtcttggaatattttcttttttttatgttagaagctatttgttgttatttcctgtaatttggtcttgaagtctgtgtctggagagtggccataagccaaaatagccactttctagcttgcaggcatgttggtcagatgggacatcggggaggcaacacaacaaaacaccctcgaggggtgcccaccagggaggctgacaggaagtctggaggcagtagggacgtttcttcatttattaaatgggagagttcaccagtctttatgctggtatcaccaatcattttggcttttcaaaagtttattctccagtagatttcttaggcagggctcataggaacaataatccttatttatatttgcagggtagtttgactggattttaaattcttgccttgaattttcttttctagatgatcttaaaacatattactccatgtcttatggcctagtattggtgttgacagttctgatgacagtttgactttctttcgcttctaagaactttgccattttccccagacattcagagctaatttgaagctttatgtagggactttggacaggtagacatcacagttgatggtcaggaactggtctagcaattttatgggttctcagattgagagtatctcttgttcttaggctagttagtttccgttgagaaaaatactattaagtataagcctggcagcctacattccagaagccaattggttgaaagaagtggaggcctcatcatttagtttatagatttttgcttaaaataaccactttttaacatggtgttttattaaccgtctttctgtacctgaagtctcctagaccacagcctttctgctctaaactctgtcgagcaaatctgttctgttgaactcggagaggaacagtcatatagtcctactcatgtgacatgcagaggctattcggtttattctaaactaatttaccagtatttatataattatatagatacaatttatacattaatatatatgtaaattatatatgtataaatactggtaaataaattaagaaaaaactaattatatatattatataataatatattttatatatacataaaattctctctctctctctctctctctctgtctccaatcacacaatcacagctcactgcagcctcgaccttccctggcccaggtgatcctcccacctcagcctcctgagtagctaggactgcaggtgtgtgccaccaggcccagctgatttttgtagagatggggtttcaacattttgctcaggctgccctcaaactcctgagctcaggcgatctacctgcctcggtctcccaaagtgctgtgattacagacatgagctgagccacagcgcctggcctatttgagatactatagtcagcaaaagataaaaagcccttctccacgtggaataaatagtagttaatcagtaatataaaacaatattagagagtgatatgtgctttgaaaaccaagaaagcagggtaatgtgacaggtaataattcacgtggcgtattaggattatcaagaaatgcttttttacagtagaaacatttgacagaaatctgagctgtggatttgagccctgttgaaagagctttccaggtggaggaaagagcaactataaaagccttgtagcaggaaggtgcttgctatattctgggaggttttagggccctcagtaacctttgggtagaattatttattagtttctgttttggtttagtttttactttttaaagtaagatttattgagacaatttacctatagtaaaacttacctcttttagttataattctgtgagttttgacgaacatatactgttgtgtaacttaccttcagcatatacaatgggtctgtcaaccctaaatattcactactgccctttgaggttagcccttctccccatcctagcaccttagaatcactgcactgtttttcgttcctgtagttttgcagtttccaaagtatcaaataaatggaatcatgcagttatgtagtctttcacgtttttttttcttagcatgtgagattataatttttgtctttttatgtcttgatcagcctggttaacgatgtatcgattttattgatactttgaaagaactggcatttgtttcaattgaatgttctctgtttttaattttatttatttatgctcttttaagattccttccttctgcctgctttggatttaatatgctcttcttaaggtggaagtttaaattattgatttgagaatgtctttctgttgtaagcatttgctgctataaattttcctttaagcactgctttagctgcttcctgtaagttttgatatgtcatatttttattttcattcaattcaaagtattttctaatttctcttctgactttcttttacccattgtttatttagaaatatgttatttaacttctaaatattttgagattttcagatccctttctgttactgatttctagtttaaattcattatggtcaggggagaaaccgtttcagttcgtttaaatttgttgatgtttgttttatggcccagaacatatatgattaatcttggtgaatgtttcaagtgtacttgaaattaatatgtgttttgctgggttgaatgttccatttgggcaagtaggttggtggatagaattattcaggctactgattttctgtttactggttgtgttgaagcctctgattataaccattgatttgcctgtttctcctttcagttctttaagttttttgctttgtatgttttggagatctcttgttaggtacatataaatgtgtatgaattttatgccccttttgtgattatgtgatgtgtctttttatctgtggtaactgtgcttgttctgaagtctactttggtagtaatatagccattccaggtttcttcggttaggtttgaatggtctatctttttctgtcctttagcttttaatggatgttttcttgtttaaagtgggtttctgttttttgatgcaaagtctcactgtgttgcccagggtggtcttgaactcctgtgtttaagctcgcctcagcctaagtagtaagtagctgggattatatgtgcatgccaccacatctggcttaaaatgggtttcttacagtcagtgtatatttagatctttcttttttatctaatctgacaatctcttggcttttaatttgtgtttagactattttataaaactaattattgatatgattggattgtaatctgatatctctaattgttttctgttctctaattttgtttatcctattgtattcctccttttggcctgatttttgattaattatcatttattttatggtttctctagggtttacaatgtatatatctttaatcatagtctatcttccaataatattttattgttgtacatatagtgtaagaatcttacaataccatgcttccaattcccatttcctatctttcttggtatcatcataatttgctttactttggtgcatgttgaaaactcacaatgtgtacctattgaatttggtttagtcagttttctttggagcaattagttttctaaagatgttttatatttttcttcattgcaactctttctgtaactacttcatgtagtttctgtctattgtttgtatttctctctgaaatactttctcatttcttttttttttttttgagacagagtcttgctctgtcgcccaggctggagtgcagtggtgcaatctcagctcactgcaacctctgcctccggggttcaagtgattcttctgcctcagcctcccaaatagctgagattacagatgtgtgccaccacacctggctaatttttgtatttttagtagagatggggtttcaccatgttggccaggctggtcttgaactctttgacctcaggtgattcacccacctaggccccccagagtgctgggattacaggcgtgagccaccgcatctggcactttctcattttttataatgcaggtctgccagtaatgacttctctcagttttttgggtatagatgagaagggagctgggaaaaacctttatttcaccctaatttttctgagtgacatttttgctgggttgtgttttccccctttccaactgttaaaagatgtgatttcattgttctttgttacacatacttttgatgagaaatctatgacatttcttatttttgttcctctgtacataattggtcatcttttttgactgctttcaggatttatatatggtgtgactagatgagtttaattgtgttttgatatttgtcctgtttgggcttttctgagctacttggatggatctgtctttcaatatttttcatttttttcttcaaatagtttctttgcctctgtctccctttctctcccccaccccctggctcccctgttttctcctcctccactttttccctgttcctcttcttgaattcctgaaattcttgctggatttctgtttatagtcccacagcctttggatgttctgttcaagttttttccccattgttttcttagtgccttttaattcaaataatttatcttgacctattttcaaatctactgattttgtccttggctctgatgagtgtactgacaaacccactgaaggtattttcatttatgttaccatgttttttaatctttaatatatccctttgactcttcttttttccattttctctgctataataatattcaccatctattcatgcatatgttccactagaagcctttaccatattaatcatagtaattaaaattaaaaattttagtttcaacattgatgttatagatgagtctgattctgttgattcctttattatttgcttgaattttttcccttgcttttatagggcatctcataattattgatcgaatgtcagacatcatatcatgcatagcaggagtccccaacccccgggctgtagaacggtaccggtctgtgacctgttaggaactgggccggacagcaggagttgagtggtgggcgagggagcattattgcctgagctccgcctcctgtcagatcagtgggggcattagattctcatagtagggtgaaccctattgtgaactgtgcatacgcaggatctaggttgcatgctccttgtgagaatctaaagcctgatgctctgaagtggaacaatttaatccccaagccatctccccaccctccaaccccccagccccacttttgtggaaaaattgtcttccacaaaacagctccctgttaccaaaaaggctggggaccacagatgcatagcataatagagactgaggtaaatatcatagtatttatgtctggaaacggggatgcctcttttctgctaagctattagcttggggtggggggttgagcttaggttggtttgaattccagattaatacgatttccttcactacattactgcttcagtttcctttagttgtaccttgtgcttagggtggctggaggctgtgttgctcagattttgctccgtgctgagcctttgacctttcttctactcttgtacctcagaaaattctctttccacattcttagctctttcctagatgttagaggctcctgctgcttgtttcttagtgcttgtgagcttgatgtatttggggagaaggcaaggtggtttggataggcttgttagtgttcttgtccattttcactcctagccagggctgtttctgtgagtctcagaaatggagtattcttggccatcctgcccctcctcctcatggcatctgattgatatctctcgtatttcctatgtgggattgactatccttcccttccccagcagagggagacctctaatcatctggccccaggagagttcttgttcttcccctagagttttattttattcttgtccctaggatactgtatcttcacctgtgccctgagggaaacaaggtttactgcccttcccctagtttcttatggctattgttttgagtagttgataatcttggtggtgctttgggccttttctgcagtggaggctcctcaccttttccagggtcataccaaggaaagccttctcttgtttcccacttgcacccatctcccgtctttctcaagagctcctcacgtgtgtggctctcagggattctgcatctcacattagtccacacttatcctttatcattttagctgaattattcttacctatattgtatagtatctgacatctctttctcctctctaccacaagtgagctggtgcttattttctctctctccctgaaggtacctgtttgtccttagatttttagggatctttgttgtcctgtgacctcagattgctaatggttttaagaaagttatgatatcatagtttatcgggttttttttccttttcttaaggtttggaggggccctcactccagctttgtgcaccctaggcagaagcaggactgtagacttcttttcagccctgtcttgtacctcagccttcggaggtcacttatacctctggttctggaggattctttgttctgtagttgtaactgatttgcttgttgatggctcttcagctccctgttcttgcttgcttctagcatttaggagaattgagaaagttatgagcttagtgctctgtccctcttccaaaattttttttaacattttacatctcctgttgtcgccaccatttttaactgttattgcagagcttgagatttttaaccactgtaggtaatttctggttggcaattaagatggccctttacaatctgataaggaacagaagtatagcaataggaggagactcctttgaagaatccagaaaaatctattcacatacctcaaatcaggaatagatttcagtaaggtgtagatatacagtgtttttcaaatttttgtcagtcaatcaagaaatacatggttactctcattacgaaagtatacttgcaaaatgaaaatgcatattcagatatttcctcttctccattaaaaaaaaaagaaaaaaagctggagccacacctactaccttgattttatgacccacaaaggaaattgccaccaccaatttgtaaaagtttgtagtgtaggttccaataaaccagttacagtagaattgttgcctcatttgtacttggcttgtgaatacttgggagattttctaactatgttttgttattttttactgttttatttttgtactgaaaatacatcatttcaaaaatggattgtgataattaaattttctcttattaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggtaagtattttattaaattattatttattttatactaattggaaattgctatatgtcaaatatggatgaagactagtaagaattccttgcttgagattttttctgattttttaaatcttctgggtaccatttattatacataataaatgtgtagttccttatttatataacatcgttttgacataggaatattctaattaattgaaatatatatttcatatagtaacattaagtttatgtgcattatatatcataaatatgttatatattaattagaaccttcgttttatatgtcattggcttaagtcttcgttttacctgacttgcaactataatttaaaaatactgaatatataattgaagtttgttttggtctgaagtcatcattaagaaaaggttattttaattttctagagacaaggtcttgctctgtcacccaggctggagtgtagtggcatgatcgtagctcattgtaaccttgaactcctggattcaagtgatcctcccgccccaacctcctgagtagctgagactacaggcacatatcaccatgcacataccaccaagctaattttttttttcttcaagtttttatagagatggggtcttactctgttgcccagtctggtcttgaactcctggcctcaagtgatcctcctgctttggcctcccaaagcgctgagattacaggcattatgtctggcccaagaaaatcatattttcgattgcattgtcattctgtgaatatcagggactttaaggagttagatttaacccctatatgactccaccctaaggcatttcggttcttatttcggcttttcttgtttcattttgtttcggtttttgtttttcccttgctgtcagctgatattttttcctgtgggtgtcacacctatctccataacatcactattcattcttttaaaatgctgtctcagtgttttagtgtatgaactaggtaatcaaatctaaggctgtagtggaataaataggccaagtgtggcaattcttataagcaagaaaagtatttgcgtgttcatttgaatgtatttgggaatgtggagccctcttttgttatttcaaaattctaagttaattccatataatgttgctgttttgtgatcttttaagccataacatcattttgtacacaaaaatgtaaagataaacaagtattccttgttgaatttcttctcttttaaaaaaaattagagttgggttcttgctctgcagcccagactggagtgcagtggcgtgctcctagctcactgcagcctcaaactcatgggcacaagcaaatcccatctcagcctcccaagtagattaaattagtagggacaacaggccctgctaattttttatttttaattttttttttaagacacgatctcgctgtattgcccaaactggtctagaactactggccccatgttatcctactacctcagcctcttaagtagctaatttatttttataaccaaaaaaatcatgtcacttgagccctcttgtacttatacttagaaattactaaaatgttaattttttctttgaacatgaaaattaggtataagagtataaatatagataattatattttatgtcattgaagtttttttttggaatttggaaattggaaaattattttgaaacttcttaaacatattttatttatttatttaccttacaaatataaataagctctctgtccactgaggttgtatagagaaatagggttgtttttcattagggaaagtgagataagggaagtagatatctgtaagacattccagtgatcccatttagctttgttctgaggactagatttttattttatctgtgtctttgtgtttctcagtttttgtggcagaaaattaagatttaatatagacagtaagattttgaataaataatgcttggttgtatcaagtaaaagtttttttttaaatggaggtaaaaccataaatatcaatatatatttaataagtcgtatttattaataaccttaagaatataattctgttatcttacaggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacaggtaagcttttcacaagtatatttgtgtggaatgcaatatttttctaactttttaaagactttgatgtcttgagtagtctgtttacagtgagattttattttattaattatacataacttagtgattctctcttccttaagtatattttggcaaaatcaattatagtctttgcattttaaaaaacctagaaagtgtttgaaaatttctccttaggtaattaggaaaactataaaatttattatctgaggaagtatatttgtgcttttttgtggttcattataaattacatggctatggaaaaaatgaggaatttctaatgtaatatgtttattcactttgcaaatacattatcatcttatcttctctgtcggttgttgctgtggctctgatgctgtaatttaaacgaacatgcagtagcatacaaccttattcgttaacctgtattcgttaagcatagggttaggaattaggcggataaccaaatgttcaaatagttcgagagcttttatactgtgtcctctgtgtttctgtgctatttctaattgcccattctgaatttatgccctattttccaacttgaatccttctctatttatacttctcaactgccctcttccttctttctgtcatttttctttgatataattctcttgcttgtctcttcaccttatttttgtctcattttttacttaactaactcccattctctacttctctttagcttcctatgagtctgtctttccctcctgtgctttctttgatcaattgtatatttttaaagcagctttattgagacataattgacacagaataagttgcatatctttaatgttataccattttataagttttgatatgcatacatttctgacagtttatgtacagttgtattacttcttccttaagtattaggtagaatttaccagcgaagccatctcgtcttagagtttgcttgtgggagatttttaaatgatagttttcatttctttaataaatttggggctattcaagttattttttcttgagcgatcctccctaatttcttaaaagaatttatccatttcatctaagttgtaaaatttaatggcataaagattttcataatgctccttatttattaatatctgtaatgatgtgtcctccctcattcctgatatttataatttctgcctttgtactgatcaatctggttagcgatttatccgttttattgatcttaagcagtttttggttttatttttttttctttttttgttttctcattcattgatttctgattcaatatttattattctgcttactttaggttcaattttgctctttttataagtttttttaggtgatagctaagattattgatttgaaacatttcttcttttctaatatatgacgtgctataaattggagtactttataatattgtgctatgaattttaagttactctataagtctgtgtagctctcttctctctggtattttatcatataaactagctaccttggtttctcttggactctcagctcttatcttctctactctggggctttcctggccttcccctgggtcccccctccctgtaccatggcctgttaattatggtaaaacaatagtaaactgggacaatcgtagggctcacctcatttttttttccaactctttggaatcactatccatttttgatgtcttgtgtcttgaaaactatttttaagtcaattttgtctgtcttttttttgggggggcagggttgtttcaagcaggagtgttaaaccattcatgttactccatcctagatggaaggagaaatttctgtcacttgagcatttattaagcaccaaatctatcccaggcattgtgctaagaataagaaatataatagtgagcaatctttataagggattaataagtaatccctacctcattgggttgttgtggtaggtactgtttaataaatatagtgggctggtgcataaaatgggatcacattttgaaaaggttctagaaattaggtcaaaaggagacaaaactagaggttggaaggataatttggtaactattgcagtaattcacataagaattataggtgacttagtctaaggtaagggagtgaagtagtggagagctaaccagaatttatagtaactgatggttgaatgggtgtgggagttaaaggagaagagaaattaaaattcactttaggttacaggcttggaaatcagcgtttgatgatgatacacttcactgagataagacagaacaatgcagaaaaacccagtagaatagagatagtaattatttctctaatgggcaaagtagcctgaaagtggttgcatgacttctacatggagagatcttgaaagaaatccagaaggcagtggaatatatgtgcctaggtgatgcacataggtgatgttgtttagacttctaggtttaggagttcttagtaataatttgtgctagtcactgaagcctttggaatgagcacagtcacaaagaaagcttgtagagtgggacatatgaagaagaatgctgaggaataccagtgtttaaataattgacagaaagaggaaccctcaaaagagacgaagtaggagcagacagagagatgagaagccaggaaaatgtatttgaggcagcagtgagggtcctgctgatattgttaaccatgaattaatagtgtatcatttttttttcatgcagtacttggtattttgtatttggaatccaacagtcagttggattgagacaaaactgaattttttgccaagcaagtgtgaccgaaggtagtggaacaggattttaatgattgagaatcatgttgatggataatagagaggtgatatagtttggccatgtccccacccaaatctcatcttgaattgcagctcccataattcccacatgttgtgggagggacctggtgggagataattgaatcatgagggtggttcccccatactgttctcatgatagttaataagtctcacgaactctgatggttttaaaaggggaaacccctttgacttggctctcatcctctttttgcctgccgctgtgtaagatgtgccgctgtgtctcctttactttctgccatgcttgtgaggaaggggtccagtttcagttttctgcaaatggctagccagttttcccaacactatttattaaatagggaatcctttccccattgcttgttttttcaggtttgtcaaagatcagatggttgtagatgcgtggtgttatttctgaggcctctgttcttttccattggtctatatatccgttttggtaacagtactatgctgttttggttactgtagccttgtagtatagtttgaagtcaggtagtgtgatgcctccagctttgttctttttgcttaggattgtcttggctatacgggctcttttttggttccatatgaaatttgaagtagttttttctaattctgtgaagaaagtcagtggtagcttgatgtgaatagcattgaatctataaattactttgggcagtatggccatttaccacagtgagataccatctcacaccagttagaatggcaatcattaaaaagtcaggaaacaacagatgctggagaggatgtggagaaataggaacacttttacactgttggtgtgcgtgtaaattagtgcaaccattgtggaaaacagtgtggcgattcctcaaggatctagaaccagaaataccatttgacccagccatcccattattgggtatatacccaacggattatgaatcattctcctgtaaagacacatgcacacgtatgtttattgcaatactgttcacaatagcaaatgcttggaaccaacccaaatgctcatcaatgacagcatgaataaagaaaatgtggcacatatacaccatggaatgctatgcagccataaaaaagaatgagttcatgtcctttgttgggacatggatgaagctggaaaccatcattctcaacaaactaacacgggaacagaaaaccaaataccaccacatgttctcactcataagtgggagttgaacagtgagaacatatggacacaggagggggaacatcacacagcggggcctgttggggtgggaggcaaggggaaggatagcattaggacaaataattaatgtatgtggagcttaaaatctagatgacgggttgatgggtgcagcaaaccaccatgccacatgtgtaacaatgtaacaaacctgcacattctgcacatgtatcccagaactagtataaaaaaaattagaattatattgttttgtgctgtaaatagcttttttcttaataatatgctgtaagttttcatgtcattattttgagtgcataaatttttccaaatattcctgtttttagaaaatctaaatctgccttttgttagaaatttgattctaatatatatacagttttgctattataaataacactatattgatgattgatatctttattacatcagtacttttgtaattgtctactcatttctttgggataattcatttcctgaggatgagttcctagaaatagaattactcagttatagagtgtagccagtttttcctgaaataattttaaaataattgataattgaaaatgcagttgctgggcacgttggcttacgcctgtaaacccagcactttgggaggttgaggatggcagattgcttgagctcaggagtctgagaccagcctgggaaacacggtgaaaccccatctccacaaaaaatacaaaaattagctgtgtgtggtggcatatgcctgtcatcccagatacttatgggactgaggcaggagaatcacttgagcctggaagattgagactgcagtgacctgtgttaatgccactgcattccggcctggatgacaaaatgagactgtctcaaaaaaacaaaccaaaccccagaaaatgcagtttagttacaacttcttagaaagtgcataaagaaaaataggaattcatgtttgtgactaggttctttatacattaatccaacttgactgcaatttagcaaatatttattcattatatggcacatgccaatcatctaagtactgacaaaaagcaaagaataagatgaacatagttcctgccctcatgaagctttcattctaattaaaaatatagaggacataataaactattaaaatgcaatatattaaatgcagtgatggaaaaagtataaggtgcatgtgggagcacgtaggaaaggtgtattttatccatatattgggtagtactgataagaaaagtttttccagagaaagtaatcttttgacataacagttttctttctcatagtttgtccaaaggacagaaatttactcaaagatatatagatgaagatatagatatagatatataaaatacaagtatttattatggtgaagaattggaaaatatgaaattttaatcatagaaggttaattaaaatactagtatagccatttattctgatatggctattaaaattatatatgcatcctagcctaactgaaaaaaagaaaagaaaacctatgtgtgcagcattccctatggggcttttagattccttaacctattaccattaagcggagactgcaagcatgcaggcatatgtaagtttggtgtcactctatcattcattcattaaatggcttggtacaaggcattttgggagatccctgatgaactctcatatttctctcctattgattaaatgattgccaaaattctacagtcatggtgttatatcttagtttaaggatttgctgctaattaaaatataagtacattattgaggagtaacactttgagattgtcactttgaggtacaatgggaggcttctatggtcacattgttacttgaaggggttcaattgacctacatttttcttcattcctgagcatcagtcttacctttataagtgcttggaaaggcaaatatagttcaatttaaattgtatgtattcagctattttaactcatagaaataaaaattgcatatggtgctacttattttttataaagtaagggaatatgtgatattctgttacttacctaaatcagtgagttaaaatgtttttataatgatgtcttatataatgtttgtttacaaattacatagagatattttttttttttttcccgagacagtgttttactcttgttgcccaggctggagagcaatggcatgatcttggttcaatgcaacctccgcctcctgggttcaagtgattcttctgcctcagcctctcaagtagctgggattacaggtgcccaccaccacgcctggttactttttgtatttttagtagagatgggatttcaccatgttggccaggctgatctcgaactcctgacctcaggtgatccacccgctttggcctcccaaagtgctgggattacaagcatgagccaccactcctggcctacatagagataattcttattttaatggtttactatacaacttacaacttatatacttttgcactttttaccatattccaaaattgtatcgaaaaatacatatttttcccctttttttttttttttttttttggagacagagtcttgctctgttgaccaggctggagtgcagtggtgcgatctcggctcactgcaacctccacctcccaggttcaagcaattctcccacctcagcctcctaagaagctgggactacaggcgcatgccaccacggccagctaatttttgtatttttagtagagatggggtttcaccatgttggccaggctggtctcaaactcctaacctcaagtgatctgcccgcctcagcctctcaaaagtgctgggattacaggtgtaagctactgtgcgtagctctatttctgtataatatagaacactcagctcagtgtaagtcacccaggtttctagtgggatagaacatcactcaactcattttgacagataaaaaaaaagtctgatagatattttccctttatacccaacaaattattgatttctgctatttgcatataaaaggataaatttaagttaatctttttttaactacctgaatgtatatgaaacaatttaaaagaatgttatctctacttatagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggaggtaactttttttggatacttatcaatttttgttttgcttgttgaaaaatactgcttggggacataaggcatcatttgagtggaatttgtatatacataatcaccttggtcagaattgaaatagtgattatattaaactagaattcattttaaaatggtcttgatttattcttttaacaaatattactggagataaagtggcaaggaagcaatgacattgtctctgacttcatggaacttgccagtctaatgcaggggttggtggtgatggtgatctggaaggtatagtagtagttagatagtaaaaaagtaatcagacacataattaaaatagttataaattgtggtaaatttaatgaagtgaaggggtggcctgcacctccacacctgtgggtatttctagtcgggtgggatgagagactgagaaaagaaataagacacagagacaaagtatagagaaacaacagtggacccaggggaccagcactcagcacaccaaggacctgcactggcaccggcctctgagttccgtcagtttttattgattattattttcattatttcagcaaaaaggaatgtagtaggaaagcagggtggtaataaggagaaggtcagcaaaaaacgtgtgagcaaaagaatctatgtcataattaagttcaagggaaggtaccatgagtggacgtgcacgtaagccagatttatgtttctctccacccaaacatctcagtggagtaaagaataacaaagcagcattactgcaaacatgtctcgcctcccaccatagggcggtttttctcctatctcagaattgaacaaatgtacaattgggttttataccgagacattcagttaccaggggcaggcaggagacagtggccttcctctatctcaactgcaagaggctttcctcttttactaatccacctcagcacagaccctttacgagtgtcggactgggggacggtcaggtctttctcatcccacgaggccatatttcagactatcatatggggagaaaccttggacaatacccggctttcaagggcagaggtccctgcggctttccacagtgcattgtgccccaggtttattgagactagagaatggcaatgacttttaccaagtatactgcttgtaaacattttgttaacaaggcacgtcctgcacagccctagatcccttaaaccttgatttcatacaacacatgtttttgtgagctccaggttgggtcaaagtggctgggtcaaagtggctggggcaaagctacaaattaacaacatctctgcaaagtaattgtttaaagtacaggtctttttcaaaatggagtctcttatgtcttccctttctacataggcacagtaacagtctgatctctctttcttttccctacaatgaaggacacaaataataggcatggtgctgtagtcaattagatatattaatatagaatttattggaaagatctaggttagaaatactaattttggtgtcaccagcatatagatggcatttaaagccatggaaatatatgaaataatctatacaaaggaagagaaagtattagaagaattcataagttgaaaatgaaaatggcaaatgtgtcaccaccttagttttactttcttattggttgacattgcttcaaagatctctcatggaactgcccacaagttcatatttttttcccttgactggatgaaagtcaaaagtgtgtcataggctttgctgaagtgatagcaacatatgctctgggaggtttctttaagaaacctacttaacaaatccttctccccacctcacagtttccctttctatttctttctgtaaaaattttattgattatgagaaaaccatcattttagagatttcagactttttttcttttttttttttttgagatggagtctcgctctgttgcccaggctggagtgcagtggtgcaatctcagctcactgcaagctccgcctctggggttcacgccattctcctgcctcagcctcccgaatagctgggactacaggcatccgccaccgcgcccggctaattttttgtgtttgtagtagagacgggatttcaccgtgttagccaggatggtcttgatctcctgacctcgtgatccaccccccttggcctcccaaagtgctgggattacaggcgtgagccatcacgcctggccgagatttcagacttttaagtcaaacgtatattcagagcataaaacatgatggcattatgaaaatcttagtgtgtaagataataatggctgctttaacttacagggtaggagatggaagttatctttttaagataaatatttgaagtctatttatattggtaagataacagatagaaactcataaaacatatagaaacttataaaacataaatattatgttccacccaacatgctggggcagttgctatcccactgggcccagttattaggcatatttgtgtggggcagcaaagacactgctttctcatgctcttcccaggtagaatccatacagaatgtcctggtgatgctgccaacaatctgcaagtgcccagctgccttttgaggccaaccctctagggtaaagttggggcttcccttactctaattcacctgagtagttggttagctgctgttgcagctcaccccagagcccagatatttgttctctcctgggcctcatcttctgtgccagggagaggctagaattggttgtgaaatcatttagtctaatgcatccagaccaagtggagcagcttgtgatttctgacttgtcagattttcagtggttgcatacacagcctgtcctgacatgtagatactgcagatcagcagccccaggatccttacagttctttgaacttcctccactgagctcctggcaaaagtgaaggaagagtgccaattaataatcagtatttgaggtgcatgcgatagacagatactaactggaagacatggtttagaagttgtaatatttattttcatcttattatatgaactctttttgcagtgtctgctacatagttacaaactaagtgtcatgaataaagaatgaaggaatgaaagcttaaaaaaaaccccaaacattagtagtatgtataaggtacacatggacttaattttaaaacactaaattagtgtgtcatctttgaaatgcagtcaaagaaagcttggttacaagtaaaacttgttaaatattgtgggattcaaattatctccttggggtcataacagctaaaaattctttttgttgttttgacaaacttagaagtgagccaaactcaaagatcttttttacattatttctgttgtgttagggttctccagagagagagagagagagtgtgtgtgtgtttgtgtgtgtgtgtgtgtgtgtgtgtgtgtgtgtgtaaagagagggaaaagggagagacttattttaaggaattggtgtacatgattgcggatgccaccaagttcaaagtcagtctacagggtaggccagcaggaaggatatccagggaagaggtagtgttggagctcgagtctgaaggcagtctgctggcagaattcttgcttagaggaggtcagtctttttttattgaaggcctccaacttcaatacaaagcaattggatgaggtccacctacattatggagtgtaatctgatttacctagagtctagagatttaaatattaatttcatctaaaaaatattttcacggaaacattttatgtttgaccacatacctaggtactgtgactgagccaaagtgacatacaaaattaaccatcacagctattaaggcaggtcttatgctgttgatttgggactaaatttgtaacagctaggatttgaaattggctctttattttttttttttttttttgagacagagtctctgttgcccaggctggagggcagtggcgcgatctcggctcactgcactctctgcttcccaggttcaaacaattctcctgcttcagccacctgagtagctgggattacaggtgtgcactatgcctggctaatttttgtattttcggtagagtcggggtttcaccgtgttggctgggctgttctcttaactcctggcctcaagtgatctgcctgcctcagcctcccagagtgctgggcttacaggcgtgacccatcacacctggcctgaaattattagctctttgagttagttcctagtttatgtgtggacctaagcatattaaccatttagcttcagtgtcttataaatataaatatcaggattgcattagctgggcatgttggtacatgattgtaatcccagtttcttgggaggctgaggtcagaggttgagcccaggagtttgaggctgcagtgagctaggattgcaccactgcatgccagcctgggtgacagaatgagacccattcactaactacctaactaaataaatacatttcaggatcatattccatagacctaggactttttcgaggttcaaataaaatagttcatgtaaaacacattgtgaactctaaaatttttggtaaaccaaatgtatcattttttattctacatttgtaaaatgaggtgcttactaaccaaaaaaatccaaagtagacagataactactgaaagttcattttaaaggtttaaaattactatattatttggtacattaataacaaatagttctttattcataacttcattggtattaacacctaatttagttctatatttcacaagctactaaagagcacatggtcatttagaaaactgaatattcagtttgtaaaaatgtttaattggtgtggtagaggattgaaacagtctttcatttttctcctctgagaattttaactgcagttaaattctgcaatgaagtagcagtgctaaaaagaacaaatcttttttttttaacagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggtatgtttttaacttcaaatttctttctgctttcctctttctctcttttttcttctatcttcttccctccccttccttctgtcttttccctccttcctcccctctttctccctcctttccttctttctttccttctttttgtttagtttgggcaaaataagatttgtaaatctgtttctaatcagctaattccattcagacatctctaaattgtctatgttattagtcgttgtgttgattttttttctttgaatgaaagttcctagttctgttgtaacaaaattcctcagtatatattcatgttttcctgacttccctgtagctcctcattttccatttttctccctttcccccatcttctccctatccctagtgtggcatatatcccaaatgaatcttttatattgatattaggaatatcaaagtattagaggtgcaaagagaggatgatcattagtagatggtggagtttaacaaatatttgggagatggatggaacagagtagaaggaagcagaacttagaaagagccttcatctaatgttggatccagtgtgctctgtggaatgtggctggtttctgagctcagcaccagcgcatacagagggtcagttagtgctgggatgacattgctgcataagcataaagttctcattctggcattataggggatcctcagacctacctacctcaaaatgaaacctactagttcacaagactcacctttgcaaagccctgaggtgttacacagcatttttactcagggagaatcctaacagaaaaccagctttacatttacagcattgtaggaaaccccacccttactagctggaataatcaaactagtcctttattgttaaatatgaatggtcagatatgaagaaaattgtaaaaaccccaagcatgaatgaaattaagataaatagaatcatgttttctgaaggaaacagacaattgaggtgacagaaaaggaagtagacaaacaaaaaagaagctctgacattctaagaggattttgagaagataatataagaaatggatcccaccaccaccagctcacccaaggataggagagttgctggaaatccaaatattattgctgaaaatttgaaacaaaaacactgaacatgtaattagaagtattgagttggaatatttggttgaggcaatctcccaggacggagaataaaaaagcacagggatggaaaatgtgataaaacttaagagtgatgttttagttcagaaggtccaattccagaatgagtgttacagaagaaataattgaggaaatggaaggcaattctttaaagaagtatagtactctccttttatctgcagggaatatgttccaagacccgtcgatgcctgaaactttgggtattaccaaacctatgtttggatagtacccaaactatattttttcctatacatacatatgtatcataaagatgaatttataaattaggcacagtaagagttgaacaactaataaaatagaacaattataacaatatactgtcataaaagttacgtgaatgtggtctgtctctccaagtatcttaatattttcagacaccagttgacctgaccacaggtaattgaaagtgcaggtaagggtgagctgctgtaaactgtccagacctaagtaaatattgaaggaagctcttagctataatgaatctactgagtttccagcagattgggtaaactaagattccacatacaaacacattttcatgagatgtcagaatggtaaagctaagattttctgaagtttcagaaaaaaaaaaggctgcctgtcagggacttagaaaaaaaatgattgcatgattgatttttgttgttttttatttatcatcaataaaacatgatgaaatagaatccctggatggtagaagacaatggaggaatctattcagaattctaaggaaagtggtttttgaagctcagattctatacacagccaagccatcacccaaaatgtgaaaagaaaataattctcagatttcctgtgactcagttttcttagacttcttcatacccattcgtaaaagaaattagtttgaaagtgtatttcagaaagtcaggaaatctaggaaacagaaaaatatggggttaaaaaaacctaggcctactcaggagtgcactgaaaaggaatctccaaattatctatgtgaataggctagaaattaactggctttcattaaaaagtaaatgagaatgctttaaggaaagaaaaaaaaagccatatggaagaatgtcttatagaagaaaaatagcatgaattccacatagtatgtaggatacagagttagctatattatataactgatacagacaggaaagtgttttctgcgcttaagaaagaaatttctataccatggtgcagaagtgaagtggactaaattttgcataattttgagccattgttagaatgtgagaagagaacctcttatttttcagagatgcactcatcgtgacagtgtagcagcagaggcagtattactgtaaatctcattgaaaaatactacatggtcatagttaaacaacacatggaatacttcttatgtaaataaaaaagtaaatgttatgaactatgataacttagaagtaaagacattactaaccaaagctgtaaagaggaagatggatcaggggaaacaaatagtaaagccttaaagagtgagagaaaatgtctgcaattgatgtaacaagaaatagatgtttgaatatgtcattttaatcgttttcttctggaaatttttacacatataccaaagtagaaggaataaggtaatgaacccacatgtactcatcacccactttcactaattttttttttttttgagacagagtctcgctatgtcacccaggctggagtgtagtggtgcaatctcggctactgcaagctctgcctcccgggttcacgccattctcctgcctcagcctcctgagtagctgggactacaggtgcccaccaccacacccagctacttttttgtatttttagtagagatggggtttcactgtgttacccaggatggtctcgatctcctgacctcgtgatccccctgcctcggtctcccaaagtgctgggattacaggcgtgagccaccatgcctggcccactttcactaattaatatcatatggctactttgttactgcccacactctgctcttcccccttcttcctccagcccataagattattttaaagcaaatcccagatactataccattaattgctatttttccataagcaataaggacattactttttaaatatagtaacatcatcaccctaaatattagcagtgcttccttaagaccatgaaaatatccagttagggttcatctttctcctaaatgtctcattacaaggcctggttttttttaaataatgataaaagtgtcaattcacaaagaagatgcaacaatcctaaatgtgtgtatacctaataacagaactttaaaatatatgcagcaaaattgacagaactaaagaagaaaatacacatatacagaatcatagttggggatttgaacacaccactcttggtaaatgataagatatgaacaaaaaaatcggaaagaatatagaagatttgaacacagtcaacaaaattgacataattaatgtaatacaatgttacactcagttgcagaatacctttttgtttttaaacacttcctggaatgtttacaaagatgcaccattttgtggaccattaaattttctgaccacattggattaaattagaaggtagtaacaataggatgtgaaaaagcttgaacaatttctaaataacccatagatcaaaaagaaatgacaagggaaattaagaagttgtttgaactgaatgatcatgaaaataaaatatatcagaatttgtggaatgcaactaaaacagtggtgaaagaaatttgtaactgtagagtaagatattagaaatgaataagttttaaaatcaaagattaaatcttctaccaccagaaactagaaaaagaataggaaattaaacccaaagtaaatgaaaagaagacagtaataaaaataatagaatccaacaaaagaaaaacagagaaaatgtttaaatgtatattttttcaaaattttagatttctgttcattaaagatacagtaacaagataggagaaacccaagcctcagacttgatgtatgtatcttttatccagagtacattagcacttttataaattaatagcaactttttaaaagcaaaataatgaccaaaagatttggatacttgagagaggatgctatgtaaatgggcagtgaacacatgaaaacttgttcatataattttttttttttttcttttttgagatggagtctcgctttgtcacccaggctggagtgcagtggtgtggtctcagctcactgcaagctccgcctcccgggttcacaccattctcctgcctcagcctcccaagtagctgggattacaggtgcccgccaccatgcctggctaattttttgtacttttagtagagacgggttagccaggatggtctcgatcgcctgacctcgtgatccgcctgccttggcctcccaaagtgctgggattacaggtgtgagccaccatgcccagccgttcatataattatttatcaggaaaacttcacagttcaccagatgagataagttgtagaagactgacaacatcaaaggttgacaagaatgtggaacagctgcaattctcacatacgactgataggaatgtgaaatagtattaccactttggcaaagaatttgaaagttaatatgtacctacctttaacagagcaattccagacctaggtatctactcccaccccaccccaaaataagtgcatatatacacaaaatgactcatttaggaatacgtatagcagacttatttatagtagcccaaatctggaaacaactcaaatgttcatcaataggaggataaactatttcattccatagagtgcatgactagctataagagtgaactacttgtacatgcagcaacatggttgaatctcagaaacattattttgactgaaagaagccacacacaaaatagtacaatctgtattactccatttatatggaatttaaaaaatatacaaaattcgtctatgatgattgaaattagaatggtagagaggttgggaattggctagcaagtgttaagagggaactttctggagggatataagtgttcagtatcttaattgaagtagtgactatgtggaaatatacacttatcaaatttcatcaaatagttcatataagatacatgtatttcattgtatgtaaatttttatcacaattgaaaatacattacctggcataatggtacttttctctgaagttagatataatgagaattagaaagtgctgcgttttcattttaagctcatttaatatgtgcatataatgccttgattcaaaattcaaatgtagaaaacaaattttgaattcttctgattagtagaaaaattttaaaaatgtctcttggttttagttttttaaagtaaaatttgaatactgaattatgtgccagttactgtaatatgcattttacatgtgctattttacttaatctccaaacatactcagtgattagttctatttttccttggaacagaacagaagtaggaacagaagcatcaagaggaaatagaaacaccaagtgttcaattaatattcccaaattattatggaaagagtcctaagccagaagttactgagttttacatctgaattttctaatattttattttcttgaatgtcattttactatacctgtttaataattctattaaatctatttcaagggtattttaatgagctacttttcatgatattttcttttattaaataactttaattttttcaaggagcaactgtggtgacagctgctgtggtagaagtacattcacgtgccttactagttaagacaacactaaacataagcttcaaaactgatgatctcaccatggtgctgtatagtccaggtcctaaacaggtaagtccaggaagaaaagaaaatgtattttcacatgtgaaatttgcataggttgatgtttttaaagtaacaaatgttaatatttaacatttattttgtagtatctgtccctctgagaaaaatgatctttttactttaataataattataactatttcccttttaaatgagttatctatcatatagctaatgtgaaaaataaattgtaaaattaaagtgatatgtatatatttttagcctttcattagagcccttcggagacagaattttgatgtttgttataagcagaggcaataatttgtagtagttcatatcatgaaatacactttagacttgtgtttctttgtaattttgtgttggtttctcctttcataggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcggtatgtattgtaatgatgttctaaggttttacttgagaaatcgttgatatattttacagaattcatctccagaattgcacgttcattttctgagtgcatcctaggttctttaaagcttcaattcagtcagctcgtagtactcggttaacatttaaaatgtcctggttctgttatgtactattcttactggataattgatagattggttgagtaactagaaataatcagtgcaattaaattggtttttacattctttaaattacattctctaatataaatctaatataagttattgttaatccatgctaattgcaatgggaagtacataaaaaattgaaaagaaaaaatatcctgagattcaaactcttataatttattgaacatacacttcctcatttatgatacatttgtgttccagaagtttgtaagtttgttatttggaacactttatggatcttcccaagagacatgacttcagaatgcttttttttgtcagtaaaagagataagaggtctttgagttttactcatatgtttgattacttctaagttactcatacataggaattgttgttattgtgttttccagaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaaggttagttattggctaaaatatttaatatttgttttattgaagtgctacaacaggacttaaccttgattagccttttagatcatcaaagtaaatgctttaagaaattaaaattttatttttcagagtagaaggaaaaccttaatgtgttttcttggaggatgtatagtttgcattttttaaaggtgtcagtatatattgcatttaaaaattatgaaacctatgttagaataagtaattgtacttctcttcaggcagtaatttgaaggaatttgtctagtggaaaaaaacaagcagagcaaataatgaaccaaccataccttttcacaattaagataatatttcaatttaaagcactcatttatttttgttgtatttattcctagcttttaacgtacggtttctctattatctttttataatatgtgatttactgtggtatagtagaaagagtatcaagttgagagttagaaactagattagtttctaggctttccaattaaatagtggagatttcccctcatttaaaaatgttcttatgcctatagcttcttcaagtctttactaagggttgtagttgattcctttgggatctaagattcttttgttttactttttactattatttcattttaatattttcttataaataataaattattcataatatatagcaaatattttaatctatttttatttgttttagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgtgagttaactatttgatcatctgcttaattgtaactattttggatgtagtgtataccattttaggaaacaaaaactacctacatgctttccaaccttgctctgtaaaatgtctttctctctgcttagagagcttaatttagaatattatttaccagctttgaaactctttcattcttccagatgctgctcattattgttagtatttgtgggaatattgtcactaagaagttgggttcatcttgacagttttcagttaagatctactttgactttctaaccatgtcaattccaaattgctctttggacttttaagactttctgccagttgtttgctgtgttgtttcaattttattgtttcaacttttttctcccgtttggatgtttttgctcaaataatgagtttttccttgtctccatgtaacttcatttgaaccttcagccatttgctttgacatacttcacattgatattttactctctagtaacctcttggccttcctcctcttcataactctacttaaaattcattcctttacagacatcttttcaagttaactggctgacttccagcgaatacttacaaaaatatttgagcttctgaaggagtaatagaagcataagtttttgtttgtttctttgtatttttttcctgatgcttggtatgcatctatagaagcataaatgttctaaacattgtcaccatagaaatataagatgtaattttgatacaatgaatacatatatattaggatataagataaactgttgcccaaatttgcaagacagttggccctccactaagcaaagagagagaatagaaaatggagggtataccaattctctcttagtttttgacttagaagttttaaatatatatttcttctattcacatcttttttggcttgaatatagctgtatgaccacactttacttcagtaaaggttggagactgtggtatttttttctgagctaccttgtgctcagataaaacttctattactgtggaagaatagaacagatattaggttctagatgtcctttatatgggataattaaggagtgtattattaagtcactttttaaatagttgtttttattaacttgtttatttgacatacctattactaggaaagtctttaaatagaaatatttttatatttaaacattaatttagtggtattgatttttctctcataggttttgcagccctgtgacttgttttatcaaactactcagaaaggtacagatccacaagtgatcgatatgtcagtaaaatccctgacactaaaggtaaattaaaatataatcatttgaatatttagtgcacttaaaaaaagtagtaaagcctagaaagttattatagcaagtcttttaattgttatgcaaacaaaataggtgtgtttttgaaaatacgtttttatgagatatttacaaagtaatattatttaatacacattttatgaatgttattctatattttattatttacatttgtgtggttaacatctaatatccctaataaatattattgaaattactttatacttcatcagtttaataatatctgcaattcatgtatattaataatatcatgtaattcatggaataatatctgcaagattcatgtaaatatctgcaagattcatgtaaacacataacaagaattatggtaatttaaaaaattttataaacaataaattgtatcttctattttgtggtagtaatgttaattcagtatttaatttctcataatatatatttaatatttcttgacgtagtatgtttgaaagtgttttgtatagacttattaatttttttccatttaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtaagcatatttttccagttttataacagataatgatacgtatggaatattatgacagataatgatacatatggaatattatggaatcttgtgtagctatttaagcttattgtaaatatgatattgggtcaaaaacttttagaaaaaagttttcaaattttgcccttgaataattgcttttatgtatacattccttttacttttaaagtacatgtccacattaagtttatatttcaactgattttatcaacttaaagataatatattattcgacagttgttgattagattcagaatattttttttaaagagttaaattgaggccaggcccagtggctcacctgtaatcccagcacgttgggaggccaaagcagaaggatcgcttgagcccaggagttcaagatcagcctgggcaacatggtgaaaccttgtctctactaaaaatacaaaaaattagccagtggtggtggctcacacctgtagtcttagttattcgagagactgaggtggacgatcacttgagaatacctgggaagtcgaggctgtggtgagctgagatcttaccactgcactccagcctggggttcaaagtgagacccagactcaaaaaaaaaaaaaagaaaagaaaagagttaaagttgaatacccttttttttttaaggatatagacagaatttctgaatatgtggataataatctcttctaatagaaatatgaagaattagaaatatatgccttatacttttatgtaatgtagaatcaaggaaagatgcttaaaaaggggttttatctggactaaattgtgaagagcgaatatgtactatgaagttagccaggtgaggaaaatgctgagggagtgcttataggaagctactgaatggcatgtagactggtttttatatagaagaaataacagggctaaaaaacatggtgggaaacaggatggaagatcatttttaatttaaaaaattctctctgtaggtgcattattataatgaaatgtttggtgtatgggagcctttgcttgaacccttagaaattgatcagactgaggattttagaccatggaatcttggtatcaaggtatatctatatatgtctatgtgtgtatatatatatatatgtattttaaaagactttatttttttaagaacagatttaggttcacagcaaaattgagaagaaggaacagagatttcccgtataccacctacttctgcacatgtatagcctccccctttattaacattccctcatcaacgtatatttgaagactgaaaaaattttccaaaattgagaatgtttataccacactcgacactttattttaatcacaacaaggttcaggttgtctcatcatgagccttgcccacatgcttccttgtttgccctctgaatataattttcaaatctaaggccaatgttgcctatgcttctaatacaattatgtaacaagtattatgttacttgttacataatttagaacaatttagaacataatttagaacacagtttagacattgttctaaatattttaatccttacaacaactcttggaggtagatacagtttttatttaacatgtgaagggactgagaccagggaggttaagagacttcttgaagtaataatagctacaaagtggaaaagatgggatgcaaatccagctgcagaggcgttaaatccactctaaaccactatgctataatgcctgtgtcatcatcttgtaggttgttgtctatcctgagtttccttcatcctttggatgtttgcatgtgtgcaggaatgtatattatttgtttgaaatatattgtggatttatataatcatgagaatcggggcctttaggtggatgaaattttgcttctgaagcaagagactgcagaattactcacgtgtttcctacctaataatgacttggtcaacctgcagacagattttcagtggcttaaagccagttaaagtaacaacagaggtgactagcttagcatgttgagctcttttcatattagatcacttaattttattttccagatattttagatgaaggatatgaaaaggaattccttggtggtttttaggttagaatacacatggtcagcagatctgtgactcctaaaaaatggtaaagggtattgattcttatgagctctaggtttataacactgttctgctactattgtctgcctttgtaagtctctaggtttctgttctttattattagcatgaccaatacattaagttacttttttctgtctgagtttttatgttgctttgaagtatgtgcttttatattcagatcccgggtacacatagtaattttaggtttttatttttccttctaaattgtgtctgccattttactatcactgatgatgacatgatttattttctctaatacttctgtcctttatgaccttagttggctgatgtccaagtaatttcaataaggcaatagaacttactgaaattagaaaagataaaatgtactgacctttctaatgttggtattgggatttgtctagttatgttgtgttcttagaatttttccttatatttctatgatttatcattttagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggtaagaaaagaaatttgaaactttaaatattgagatacttgtctgattgatctgtctgttgaataagaagtttaataacttagttgtcatttgtcctttactgttctccttgtcatttaattttacacatttcattttatttagcataactctttcttattaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttagtaagtagttgaaaaattaccttcctggggctattttgttttaaattacaatttacatgttattttactcttttgtagaatcttagcaaggttttttttgtttttgtttttgtttttttaaaatatcctttctaataggtcaagaactgttttttgtctttgcagtgtcttggttactattgttactaaaactttgtattccaaactctttctttatcctctgcattatttagagcatggcaatttactgctttgttgttgggaggaaaaatattagatctcgccctcattctgcttttatagaccgtggatgtttagatgtttgtgggggttcttttattcacatttggtatccgttgatagtattccaccagttttgcaactgaaagaattctaagtgtgaattcatgcagatggcaatttttaatggctttaggatttataaatggtttttttttttttatgttctgcctgttgagatgaaggttttttcctttgtcttttctgcttcccaaaagtttttcatttttattggaggtgaaatatatacattcttaaagtatcataatatgtagtcattgtgaagttaaatagtcccagagcctcacctacaccactttttgatactctggcatttaagtaattattgaggagggcatcatttaaaagattaattagacataggggggtaggctactaaaatagcttgtgtttctagttagaaaataacatgtaacaggtgtttcaggtgttgtcatagcgttgtaattaatgttcttataaattttacgtctttttttttaacatttttatggatgggatggtaaatgaaatttatgcaagtaagtaattttatccccaatacaacatgtgttttaggtaaatatatataaaattttatttaatcaagtccaagatataaaggaaaagtgacacaagttgttggaaaaattaaaaacaaaaattgtagtcaccttgatatttaccaatgtctaccaaaaggtattatgctctggttattctgacagcaaaccagagatcagtattcttgtattttatagtacttgctctcattactcatttttgaaacgtttgctattgttgtcttgggttaaactcctgaatgggagttttttaattaatgctgtggaaatatatgctggcttcttaaaatatcccttttatggactatatccaaagactctagtgactattatttataagtttaagaatcatctgaaatttctaatatgtaacatatgtaaaattaatatgtaatgaattataataaaaacttttaaacatacttacttaatttagcacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcaggtatgaaatgatcaattttgggggatgtcctgttatgcatatctgtgtgctaataaaattaaaaacaacaacaacaaattattactgaaagaatataaaccgtaacagtaatacagctgatatcaaaaagaagactcactaccaccagttgcgctacttggttatgacgggtggtaggaatttgttcaatatacttcttataattttttaataggaatattttgtaaaatcttcttacggtattttttataaatagtcatcagtgttttgctttaggtctttgtaatgtatttatatcctttctatttgattagataatttttagagaaataaaaaaattttacagctttattgaggtatgtacaataaactgcatatatttaaagttgatgacttttgacacaaaaatgcacctttgaaactgtcatcacagtcacggtaatgaacatatttatttcttagaaaaattttctgtttccccactttcccattcccaggcatccactgatctgtcctcattgtacattagttatatggcctaggattttacataagtggaatacagtacagatggagtttgactttcattcagaaaaattttgtatgtatgtgtcaacttatgtgtatccatgttattacatgcagttacttgttgttgctcagtagtaatctattatatgtatatgccgcatagccattttgagtgaacctttgtatacagtgtgaagttaagaattgaggttttgctttttttttcaccatatggattttttttccagaggattttaggtccttctcatttttatataaatttgagaatcagattatcaattttataaaaaatctggataaaattggcttgtcctttaatttttaaattctgattactcattgatagtatttagaaatacaggttatattaacctctacttgcagatttaactagacttacatattctagtagatttgtgtagatttagatagttatgatagctgcaaatgaagacatttttactttttctttttcaatctggatgtgttttattttatcttgtttatattgcctatcacactggctagaatacaattcgagtagaagtggtgagagcatgtttttgccttgtccattctttcacctttaaacatgatttgtgttgttttgtagatgccttttcttaggttgtaaacgttcccttctattcctagtgtgctgagagtttttatcagagttgattttggattttgtcagatgctttttctgtacaagaggaggatatattttttaatttgttagtatgatgaattacattcactgattctttttaaatattagatcaaccttgcattcctaggattaatctcacataatcatgacgtcttactaaccttttagtatattgttggattttgcatttatattcatgagggatattggtctagagtttcaatgtctgtctttctgtctttcttttcttgaatcttgctctgtgtccaggctggagggcagtggtgccatcatggctcactggagccgcatctcctgggtttaagcaatcctcctatctcaacctcccgagcagcaaggactgtaggtgcacaccaccacacctattctcccatcttgctccgcctctcattgtttaactttttaactcattaaagcagcagtacccaacctttttgacaccagggacctgtttcatggaagacaatttttccacgggtggggggctggggcatatagtctcaggattcctttcttaggaatagaaagctccacccatgtgtgttcccatcccctgcagggacaccaagttaacaactatctacacagaaaaaacaccttcataagaaccaaaaatcaggcaagtactcacagtacctggatttaaccacagatcatcaggcattagttaaattctcataaggagcatgcaacctagatcccttgcatgcgcagttcacgctcctatgagaatctaatgctctggctgatctgacaggaggcagagctcaggtggtaatgctctcaagcctgctgcttgcttcctgccgtgcagcccacttcttaacaggccacagaccggtacagcccatggctcaagggctggggacccatgcattaaagtatatttaacgtggggtttctgtagccaccatgtagttagaccttgttttttttttttttttttaacataatctgaaaatctgtgccttttaacagggataattaaaccacttatatttaaagttgttgttgatatggttgggcttaaacttgctattttttttttctatttgtctcatttgttctttgcttccatcttccctttgttttctctttttttttattaattgagcatttttgttatggattcattttatttccttgttggcttattggctgtatctctttatacttccttgtctttttgttgttgttgttgatactttagggctttattacatacatattgtattagtctaccttcaagtagtattttgccccttcacatacagaatcaaaactttagaccagtatacttccacttctcatctcccacattcgtataattatgttcatacatttttgtgtctatgtatgctagccaccccataatacaagttactatttttcttaaatgaattatttatgttttaaataggtttaaaatacaaactgtatttgatatttattatcactttttcttctttcagtaatctcacagtgtggatctgctggtgatgaattctttcagttttttcacatatatgtattacagatattttcactgggcatagaaatctagattggcagggtttttccccccatactttaaaaatgttgttctgctgtctgctgtattgcattgtttctgatcagaagtctgctttttttcctatatttgcttttctacaaaatgtgtcaatcttttcttcagcagcttttgagattttttttctttatcattggttttgagcaatttggttatgatgaatcttactgtagttttttttatgttccttgtatttggggtttactgaccttaaaaatgtggatttatagttttgatcaactttagaaaactttttgccattgtttctaaaattttttctgtctttgccctctcttctctcctttaggtaccagttagatatacgttagggtgtttgaacttgccccacagctcagtaatgctctgttcatttttacttttagctttttcctcgtttcttttttcatagtttctcttgctgtgtcttcaatttcccttctctttttcagtggccaatctgctattgaccccatctgatatatttttctcaatagtagtctggatttttttgtttttttattttccattgtctctttttaacatccttagtcttctaactttttagtgatattggatataattttaataaatgttttaatgtccttgtctaccaattctattacatgtcatttctggtttgttttattgatgtttcttttcattatggtaattttttcattcctttaatgtacctgataattttttattggttacctaaaactactgtatatatcagaaccagacttcattcttcctgtttcttttagacggatctttactgagccttagataatctacacatgtcctgatcattactcagctgaagttttgacagggaggggacactcagttttccagaattctgtccgtacagctcttgcctctccatgcaggtctctcccctcaagtacaacatgctgtgaatttcagtcacgttggcttccccagattttcagatcttgtctcttcaacttggctgcctgctcctcacacagcagactagaaactcactctccagacagcaagctgggtagtcatagggcttatgtagtttttttgtttttgtttttcccttgtgccgcctcttgccccgtatcggaaactgtggtttgatgtttgttgtttttcttcctgctttttagttgattagggtgggaagctatatctggtccccgttattctagcatggctgaaaacagatatcccttctctttcactttttatttagttaactattttaaaaggtgactaacagctgcactcattactgctgattattttgccatttaaatagttgaacatgaattttgaatttcttacaggtactatgtgtagaaatatttctgttgcttcaaatgtatagagcaaatagtttttctagaattaaaaatatagtacagttaagattattcatttatgaaattcttagttctcatgttttatatgctgctatgaagtttttaaagtagattttggtaagatatagaaagattataagataattgttttactaaacaacttgttattatctattccaaagataaatatgagtatttggaggttttctgatattattattattattattatatattaatcagaataatacatttttgcctgaccattatttgctacttactggatgagataatcttcatacttttctctctaaagaaaattgcaacaattcagtcacctcttcaggctccaattctaattctagttctcttgctatatccaccatatctgcagtgacttgctccattgaagtcctgaattcctcaaagtcgtccatgagggttggaaccagctgttaattttgatattttgacctgttctcatgtatcacaaatgttattaatggcgtctagatgatgaatcctttccagaaggttttcaatttactttgcccagatccatcagaggaatcactatctatgggagctgttgccttaaaaaatgtatttcttaaataatgagactaatattatttaagtcaaatatacaatgttacatataatattaagaagttgaaattactccttgatcaatttgctacagaatagatgttgtgttagcaggcatgaaagcaacattaagctcctgtacatctccatcagaactccagtgacaatgtgcatggccaatgagcagtagcattttgaaaggattttttttccctgagaataggtctcagtagtgggctttaaaaattcagtgaaccatgctgtaaacagatgtgctttcaaagtcagtctttgtttttccatttatagagcacagagtagagttagcatattcttaaaggccctgggattttcataatggtaaaagaacattggctaacttcaggtcactagcttcattatccctttaagaagagattcagactgtccttcgaagctttgaagctaagcattgacttcccttctctagctatgagagtcctaaatgtcatcttcttgcaacagaaggctgttttgtctagtttggaaatctgttgtttagtgtagccatcttcatcaatgatcttagctagaccttctggataacttgctgcagccacttgccacttcatcttgcacttgtgtgttatgcaggtggtttcttcccttaaacctcgtgaacaaacgtctgcttccaactttttttctgcaacttgctcatgtctctcagccttcatacaattgaagagagttagggcctatcttaggagaatgttatagctggtttgatcttctatcctgtattaggccgttttcatactgctgtaaagaactgcccaggacttagtaatttataaaggaaagaggtttaattaactcatagtgcagcatggctggagagacctcaggaaacttacaatcatggcagaaggcaaatgggaagcaaggcactttcttcacaaggcagcaggaaggagaagtgaatgcaggaagaactaccacacacttacaagaccatcagatctcgtgagaactcattcaccatcacgagaacagcatgcaggaaactgtccccatgatccagttacctccacctggtttctcccttgacacatggggattgtggggattacaattcaagatgagatttgggtgggggacctagccaaactgtatcatatccagaccactagagtattcttcctgtcagcaataaggctgtttcactttcttatcatttgtgtgttcactgggttaggacttttaattttattcaaaaacttttcctttgcattcacaacttggctgtttgatgcaagaggcctaccttttagcctatctctggttttgacatgcacttcttaacattaatcatttctagcttttgcttttgatttaaaagtgacagacatgtgcctcttctttttatttgaaagaggccattggagggttattaattgtcctaatttcagtattgttgtgtttcagagaatagggaggtccgaagaagagggagaaagtggggagaatgtccaatttgtggagcagtgagaacacacacatttattgattataacacatatagttaaaatgaaaagattgaaatattgtgagagttaccaaaatatgacagtgaggcacttagtgagcacatgctgttagaaaaatggcaccaatagacttgcttgatgcagggttgccacaaacctttaatttgtaaaaaatgaaatatctgcaattcacaataaagcaaaacattataaaacaaggtatgtgtatatatgaatttactacttttgatagtcaggagaaatggtattattcaaaataaaatttgcccacagttacacagctagtaatcagcactgccagtatttatctcaggtttttttcagtttaacatctatgttcatcctgctatcatattgctgttgtgtagtcataaactttaggaattgttccagcaggatagcttaccagcttacctgcaacacgcttctgtttctttcttacctttgtagtttttgagacacagggtcttgctctatcgcccaggagtgcagtggcatgatcagtgctcactgcaaccttgacctcccaggctcaataatcctctcacctcagcctctgcagtagctcggactacatgtctgcaccaccatacctggctaatcttttaatattttgtagagacagggtctcactatattgcctaggctgctcttgaactcctgaggtcaagtgatcctcctgcatcagcctcccaaagtgctggaattataataggtgtgagccactgcgcccacccacttttatacagacggatgcttccttttcctctgctcccttagacttttcaagcttatgctcattccgttttccagacttttgatctttccttgaaatttcaactactagttattctcagcttccaaccaactttttccgcactaaatttgaaagggaaaacaaaggaagcaatatcagactttggtaactaacttcacattccaaacaggcaccatttagaagcatgtgtttcttaataggctccatttacatcagtgataagttgaatgtgaagtttatttggaattatatttataatcagaaaatatgttggaaaacttgcagttaatgtctgttgtggaatgctctggatgttggttattggtttgatagtggactttgaagtttattgtaatacagatgtctccatccacaccatggaatttaaaaaatatagacatttaaaaatgtttccctcaaattaaaaaaaaaaatacatgaagttgaagtcagctgttttgtttccctcttagtccacattccctccttccttcttccttgaggtaatatcaatttggtgatacgttgtgtatatttccagtaccatattttaaaaactattattcctgtccagaaaatatatacttgtgtttttagtgtcttacagaaatgttacactgttcaccttgttttgctatgttctgttttcattcagatattcgaagtgtaaccatatactgatatataggtcattattttaatgatgttacatgattatatggatttgaagaaaattttcttatttttctattattgagattgttttcattttcatttttttttataatgaaagtggtgtggtgaacatcagtgtcttgaatgaatgtagtgaacctgaatgaatacacatgtgtaaacatttctctaggtatggaactaggagcagaattcctaagaagaaagtacattttcatttttactaagtttttgctgaattattcttcaaagttattttatcaatttacattctaccagtagtgtatgtgagttcctgttcacatcattttcaactgttgatatcaccatacttctgattttttttgcagtttgttggtattaaaagatactccatgaatataatttgtattttcttgattactaggaatgtcaagtatcttttcatctgtttattggtcagtttttccattctgtgaatcatgtttacattctgttcctgttttcctcttgattgcaacttttttaatgatttttaggctttttgagtgtggtggttataaaccctttgtcaagtatattacagatatttcccagcctgtagattgtcacttttatcatataaatatttaaaattttgatttttttctgtgaatttttttctactatttttatctaaacaaaaacttatctttaaacaaattagtccctatcctaaaatcaaaaagatattatcttattcccctgtaggatgcttaaagtctgtttttgagattcctattatataaaactatagagatttttcttgtatgttttaggataaataatatgtttgtttcttttctaatttatataagcaagatgaatattgcctgatagttcctttgttaagatagttacatggacatattttttttacacatctttagattcttagattaatgatactaaatattatttgtttttctttcccagataagaaatcatttttcagtcccactgtctgtttacgaaggggataccttattgggaactgcctcacctgaaaatgaattcaacataccattaggatcttaccggtattttgtctttatcattttatttactctaaaatctcttgtagaatttttagtttctgatttcacatggataactttgatcaaatccatcctgctaatagcttatctaacgtatttaggtttcagtgcacttagatcttaaaaaagaagtattatttaatttattgtaataacttataccaagcacactatatatgcttttctcttaaatataattatattttgattgcaatataaccgtcataagcatagtcatatgattatgagttttaaaaatgtctaatagatcatgcctggtggtttctgaatttatatatactattatgaagtaatttgtacttctcaaaggttttataatacaatttttttgaaattcctttagtaaacaatattttatccttttcttttcatatttgttcattgttcagggttggagttgtaatataaatagaagtatatactatattaattttaaatttttaaagtaattaaatttgatacaatatgttttaagaaaatattaaaattataacaaaatatgagctagtcttatagattttatatcataacaagtaagtattagtcaagatatgtaatctggaattgaaaataatctcttatgtggaaattgaaccttattggagaataaaactgttctcagaattaagcattgtagtttgtttaaataccattttagaatacacactagaaataggtacttacctcaatgctacagaaggacagaggcaaaactgcaaacagtgcttacctgttctcttgtccagaagttcagaatgggatcctcaatgctccgaagacaatctagcagttttaggcacctattttcacatagatcgacctgctaaacctaaagagtgttttattgcttagttcagacttgctgagggaaagaattgtattgttgagagaacaacaaaatagtcatttacagtatctgaccttgctctagagaggatttggggtgggttacaagactagattaaatatggcatgtaagatatatttaaaaatttctgtgaagaactttcattttcttcttggataataaaagttaatgatattctactttttaatacatttctgctatatattttgtatctctgtccatagtagagaaaacagtacctttatactttttccaaggctgaatattaatttgttacatgatagttaatccatcttaatgagaattagtagtgattaattcatcttaatgagaattgttactgactaagtacttcatcttaagtagaattattagtgactaaccagcttggatttctcattaggcattttttttttttttttttttttgagatggagtttcgctcttgttgcccaggctggagtgcaatggcgggatctcagctcccaggttcaagcgagtctcctgcctcagcctcctaagtagctgggattacaggcatgtgccaccatgcgcagctaattttgtatttttagcagagacagggtttgtccattttggtcaggctggtctcgaactcataatctaggtattcttttaatctagtacttcagtataggtgcacttatatttaagatgtgaggttttaaattaacaaatggctatctttctctattctatttctattcttagattaatgatacagataaatatagatgcagataaacacaggaaaacaatttatattttattaaaatatttaagtagaatttaaatatactgattcttttattcatttaacaaatatttatcaaggttttctgtgggtgagacactcaataccaagatgaattgcatgtggctattgccatcaaaagatggatatattacataaatgtataaagtaggaaacagtgggttatagagagttatagaaagtgttagagttgccaaaaactgtggaaaacataaaagggattaatgactgactcctgggcaagatacatgaagtacggtaacatctgtaatatagtaatatggagattagaaggaaaaggctatctaagaggaaggcatgcatgaacaaagataaggaagcatgaaagcatagtgttaaaaggaatagttgggaatttgttggaatgtagagtgcatgttggaagataaaatttgaaagataagttcacagttagatggttgctccctcattttcttgctccatttttataaattttatctccatctattagtttgatctgtttttttcttcttgtctcagataatttgatgttctgtttcaagaccattcacactaccatatcttctcatttaaaacctcctgtcattgattatctttctttcctgttttccttattcattccttgaactttcctttgacgttttatatttctcttactcagattttctcttcagaacaccctttttgggaaaattgtcacttggcaaataccttgcagtctgtctagaaagagccaaccactctgccctcagtctactctaaacatatgttttttggtacctatcacaatgcagtagttatcttttaacattttaacatttcccacctgattatgatcttactcatttgtttgttttcaattttgccttcttgttggtacataataggtccaataaatgttttgataaactggataagtgtattacgattagtttaatttggaaaaaattaaggttttgtctttaagtattagaagtaagagtggaaaatagaatgaaaattatagaaggaatgtagaagtagaataggctatatctgttaactgttttgacaaataatttatatgcttcagtcaggtaagaaggaagtctaattgtttcacagtccagggtgccagtagctggaagtcactgaaaaaggacatgcagaaaagtgggtagagtgggttcagtgttcagtctagcaaatttaaggtgccatcagaaattactacagaaatacatcatagatatttgacattttaggagtagagcttaggaaaataatcagggttgaagatagttttgaccattgttcatctataaaggacagtgttgtctcataactatagctaattagttttacaaatataaaaatatttatgaaatgtttattcttggctacagtgtgggttcaaaaattaagtataaaatattgctgaaatgtaaacaatgtaatattcaaatataaagattaaccatgtgacaaccaataattttgtcaccattttcttaaaactactcttctgcaatggcaaaaaaatccaaaattgacaaatgggatctaattaaactaaagagcttctgcacagcaaaagaaactatcatcagagggaacaggtaacctgcagaatggggagaaatttttgcagtctatccatctgacaaaggactaatatccagaatctacaaagaactgaaaaaaatttacaagaaaaaaacaacccatcaaaaagtaggtgaaggatatgaatagacacttctcaaaagaagacatttatgtggccaacaaatgtatgaaaaaaagctcatcattactggtcattagagaaatgcaaatcaaaacaacaacaagataccatctcacgccagttagaatggcaatcgttaaaaagtcaggacacaacagatgttggagaggatgtggagaaataggaatgcttttacacttttggtggtagtgtaaattagttcaagcattgtggaagacaatgtggtgattcctcaaggatctagaaccagaaataccatttgacccagcaatcccattactgggtatatacccaaagaactataataaatcattgtactataaagacagatacacacatatgtttattgcagcactgttcacaatagcaaagacttggaaccaacccaaatgcccatcaatgatagactggataaaggaaatgtggcacgtatacagcatgaaatactacgcagccatagaaaagaatgagttcatgtcctttgcagggacatgggtgaagctggaaaccattctcagcaaactagcacaggaacaaaaaaccaaacaccgcatgttctcactcataagtgggagttgaacaaggagaacacatggacacagggaggggaacatcactccctggggcctgttgtggggtgaggcgctaggggagggagagcattaggagaaatacctaatgtagatgatcgattgatggctgcagcaaaccactatggcatgtgtatacctctgtaacaaacctgcactttctgcatatgtatcccagaacctaaagtataattaaaacaaaaacactaaagcagaaaaaaaaataataaagtaaaatatcatactgatgtttaaaaaaaaacagcactgttccgcatctattgactacgttttaataacattaaatattgattgaaaactttcatttgattaatgttggaaagcttgcgattattttttcaatagtaattttttttagtttatgaattcagtcatggcatttatttccttttaggcccatgtatccagaaaagccaaattctttcagttatatatgcaagtcacagatgattctatgtggttttctttgcatatataactgatacgattcatgtatttttatatgaaaccatttataagtgtacttttaagatagtaagtttgtaagaaaaatattctcctcttaaaagtcaaacaacttgatgagcttccagaaagttaagatgatatctatttatctatcttttttttttttttttttttttgaggctctgtcgcccaggctggagtgcagtggcgcaatctcggctcactgtaagctctgcctcccgggttctctccattctcctgcctcagcctcctgagtagctgggactacaggcgcccatcaccatgcccggctaatttttttgtatttttagtagagacggggtttcaccgtcttagccaggatggtctcaatctcctgacctcgtgatacgcccgtctcggcctcccaaagtgctgggattacaggcatgagccaccgcgcctggccttatctatcttacttatatcgtaaaaagtatatgaaaatataaaaatgtactacaatattatgaaaggaggtaagtttgttattctaaagctgtaattatatagtttaatatgttttcctttaaaacattttaaactgtatcatttaatctcatgcagatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagaggtatcggcaaactgatttagtgccttcctgtttttgattttgtagtttcagttttttaagattaagatcaataaaaactattttaaagatctaataaaaattagaatactagtaaagaataggtaatgcagatattcttttgcaacaagtatgagaattattattgaaataacatttaagaactagacttcagtgacaaaaaagcatgctacattatgttgtattcttttagtgctgattttcttaaaagattgtatactttgtgaagttgctttttttctttcatactctgtgtggtttcttcctgttgttataggaatccatacatcttaagattttatgtaaatatttcatttgcagtgcttatcaaatggaagaaagtagttcttcattgtcatctattataggtttattttacttttagaattaccatttgctttttaaaaaaatttttttgagactaggtttctctctgttgctcagactggagtgcaatgatgcgatcatagctcactgtagtctcaaacttctaggctcaagtgatccttccacctcagccccccgagtagctgggactacaggtgcatgccatgcctggataatattttttaatttttaattttgtagggacagggactcactatggcttgtcttgaactcttgggctcaagtgatcctcccgcttcggcctcccaaagtgctggaattacaggcatgagccagtacacccagccgtttacacttttctgatacatgtctcttttggaggaaaaagttaacatatttatggttttaaatgtgtatttccatattgaataacaaattatcatagtggttaagaatttgtactttgctgtcaggtagatttgaaattgcatcctagctctgtcatttgctagctgtatgttcttaagcaggctttattgcttttctaaatcttttgctgtggtctgtaaaatgagaataataataaaatttgcttggttaagacatgggggaaatcaaattagattgtgtatgtaaaggatttggtacagtgcctcccagacacagggttgccatttatttatcactctagcactaccaccaccattgttattttgtggaatattatttaacttgtaaagaatcaagaactccttacttttgctttaattaatttaaaatcatgagatgaagagattcctatattataataataggaaaagaataggatagagatgctggaaaaactggtgagatattcagatgtactgtcaatttatatttctgttctcatagaacttttaattggatgctgttagtgatcacattctgtctgccagtttccaaagggtgtgatcagtttttagaaagacaattgagccatggtgtggggaagggactagaggggacaagagcggttaggggactcttaaactgagacgtcatatagtgacatgaactaagataatagaagggagggtcgagggaaatgagcagtttggagagatacatatgacgtaataatataaacagtgattggaaatgggtgatgagggattgtggaggtagtagggattacttattttggattaccatcagtttttgcccacattttacgttgttttgtagttttcaaaataaaaatcacgagtggttaagattgtctttttgtcgttgttttaccaattatagtgttttatgtttataatttccaggggagtttcccattatgttatttaatcttcacagtttgtcctttgaagtaagtcatttagaccattttacaaatacagtagctcaaatctcagattaaataccgtgtagaggtttacacagttgacaaagttagaacttgaatgtaagtcttctgacttgttctgataggtatttcaaaagcattttttgcagcatttggaatacataaatagaattttgaggcatattattctgcaacattttaaattttgttttgttttttttttttttattacagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggtatgcgatgtttattctgtttttcccttgtctttagctacttgtcactttttagtttttaaagttctgagtaataaatattatgaaacttggatagaaataacttgttaaatatttgaggccaaaaagattagaatttaatattataaaggtttagtgcattaacaatataatattttgtttatgctaaaaagtaatttatcagtttaagcaggaatttttaaaggtacctaaattgtgatgtatttggaatatttttttcctaggttcaacttatggtaactgatagtgagttgtccaatcagttttcaattgatactgttggtagtcatggagctgttaaatgtaaaggcctgaaaatggactatcaagtgagttcattctatgcttatcaagaaacttttattttaaatgtttctattaactacttaattaaattttataaagatgttatacataacagtttttgagctgttaatttttttttcttaggttggtgtcactatagacctgagcagttttaacattactagaattgtgacatttacccctttttatatgattaaaaacaaaagcaaataccatatatcagtggctgaagaaggaaatgataaatggctctctcttgatttggagcaggtgggtagatgaatttcaaaaatatacctctttggattctattttctccttgaagttagatacctaaagtcaccatgtaatgttttaactctccccttactccaattttgttttagtttcatgaatctttattgaatatttgtgccctgctctagatagatgggaaggttcaatttttaataattaggtaactaggaatgcccagcttgttaagggaggtagacgtttaacaattactaaccactttggttaaataaagcagccaaagactagataagatgtaaatgcaccaaagagaaggaaattacttattctctctaggaagctattaggaatgctttcagagagtagggtaagccagactcttcttcaagttatttgaggagagtagtaacttagaagtgaaattttgattttgtgccatcattaaatctttgaataagagttttctgaatgactgacagaggttgatggaatattttatttttgaagaacttttattctaaaagttaggattagagaagtttttgctgtttctattcattattcctttttgcatacaaaaccgtccttgttgggattattcttgaagtatattctttagaatttcttttagagctggttttgaaggtaaataccatcagtgtctctagaaaaatctctctggcgggagggacaatgatcgggatataaacccaggcgttccagggggcaacggcaaccccctttaggtcccctcccatttatgggagctctgttttcactgtattaaatcttgcaattgcaaaaaagaaaaaaaagaaagaaaaatctctctggctgccttcagtcttctctttgtctttgatgttctgcagtcacactgctatatgtctatatgtggtttactttttatttacccttcttgaggtgctttacccctagatctgtggattaatgtatttcatgctttctgtaaaatttgctactattgtttctttaaatattgcctctcctccattcttccgtttttttccatctaagccgttaaatcagacatgttggacattcatactctatcctccatgtctcttaatagctcttttatattttccaactctctttgcttcattctgagtaagttctacatggacatctttcctttttttttttttttttttttttttttttgcttttgctgtgtctgaactactatttaagtcttcaactgagtatttgaataattatagttcttattcccagaaatttcaccttttttcaagtatattcattctttcaacaaatattgtttattttttatgtgacttgcaatataatagttaaagccacagtagttaaagcccatctttatgtagtttacgttttagtgggtataaggggaaacattaataataccgtaatcaattagtatatagtatgtttcaaagtgacaagtctaatgtgggaaagtctgatgtaggataagggacattgagagttcaagagccaggggtggtctctaattttatgtaaggtagttaggatgggactcattggagtgacatttgaacagtgccttcgaggaaatgagaaagttagcaattgtcgagagctcagctgaggaggagagagctgagctgccaggtgtcggaatagctgattaacacaaaccacaatgaaagtaacagtcaaacctttaatcacttactgtgatagtacagattgagcatccttaatctgaaaatacgaaatcaaaaatgctccaaaattcgaaatattccaaaatccagaacttttcaagtgccaccatgatgccacaagtgaaaaattctacacctgacactttatgtttttcactttcttaactgtcatttttttttttttactgttaagtacttatgtgtgaataagtgtaagaaaatgattgtttattggtaacacaaattgagagtcagaaatgatggtgatgccacacaaccacagattgtcaacatgggtggttgagatagtgacacattctctttctgatggtccaatatgtacaagttttgtttcatgcacaaaattatttaaatattgtataaaattacttttgggctatgtgtataaggtgtatgtgaaacataaatgaattttatgtttagagttagataccatccccaagatatctcatcatatatatgcaaatattccaaaatccaaaagaagtccagaatgtgaaacacttctggtaccaagcatctcgaataggggatactcaacctgtgtaagcaggaggctaaatcagagaaagcacaattaccacctgtgctggaatggcactggacaagggttaggtggatcagcacaaacatggggattgtctcaccgtctaggaaaccttgaacaaagtgtccggcagttttatggacctgggggatggagtaggacaaagcggaggagctaggaatggaaatatgctgagcactgagagtagacaaaaagtgtcttcactttttgtgaagtgactatacccttgttttaaactgatcatctgtgttccagttctcagctcaggcgctccctttcccccgataaagaggtcctgcaggagctctcaaggaaggcctctgccaaaaagctctcataaagagcttccgaatgaagtgcctgggctaggaatgcagacatggataaaagctttgggacagggttgcttgaatccttaagactgcagtgccctggctgtgcgcaaagtcaggttatattcctaagcatgtctcatatctagttccattaattccattttatggttgaataaaactgtctttaacaagctaagacacttagctctaacaaccaggttctgctacattgtcctcaagtcatgtgatgatgatcaggtatcacacatgagcagtctcactgaaatatatgaagggatcagtctggtcagggcctaagatggagttgacttaatagcttacagacaaggctggttcttcattctttttcttttagctctgtttccagattcttttgtccagtcttctctgtagtaccttgactatctcctattcttttagtttggtttccagatcactcacgttgaagttatttcgtacaattctgagcttctttcctactctgaactttgaatactacttttacttttttacccttatttgacaaccagatgctagatttaatacttgttttgcgtactttgatttctgcctaatttccagataatgttcatacctgattttgatttttagtaactgaatgtacacttgttttaagcctgatcatctgtgtcccagttctcagctcaggtttcttgctgatttttcaacccttctctgtaagatcatgaccacattaaagtctcttttctcgccagcagttcacttaccatagctcttcaatttgctatccactgcttcttgaatgcatagtgctgacaagtgacaatccatcttcaagttgaaagtttacagctgtttaaacaacccaataactagagcagtgttaaaacaggtttttttatagtttaagtctattctgatgggaatattaagatgatttatatatttatggtgaaatctgtttatttttataaacatatataatgtatattttagtgtatccccttttggcctgagtatgcttctagtaaacttcttattcaagtcgaaaggagtgaagatcctcccaaaaggatatattttaacaagcaggaaaattgtattctattgcgtctagataacgaggtaagtttttttttcttttttgcatgtgtcattaggaaagctaaaatatactgactagtattgtatttattttttgtatcaaataattacttctgttgatttttcccctttccccaaaaacgaacaaacatttctttttgtagaaggaaacagagatctaagataatttaattgttaaataaaaagttagttggggccgggtgcggtggctcacgcctgtaacaccagcactttgggaggccgaggcaggcggatcaggaggtcaggagattgagaccatcctggctaacacggtgaaaccctgtctctactaaagaaatagaaaaaattagccgggcgtggtggcgggtgcctgtagtcccagctactcgggaggctgaggcaggagaatggtgtgaacccgggaggtggagcttgcagtgagccgagatcgcgccactgcactccagcctaggcgacagagcaagactccgtctcaagaaaaaaaaaaaaaagttagttggaatgcctggaatactagaatataccacatctggaatgtcacctatctgtaatacagtgattgagattatagatttccagaaatgcagtacaaaattctgaattgttttctcagtcatcccaaaaattaaattatcaagttatgaatagtctgttcttaaatgttattagttaatattcttgggaaaatgattacattaaaatgttttctttttctttcttctagcttggaggtattatagcagaagtgaatttggccgagcattctacagttattacatttttagattatcatgatggagcagctacattcctcttaataaatcacacaaagaatgaacttgttcaatacaatcaaaggtaagattatcacaaatacagtaactcttgatggtgtaagtctagatgatgaggcacagttttttttgataatttcttaagagtataaacactgataatagcattgtagctgtgtaaaacagtgttccattaaaaaatgtacttgaagcatgtaggggtaaaactgacttgatgtctacaatttattttgaaatgcttcaaagaaagaaaaatggaagagctgaagcaagtgtggcaaaagcttgttcattgttgactctgatgaggagtctgtcagagtttgttaggagtctctgaattttgtctatttttgaattttttcatgtgtttaatatagtgtaaatatgtaaaatttcagatttttttttcaaacagtaggtaccctcttgttgagctgtcttggggaaaggactgcttccttaaaggctataattgaatcttcatggtttaggactactcttcaacattattcattttatttgctgttatatcttcttagtgccactacaggttatgcaagtttctgatcctctacttagtagttccaggctgtcttgaatttattttgtttcctttctttctttcttttcacctgttacttttcaacaagcacatatttatcattgcacttccactttccttccactgctaactgtacaacttctaatcattgattaaaatcaaacagacattgagtagggaccacagggctggactagcaagtacctaaaactcgtttggggtagcattctctcatctatttaagatgttaagaaagagggatgcctgttttttttaattatccatattataaaaataataagttgtttctaaacatgtgtgcaagtgtctttttaatataatgacttctcttcctttgagaagatacccagtactgggattgctggatcaaatgatagttctgcttttagttctttaaggaatctccatactgtttttcatagtgtttgtactagtttacattcccaccagcagtgtgaaagtgttcccttttcaccacatccatgttaacatctatttttttttaatttaaattatgatcatttttgcaggagtaaggtggtatctcattgtggttttaatttgcatttccctcataattagtgatgctgagcttctttttatatgtttcttggccacttgtatatcttcttttgagaattgtctattcatgtccttagcccacttttgatgggattattgtgtttttgtttttgttttcttgctgatttgtttgagatccttacagattctggatattagtcctttgtcggatgcatagtttgcaaatattttctcccattctgtgcgttgtctctttactctgctgattattccttttgctgtgcagtagctttttagtttaattaggtcccatctatttttattttgttgcatttgcttttgggttcttggtcatgaactctttgccaaagccagtgtctagaagagtttttccagtattatcttctagaatttttatggtttcaggttctacatttaagtctttgatcgatcttgagttgatttttgtataaggtgagagatgagaatccaattttattcttctacatgtggcttgcccacgatcccagtaccatttgaataggagatagtcaaagtaccagaaagaagactggacaaaagaatctggaaacaaaagagctaaaagaacaagagtgaagaaccagccttgtctgtaaaccattaagtcaactctatcttaggccctggccagactggtctcttcacatctagtcccttcactagaataaggtgtcctttccctacttcatgtttttgtttgttttgttgaagataattggctgtaagtatttggctttatttctggtttctctattctgttccattggtctgcatgcctatttttataccagtaccatgctgttttggtgactataggcattgtagtatactttgaagtaggataacgtgatgcccccaggtttgttctttttgcttagtattgctttggctatgagggctccttttatggttccatataaatttcaggattttttttctagttctgtgaagaatgttgatggtatttttatgggaattgcattgaatctgtagattgcttatggcagtatggtcattttcataatattgaatctaccatccatgagcatgagatgtgtttccatttgtttgttaaatttaaacttttaaataaatattcccttcttatgtaatctcccctgccattatcctagttcagtaaccctccatttcttatctatttgagtagatttttatgcgttgttttgttttatttgagtagatttttcttttttgttttgttttgagacagtgtctcaatctgttgcccaggctggagtgcagtggtgcgatccaggctcactgcagcctccaccttccaggctcaagtgattctcatgcctcagccttccaagtagctgggtttacaggcatgtgccaccatgcctaactacatttgagtagattttttatctatctctatatatctagtcttatctttagtaaatctcccattttccactagaatgagttttctaaaataagaaatataatcatatctctctagtttaaagtttttctttttttacccatttctttaaaaatatacttctaggctgcctttctaaacatttatctttccgtggcctaaatcttaccctatacaaagtgaagtttttttttttcctgaatgctctgggtctttccatgtgtttttacctgaataggtgtttctttcagctagaaaaatgccattctgtaattattaaaaaatcaagaaacaacagatgatggcaaggctgtggagaaataggaacgcttttacactgttgctggaagtgttaattagttcaaccattgtggaagacagtgtggtgattcctcaaagacctagaacccaaaataccatttgacccagcagtccccttcctgggtatgtactcaaaggaatagaaatcattctcttataaagatagatgcacacacatgttcaccgcagcactattcacaatagcaaagacatggaatcaacccaaatgcccatcaacgatagactggatgaagaaaatgtggtacatatacaccatggatactatgcagccgtaaaaaggaacgagatcattcctttgcaaggacatggatggagctagaagctattatcctcagcaacaagaacagaaaaccaaacaccgcatgtccctgcttataagtgggagctgaacaatgagaacacatggacacagggaggggaacaacgcacactggggcctgttgggggcatggtggcagggagaacatcaggataaatagctaatgcatgtggggcttaatacttaggtgtaggttggtaggtgcagcaaaccaccatggaatacatttacctatgtaacaaatctgcacgttctgcacgtgtattctggaacttaaatttaggaaaaaaaaaaagaaaaatgccattctatgtgatcccttcccttgccaccttaatctatgtaccccagtttttgatagcacctttacatatgtagattgcagcattcgtcacattgtgttactttcttgtgagtttgagacatgtacacacagatagtgaatagtctgaggactatggttagtttcccttttcttggaattttcattgcctgtcccaggtagtccagtacgtttttgcataaggaatactctgcaatgaattaaacagattaaaatttgtatgaattaagagcatttttaaatatttttaaaccaaatttatttgataatcaacacatttacatttgattttttttttcatggaaaaatgaagagtatgattttgttttctcctccacatttccttctcttggcttttaaaaaaatatggatgttatttcctgcatataaaagtaatagttgttaaattactgttttaaaaaatactacagaaaaaatgtgaaagaggaccataatccctgtaatccaaatactgtcaacattttggttcattgcttttcctttcctttcctccctcctttgttctctccctccctccctttcttccttccttatgtatctctcacatttgacagctattgtgagcatatcaatttgcttcaaagcacaatttttttttctttctaacttttattataggttcaggggttacatgtgcaggtttgttacatgggtaaattgcatgtcacggggttttggtatacagattgtttcattacccaggtaataagcatgatacccaataggtagtttttcgattctcaccctccttttactctccacccccaaataggttcccgatgtcagttgttccttctttgtgtccctgcaaagcatgatttttactgaatgcgtgatattctatcatttagatgctctacaattaaataaatacttaattgttcagaatttttatttcaacttttataattttagaatcagtttatcttctttttttgttgttgtttatttgttttttgagatggaattttgttgttttgcccaggctggagtgcagaggcgcgatctcagctcactgaaacctctgcctcccaggttcaagcgattctactgcctcagcctcctgaatagctgggattacaggtgcgcgccactatgcccggctaattttcatatttatagtagagacagggtttcaccatgttggccaggctggtctcaaactgctgacctcaggtgatccacctgcctcgacctccgaaagtgctgggattacaggcatgaaccaccgcgcccagcccagtttatcttctaataacgatcctcaacccatttgtaatcattgtaataactagtttataattccttaccatatttttttgtagtatattgtcttctaatgattttttggaaaatacatattctgtttcggttatggataattccttttttgttattgaaggtttcgatacatttaaaatcaattttaagattgaaacagtatctgctagcttacccataaaaaattgtaatgcttttttaccttttcttcaacctctttccaaattcttactttcttgtgaatataatttggtatgttttcaaacagattaatataaaatggttagcttttcaaaatatgtattatttcattcaaggcccttttggtatttgcattgattttaatgttttaacaaaaaaatgactttcttaaactggtttaattgttcactacaggttcctcaatatttctatatcctagttgttaaaatgttgttctgagttcatctctagcttggttggaaaaagtctgagttatttttttagtaaagatttgtggatagtgttatgctattgcttgttcgaaatgtcttattcttacaaatttatgacaatttgacataaaattttaagtgataacgtttttctcaaaattgtataggtattgtgccattgttttttgatattaaacatcattgaactgtgagagtaacatttttattttcttgcgagtgactatgattttcctagatatgtgttagggttttttcccccctattttcttacaaagatatgtctagaatgatactgttttcatttatgtctgatacccagtgaagtcttttaaatctgcagagttaattccttcttctactcagaagagctatattttattacttgtttggtttataacttttgtaatgtttttttctttctgagcatctttttgtgagtcaactgaatttcttagatgtgtatttcatgttttgtgattttaaagaataatttagttactttgtttttgctctagtaagaccaatacttaggaaagagttaccaattaaattatcttagaattggtataaatagggtaaaatagttggaataattttccataattaatttgtattaaaaaattgacaaaacagttttaaagacttgaagacctttatttcctaagtagaacatgtattttctaagtgggaaaataatgagaaatattcattagtgaacccttttttaattgtataaggtaagaatttcagccttgttttaatcagaacgatcacagatctcagtgaactaagaattaatgaagtattattttagtttttttttaatctcttcgtgtacttgcatttaatttaacgcgtatttttgctactgtgtcagttctctcagtgaaatagaagattccctccctcctggtaaagccgtgttttatacatgggctgatccggtgggctctagaaggctgaagtggagatgtagaaaaagccatggtgaagtaacacagaaggatgtaagtattgggttattatggtgttcccagcagccttttttaaaaaaggtatttgggccgggtgcggtggctcacgcctgtaatcccagcacttttgggaggctgaggtgggccatgagttggagatcagcctggccaataaggtgaaaccctgtctctcctaaaaatacaaaattcactttgggaggccaaggcaggcggatcaccaggtcaggagtttgtgaccagcctggccaatatggtgaaactccgtctctactaaaaatacaaaaattagcctcgcatggtggcgggtgcctgtagtcctagctactaaggaggctgaggcagaagaatcgcttgaacccgggaggcagcgattgcagtgagccaagatcacgccactgcactccagcctggcgacagagcaagactccgtctcaaaaaaaacaaacaaaaaacaacagtatttgattttcagccttcctagttttaaggactttttgtggccacacttctgaaaaactgccaaacgtcttcaaaatagtattcaagtatttacttaaccaaaaatgtttaaaaccaaaagtagtcttattttgtttacatcatttgcttctactgtgttataaagaataaagttgtgtttagagaagtgctttcagcattcacctgaaaaacaaatatgttctctgcattgacaatcatactaggtagatttagcttctgtaaggaacatttaaggatccactgagtgaactaaaacaaacttatttctgagtggcaagctatgatgataaagttatgcacatatattttctggtaacattttaaatactttcagaaaatttttaaaagtttttaatccttcaagattcatcttaatttgactcctgatgtttttttttcttaccactggtgattttttcttcctgcttatcagtaggtggtattttctcattgtctttcagtgctgctgttgaggagtctgctgtgggtattgtttacattgtatttaagaggattgcctataagtggcctttcagttttaaaaattcattactattagatttattcaggaaaaaaaattgtactttgatataaaaagtcttattcatttgatctgttgattagtactttgcatatttatatcatagtgatagtttgaagcttataaagataaatcagacattcactgtaaaatattagaaagacttcagtgaaataagttagtcttcttgattctcaatgtggttttagtgatatacatatatatacttagaaagtattacaagtaaggtaagtatccccagataattattttatggtaacaactcacagtttttaatttctgtatattgcaacgtgaaggtatactatatagtaaaattttctgaaaatcagaatattaactagaaattaatggctgaatattaattatgagaatttgctatgtttatcttgtcattgaccctcaaaaccctgatatcagcacatttatgtgagattcctgcagaaatagcctcatgatgaatatacatgctttgtagaacatacaattgagatacaagatattttttatcctgtttgattcagctatgaaaggaaatgtgaatttcaaactgaaacaacttttaatacatatcacattgctgtagtcttagaataaagcagaaaaaaatactttgtgttacagattagcctacgtgggaaggttcaattttattaaaatgtttaaattaaaaaagtaaacaattggcctgtctttatgagtaataattttataacagataacatcaaatgatttcaataatgtaaatttgcaagtattctacaaatattaattcatttagttgccactaaccccatgaagtaggtgccattaatagtctcattttataaatgtgaaatctaaatttcatgttctttgggaccaaattctaattttttggtttttttttttttttggtggttttattctaggatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaaggttagatgcattaaattttggatacatttaaatgatcagtttctaattgttaagaaattgttattgtaaaatctcaaatgatttagtttcagttttgtgctttgactattcattgatactgtggtagtgctagttttaaatgtgcttgagggaattttttgccttttgaaataaagatatggcagaaatcaaatttataaactccttattatgttaatccttccacttatctaaaaagttatatttattcaacttgccaaaagtatgttttgcatatcatacaaaatgcttagttcattttccattaccatctagcacagttcagggtacatatgctgtagctgttggaggattaacatagacaatcactttctaatttgaccttggcactttaagatctaataagatctaataaggtgatcactgtatttatcatttctcgtataagacatcaccattaaatcttttatctctcccttatgtccttattattcctattcataaacagttgttttaatttacatatattagtgcttaatgtgagaatatttcttctgtataaccaggataatgtaattttaatccttttcttgaattaaattcttgaatatatataaaggtatatgatacagatgtaaatttagttttctatgtacattaatctatacgtgtccctgacctcttattgaattgaatcaatgccattttaaaaggaatattaaaatctatattcttaagaatttttattctcaaaaaatgtttttactatttaaatagatcaaatacaccatagatttttaagacctttagacctattatatgttatcttctaagctaagtgatgttaatgcaaagatgaataatacatggtctctacctttctgtttcttaaatgaatataagttctataaggaataaacaaatagaatgctttaataaaattaaacaacttaaatatttaagtaacatatgaaagtaacatatgaaagtgagaaagcagagttagcagagcaagaaattgcagtggcgcactctatatcctagataactattttatacttgtctccccttaaacccccattgtgtcagcttactaccttgcattccacttcactgaaaaaattgaacccatcaaaagcaaacttccagagacccatctcaccccccaatatcacagcttgctatctaccagcgtttgcatactacttgctgtactgacatactctcaacagtttacagtagatatatgtgctcctgtttaaacagatttttctctacttttgcactgtacttcatttcctcttacctacttgaggacattgttccagcagtcctcttcttcatctctcctaagtcaacagcttttgggtctctactgaattgtttcagtgttacttctctcaacataaaaaattctcttgagcctactttccttgctacctgttgctcatttctttctttgcatttataaccaaacacctcaaatgtactgtctgtttcaaaggaacttaacatatcctgtgttctccaactatttttcatccattttctctttaaccactccaaacagggttttgctttcaacacaccatgaaactggttttgtcagcattaccagtgacctccataatgccatatccagtgtagaattatcggtctttacttaataacatttaacacagatccctccttgatgtagtttctttcacgtgacttccagaatacctcaccatcttggtttttcttcctatccagtctcattcattggttccttgtcttctctcaactgcttacattggctaaatgccttgaggctcttagacctggtccttttctcttgtggatttcagttttatgatttcaaatactgcccagaatttctctcttaggtatgtcttctgtcacacctgtcatctgaccttaagacttcatatatccaactgtgcatgcaaaatctctattcagatatctaagagacttcttaaacttcatatgtgtacactaaaccttttatttcctccttctaccaaaactccagctttccaatcagagttaataaaaaatagctccttctagttatgcagcccaaaaatattgaaattgtcttcgattcctctctttatcttacaccccagacctaattcatcaagaagatctgtgctggttctaccttcaaagtgcacatagatctgaccacttttctagtatctcactgttaatagcctcatcagggccatcaccatttttcaactggcttactgtagtacactaacaagttttcctgcttctaatcttgactccactcttttttctttccatccacttcaacacagagtgtattcttaacgaaatgtaagtcagattatgttgttagttgtcttataaccgatcagtggtatctcatctcactcagaataaaactcagagtctacagtggtctacaatgctttacattatttggccccccactataagtcttactttattttctattcctaatgtgttcctgacatgccagcctccttgctcttcttcatatactgcaagtgtgcctcctgctttagctggcctctctacctgaaatgttttcctcctcttgtctgctggataattctctcagctcatttaaggttgccaaaatctcactttctcaatgaatcccccattgaccactctaatattgaagaccccaccactttacatattgcagttctccggatcccccttgccttgtctacattttcttctttcaaaagcattttcacctcctacatattaaattttactaatttattttgtttactatttattttcactcccccactaaaatgaagctccagaatgacagagatgttcactgataacggctgtaacacctagaatagtgcctcagtagtagcttaataggtagtagttgaatgaattcatgtttttaaatttgtaatatgctcacttgtaattgaggctgttctgaaattttagtgaaggtattgtaattcatgtaataaaccagttaaaataaatgttaataacttagtattaaatactatgatttttgctttcttaaataagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggtaatatttttaagtactgatgtgaagttttaattttttgcctgtcgtagtttggtgaatcactagtgaaatttaaggaaagtttggcttccttataaaacaaaataatcctgtcatacataccttgtataaaatgttttaaagaggtgtttatctatattaagaaatcaggctgggcgcagtggttcacacctgtaatcccagcactttgggaggctgaggcaggcggattacttgaggtcaggagttcgagaccagcctggccaacatggcaaaccctgtctctgctaaaaatacaaaaattagccaggcatggtggcaggcgcctgtaatccccgctattcaggaggctgaggcatgagaatgccttgaacccaggaggtggaggttgcagtgaaccaagatggccccactgcgctccagcctggctgacagcaagactctgtctcaaaaaaaaaaaaaaaaaaaaaaaaaagaaaagaaaactttcttttaagatactagatgctaatgatctgttctttgggttagcaggaaacttaaaaatgttttattttttcactgtactttctttaaatattttatttttcctttattcatttttattgtggtaaattttagtacatttatgtaaaaagtaatgcagtgaagctttgtaagaattatatgaatatgtgaattttatggacatgggatattaagatctaaatctaaactaatacaaatatgtagcttactgttttaaaaagtttttggcattaatttctaattctagtcatttatagataaattaattttttcatttggggggacatatttttcaggttcgcctaacccctactggtcataacatgaaaattctgcagccgcatgtaatagctctacgaagaaattatcttccagcattaaaagtggaatataacacatctgcacatcaatcatcatttagaattcagatttacagaatacaggtaagtctttctgaaaatataggcaaaattgtattctaaaggaatgcaataagaaaccagatctattcccatggtctgctttatctagtattcagtttcaatgttgtgctagcctttttttttttttttttttttgagacagagtctccctctgtcgcccaggctagagtgcagtggcggaatctcagctcactgcaaaccctgcctcccaggttcaagcgattctgctgcctcagcctcctgagtagctgggattacaggtgcccaccaccatggccacctaatttttgtatttttagtagagacggggtttcaccatgtgggccaggctggtctcaaactcctgaccccagatgatccacccgcctcggcctcccaaagtgctgggattacaggcgtgagccaccgtgcttggtcaccgctagactttttgattctttttgttcctcaaatcctgttattctggtcaggttgtataattgacatattaatatactgatgtgtttttattttcttagatccaaaatcagatacatggtgctgtatttccctttgtgttttatcctgttaaacctccaaagtcggtcaccatggattcaggtttgtttttatttttagatttccataaaagcagttgtattagctatttgatttactttactataaaaatatgaagtgaaaccattcttgggtttaatttttataggataattggaaaattaaactgcttgaaaaaggaccagcaagtactatacacaactaactttgataagattttgagtgaatcttgaagaaaagattgattagaaacatatattgaaatttttagaaatactaatttaaaaagcagataatctgtaaacctgcgatttaaaaacctttaaagcctttgaatgaacaataaggaagttcaaatctagagtgttttctaacagcagaaactgtcctatgttctccaaataagaataacggacaagtcctttctacccttttctttccctttgcctttcttgtttcctgcatatccctcttccccctactttctcttccctcctcactaccctacttaactttcttctccccttgctttcccacctccaccccacaccacttcttctaaactatcctggggggagtactctttataactcgctcagaagctttttggccagtataatgcgtaagcccttccacctagaggtctggagcaagtccccagaatctgttttcacaaagtttccctgatgattctaatgcatacttctaaactgctaattgtagaattagttatcttcagagtaactatagatagttttaaaaacaatgctagagtctgaaattaagattgtagtagattttgccaatatcagtaattttaactgatatttattatttagtaaatgatttaattttccattgtggtgtatattggaagaaaatgcctagcttttgcttaaagcatcatgggagtaattatatttataacctttacagcaccaaagccctttacagatgtcagtattgtcatgagatctgcaggacattcccagatatcacgtattaagtaagtgtcttaatacatttcttgtatatttatttaatgtttgatttaaatatatgaattgtttgtactctttaaatgttggacaagtcaaagatttaagcataaaatattaattataaacgtcaaataaaaaaatataatgttgtggctcacgcctgtaatgccagcactttgggagacctagacaggctgatcacttgaggtcgggagttcgagaccaacctggccaacacggtgaaaccccaactctactaaaaatacaaaaattagccaggcgtggtggcacgtgcccagagtcccaactactcaggaggctgaggcacgagaatcgcttgaacccaggaggcagagcttgcagttagctgagatcacaccactgcactccagcctgggtgacagagcaagactgtctcaaaaaaaaaaaaaaaaaggcggctctggatgaaatacatctaggtatttataatcattgtttctggattttggatattttattattctcttgtacttgtatttgttttttgtttggggttgtctataatcatatattgttttgaaaaaggaaaacaataatattttcgtcttcactcactacccattccaagaaacagaagatggactgaaacatctatgtaataatctcctgtctaatttcccttaccttgtcaccaagataacctatctttatttccttgctgtttaaaatatagttttattgttcatgtgtacctaaacattatgccttttagttttaatttttttctaatttttagaaaattgtttcaggccggaaatagatgttgggacttgcttttgttcattcaacatttttattaaaatttattcattttgttgtatgtagccatagtttattcattatcactaatatataatattctgttttatgactctgtatgacagtttacttatctggttcctctttatggccattttcatattttgactttgttgctgttattaacagtgttccatgattttttaaaatttagtcaactaaatagtcctaagtttcaaagttctaatattgatctcatacttttttctcatctaatttttgtaatacagttgttaattgatgatttttaaaaaatgttttctactttgtaatacaggtatttcaaagtattgattcaagaaatggatctcaggttagatcttgggtttatctatgctttaacagaccttatgacagaagctgaggtgactgaaaatacagaggtaagacttaaaataataacatttgatggaaaggattagggaaaagatattattataaatttttaaaggtattaaaatgactttgttgcattttaaaaatacaattaaataaattttattactctcttgtggtacatacctttttagaaatcttattttctgatgatagaaaattagcaaacaggaggaaaggcttggggtgaatagcagggagaaaaggataatttgtcatgttcacatcacttttttcctcttttattttcctggattactttggctttgctttcactttaataatttagaaatttagggtatgtccaggatatttaatgggagaaaggataggaaaattaaaaggtggtatcatctgggtgactggaagaccataaaatcatagttataaagtgggtcagatatagtctgtttttcacttgccctcatagattcatggatggagaaagagcaaattagtaacagtctattgaggtatagatcacataccatacatttcacccatttaaaagatagggttcaatgacttttaatgtattcacaaagttgtacaatcatcatcactctctaattccggaacattttcatcatccccaaaaggaactgcctgtgcagccactgatacactttgtgtctttaggtttgcctattctgaatatttcatacaaatagaatcatacactgtgtagtcttttgtgaagggcttctttgacttagaataatgctttcaaggtgcatctatgttgtagcatgtatcagtacttcattcctttttatggttaagtgatattccattatatggatgggccacattttgtttatccatatatctgttaatggacgtttgggttgtttacacattttggcttttatggataatgtaatgaatactggtgtacaagtttttattggacaaaaactttattaaaagtcttaaactatttaaacttaatcaccatgtgattaagcaattccaatcctaggtatatagccaaaagaaataaaattttattagaagtggaattgctcaatcacatagtaaccttatatttaatcatttgggactgttaggcagttgtgcaaagtgcctccaccattttacattcttaccagagcatatgagggctctgatttttccatattatccccaacacttgttactatctgtctttgattctagcaatcataatgggtgaatgtgaaatagtttgtcattgtggttttgacatgtaattacctgatgactaatgatgttgagcatctttgatatgttgattatcctttaatatgttaagtagttaatttgcatatcttatgtgaagaaatgtccattcagatcctttgcttattatttaatgagttatttgtcttttttcttataaaagttatttgcatattctcgatacaggtctcttatcagatacataattttcaaatattttctctcattctgtgtgttgctttttcactttcttgatgttgtctattgaaaatcaaaagttaaagttaatgaagttcaaattattttttattttgttgctcatgcttttggtgtcatttctaagaatccttagccaaatccaaggtcatgaatatcttacgttttacgaattttaaagatctagctcttatgattaggtctttgatcaatttttagttcatttttgtatatgatgtataaggatccaaattattctttggcatgttgctatccagttgtcctattaccatttctttaaaagactatttgttctttgaatggtcttgacaccctagttgaaaatcagttaacaacacacatgtgattttattccgtcgatctgtgcatctgcccttgtgcattgcacactgtcttagttattgttttgtattaagttttgaaattgggacatatgtatcttcctactttgtccttctttttcaagatgggtttggctgttctgagtcctttgaaatttcatatgaattttagaatcaacttgtcaggttcttcaaagaagtcagctggacatctgatagagactgcattgaatctgtaaatcaatttgggaagtattgccatcctaacagtattaggtctttcagtccttgcacatgacatgtttatccatttatgtagatttttaattttttttaacaatgttttgttgtttttcagagtgtaagttttacacatttttcattaaatttattcctatgtattatattcttcttatagtattatgaataaaattgattttttaattccatttttggattgttcattgctactgtataaaaatgcagttgatttttttatactgatcttgtattttgcacccctactgaattgttagctctatttgttgttccgtatattcttttgggatttctatacataagatcgtgtcatctgagaggagaggtagttttacttcattctttctgatctgaatgcctttgtttcttcttcttccctagttgttgtgtctagaaattggtgacacattaaacagaagtgccaagagcagacattcttcttttgcctctgatcttggagggtaaattttcagtctttgagtatgatattgaccctgggtttttcctagacatcctttttcaggttgaggaagttcttttcttagttggttgagtgtttttaatcatgattatatattttgtcattctttttctgcatctatggaaatgattgtacactttttgggttttgttctactgatatgttttattacattaatttttttttttttatttttttttttttttgagacctaggctcgctctgtctcccaggctggagtgcaatgctgcaaaagcaatctcagctcactacaacctccgcctcgtgggtttgtgcaattctcgtttttcagcctccctcccgagtagctgggattacaggcgtgtgccaaaatgcccagctaatttttgtaattttagtagagacagggtttcaccatgtttctgtgtttttttgttctgacctcaggaaaactcctatttgtcactttctctgattttctcctgcaaactattaggtctacaggttagccagtatcttctgtaaatcaatgactttccttttagttgtctttcaccacatctgctgtttctgagagcccttaggctcgaactgcactatatgttataagtgaaattagttcctttgggaagagattaatagttacctgttttaaaacctactttccccatcagcaaaaatccctaaaccaggcctctgaagctggcggtgggaacagttgtgacacccttctatttgagtaacaccccagtttaggagctgagcactatgtgtggtggggtaagaggggcagtggcctgagatgatctcagcttgcctttgctggcatggaaccaccacattacaggcctgggcaagagtgatcagaactctagtattctcagtggtactgtacccaaggcagagcttttttaccctgcacagaggctggacagagaaaggaagccctgccaagtacggtggctcacgcctgtaatcccagcactttgggaggccaaggtgggtagatcacttgaggtcaggagttcgagaccaccctggcaacatagtgaaaccccatctctactaaaaatacaaaaattagccaggcgtgttggcaggtgcctgtaatcccagctactcaggaggctgaggcaggagaattgcttgaacccaggaggcacaagttgcagtgagccgagatcgcgccactgcactccagcctaggtgaccagagcgagactccgtctcgaaaaaaacaaacaaacaaaaaaaaacccataaaggaagcccccgcctcacagttgcactcaaccataacttaacctcagcagcaggtagctgggaacaggatgagaaatgctgacgtcctgttcttcccaggaaggaagtcctccaattgaggactgggccaagaaggagctctgtgttcttgggtatactagtctagagtagaattctggctcattagtctgggagaggggacagagggaatggcctttgttaaaacaccacggattcgcttttcttaccaaattctttaggttttcttaaatagatgtttcttcatttgcttatgaccttaaaaccattcctagaggccttaaatttgttgttgttgttgtttaaattttatcagtttagctggggtgctggtttgaagagcttcccactgtcatttcagaaattgatttctaaatatactttttataaggctatcatttcttatgtttttatgaatatgttaaaatgtgaatcttggggctcatttttcaacacatagaagttacttccgtctgagcatttaaaggagaagtattgatgaatatcaagaatgaaaccaccaatcaattaatgcaaaattgttttcaacaccttctttattttattatattactgatctgtgtaggatgcattaaagcaattacaagtagactacaaaatacaagttgactgtatgattatgtttaaagaaacaaatatacccaagagagtgttgatggtatggattaatgtcattttgggataagatttatagtcacatggagaaaagcttagtgtcttttaatggtttggatagaaatatagaagataatgcttgttggtttgtcagtggcagacagaactgtcctatagatagagatgttactttcccttctgaggcaatcataagcaatgttgagtctggatcttatagaagagttttggcagtgtgtcttctatttgcttaaatatctcatgcaggtaggtccctttagttttaatattttgtgttccttttataggttgagctttttcataaagatatagaagctttcaaagaagaatataaaacagcctcattagtagatcaatcacaagtcagcctctatgaatattttcatatatctcctatcaaggtaggagaaagtcatttttattgtccttgataatctaggtaatagcaaattgatgtagcatttatattgtgttcttcagtaatatataaaatctgtaaatatacaattaaactaagtaacaaaggaattacccttttacatttttatttatttttaaataactttttatcatgtggagccacctatagcatgtatttatgtttataatttgacctaacattattttaccttgattttctgttaagctgttaggtgacaattttcaaaattttgcatatgatgatttgtgtattagttttaaagtaatttataaagtagccttaagaactgaagactgaatggtatcaaatctaagttagtttttagtgcaaaattcctataagctaattatacaataatagaagaaaattactaaacaaccatatatgtagagtatatatgcaatacaatacaaaagtgttttttaactggctattaacttctgaaataattgaaacatatacttttggagatacaaatacctttcagcttatgacagagttacatctcagtaaagccatcatgagttgaaaatcttgtaagtcagaaatgcattgaatacacctaacctactgaacattaaagcttagcctagcctgtcttaaacatgctcaaaacagctgggcaaaatcatctaacacaatgcctattttctaataaagttattataaagaattttgaatcaaaattcaaagtacagtttccactgaaggtgtattgcttttgcagcattgtaaagttgaaaaatcataagtgaaacataagtcatataagttggggaccatatgtatttgagtcattttcaacagcttcaacttttagatttttaatgttattaacaaatatataaaaattaatattttcttaggtttgccaaaagaatgggataggattaaatatcatgctatcttaaattgttgaattgaagatttaaatagagctatgttagattttaaatttcttcatatttctacttagtgattttaacataatccagataactttgaaatcttatttatggtgtagtgaatttaaaattaaactgattttttaagagttaaaattgtcaatatgaagaaaatacttttaaatatttatctctttatctttttagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagtatgtttagtattcaaatctgtaaattgatggaaatatttctattttatatgtccctaaaaatttcgtaaatgaaaaagtgtgtgaagtacgttgcagatcataggcaaaatgaggtttttgcattcaagtgaagtgcaatctgaataacaccaacgtatgatttgctaacccctaattgctaaattacagaattattaaacaatttccttaagaaaaagagtcataggccatgcaagtttcacattttaaaagatctttctggcttagggaaggataggatgtgtatgcccaaagatatggtgcctgaaatgtatggatttgaagctaataggaataagactcttcaaagcatttgcaactagaacagaatgaatgcgataataggggaaatgaaaggatcaactttaagtgttgtaatcaggaatttatattttaatatgagtcataatgaagcttatagagtatctgaccaaagagattcagaatgtctgagttgagactttagaagagaataaccctttcaagtagcatctagaattgattattaagaacagtcgtaagaatcaataagtccaacacgaggtaacactgaacctgaagttaggtaagtgtcaaataaaagtacacaggtatgatgttagcagaaatagtattctacttagcaacaagaagcatagagcttttcagttactgtatcaggtatatgctatggatgggttataagtaagctaatcttagtatatattctgtgaatggagttataagtaagcaggcaaaacctgctgcagctgaacctggccattcgtgagcaacctctttatcagtgtgtcagacattttctatgtgggccatgataggacagaattgggaaataaagttctagtggtacatgaatgggattcacaggatctcagaactctcgaatttacatgaaaatttatgtgtactggtgacttgtctgaagataagatccatgtcttttatcagattcttagaaggttctttgattaggatatgcagagatgtatgtaaaaagtaaatttcctgattggcatgggaaaatgtactagaaggaaaggtttggagaaaagattctaaagaaaataaagccactcattaatattaaaaatactttcttcatacacatgtacagacaatatatttttacgcttttttcaggcttgcattttttgaactcaactatcagttccatacaacatccgatctacagtctgaagtcataagacactattcaaaacaggtttgtctaagattatattacagagggacagagtgatacagactggtaaaaccttttgtgtctatacatatataatgtggaactattgaggaactaaatagccattttcaaattattaaagcatgggtattttcctcagaattataaaaagaaattaagctcaatcactatttgaattttttgtccttatattttttagccactgagagaaattttttgtggatcagcaggactggaaataaataaatctttaaataaaatattaactaatttatcacacttaattaaaaaatgggttcatggaaactattagtaactaactgatgaacacgggatatttttagtgtaactagttgttaagtcagccagatgtatttttttaacagatgtttttccacttctagagagactcttgggttttaggatataacttagagtatctgatatagctgtggtatgacagatcactgagcatgactcaggagatttggatttctcccacttttgccatatacccactatgtgaccctgagtatcatctgacttatatgtttctccaatctataaaacggtggtggtaatgacagtggtcacagataattgtaaaagtgaaagtattttaaatattctagagctttacatgaatataatgtcatattatttttaatactataataccaaattactttttaaaagctaagaatagcgatcaataagcctggcatggtggctaacgcctgtaatcccaacactttgggaggctgaggctggtggatcacttgaggccaggagttcgagaccaccctggccaacatggcgaaaccccatctctactaaaatcacaaaaattagccaggcatggtggtgcatgcctgtagtcccagcttgggaggaggaggcacaataattgcttgaacccgtgaggcagaggttgcagtgagccgagatggcgccaccgcattccagcctgggcaacagagcaggactgtctcaaaaagaaaaagaaaaaaaagagtagtgattaataaaatgagatggtttaggagttgaaattggcattaaaggtgttggcctgagaaaactgggcgtgtgttttaaataatgtataagaaaaaatagatctaattatctgaattgattaatgttcatattttatttttaggccattaagcagatgtatgtactcattcttggacttgatgttttgggaaatccatttggcttaattagagaattttctgaaggtgtagaagcatttttttatgaaccttaccaggtaaaatagttatttttgtggttgtgcaatatgtcactaatacttttgaatagataatacttttctattgttaagttgagttaataagtgcaaacagattttggaacacacacaaaaggacatcattttgcagcaaacaatggtaagaggttttgggggacatttttacccttttcctcaaaatttaaacttaagattttgttaagctacgctgaattgtaagtgttctcttggaatataaaaggtggataaagtagaaagaagatcaccacatcttgctttgcacagtagtgtggaactataaaaataatcatgcaaactgacacctggccaagcaatcttaaaaatcagtgggaaaaattatgattgttctatgtcctttaaaactttttcccaaaagactcctacttccacgtataaatgtatagggaaataaaaaataaagttaacattaattttgcacattgtaattaaaaacattaaaagcattaagaattttaaagtgtttatttgaaatttttattaaagacttatcaagagtagtttgaactgtgcttgcattttgctcataaacttacaatatggaccaagcacctttctgtactttggtgagttgccgtactcctttctaagggtcagcgtctaacattatatccttcacactttcagcgtccagaaatatccctaggaattcttttaatgtgaaactttttgctgatattacttcctctgggacaacattatccatttttgttactacctctttcgtcgtatatatccgtaagctcatctttaaaagtgaatataactcactcactcatttatttactatttggccctttagggagccatccagggtcctgaagagtttgtggaaggaatggcactaggacttaaggcactagttggtggagctgttggtaagaaacagaatatctaccaagtatttttgtgctagaaagtaatggcatcattacttttactaaagataatttctgtcaggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctgtaagaaatttcacagggttgtgaagattttgggaaatatcttttaaacaaacctacatttgcgaataaggaaatagacatgattctcactccttaaattattatttggatattttaagagcagtgggtggtagcatataaaacatgtcagtagcctctaaaacattctgtttaaataaaatacttaggagatctgttaattcttatgctatataaaaagcagaactctgtattttttgtgtaatccaaacttggttcttctaggcatcataaaaaagtattgtaaattttcagttgtgttttccttctagggatttgttagtggcataacaggaattgttacaaaaccaatcaaaggcaagtatagtagttcctttgcaagtctttctaagttgattctgttttcattcttggatgcaattgtcaaaaactcttttttctttccaggagctcaaaaaggaggagcagctggtttctttaaaggtgttgggaaaggtttagtaggagcggtagcaaggccaactggaggcatcatagacatggctagcagtacatttcagggaataaaaaggtaaatcctctttggtgtaagatatgagttaaaatgctgaagccatgagaaatggaatttatctgctctttggcttcaggcatttagttattgtctttgttttgtgctgctataacataccacataataccacagactgggtaatttataatgaacagaaatttattggctcacggttctgaaagttaagaagtccaagattgagaggcaacatctggctagggcctttttgcggtgtcatcccatggcagaaggacaaaaagagggcaagagaagaaaaaagggaaccaaagtcacccttttataaggaacccactcccacagcaacagtattaatgcattcatgggggcagatcctcatggcctaattacctctaattaggccccacctcctggctggggataaagtttccaacacatgctcttggagggacacattcaaaccatagcagttaccagcactacaatatggcaggttgcatatggtcttcctaattcattttgattttttttttttattattatactttaagttttagggtacatgtgcacattgcgcaggttagttacatatgtatacatgtgccatgctggtgcgctgcacccactaactcgtcatctagcattaggtatatctcccaatgctatccctcccccctcccccctccccccaccccacctgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccgcaataaacatacgtgtgcgtgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagttttcctatttctccacatcctctccagcacctgttgtttcctgactttttaatgattgccattctaactggtgtgagatggtatctcatagtggttttgatttgcatttctcggatggccagtgatgattagcatttttgacaaaattcaacaacccttcatgctaaaaactctcaataaattaggtattgatgggacgtatttcaaaataataagagctatctatgacaaacccacagccaatatcatactaaatgggcaaaaactggaagcattccctttgaaaactggcacaagacagggatgccctctctcaccactcctattcaacatagtgtcggaagttctggccagggcaattaggcaggagaaggaaataaagggtattcagttaggaaaagaggaagtcaaattgtccctgtttgcagacgacatgattgtatatctagaaaaccccactgtctcagcccaaaatctccttaagctaagaagcaacttcagcaaagtcttaggatacaaaatcaatgtacaaaaatcacaagcattcttatacaccaacaacagacaaacagagagccaaatcataagtgaactcccattcacaattgcttcaaagagaataaaatacctaggaatccaacttacaagggatgtgaaggacctcttcaaggagaactacaaaccactgctcaaggaaataaaagaggatacaaacgaatggaagaacattccatgctcatgggtaggaagaatcaatatcgtgaaaatggccatactgcccaaggtaatttacagattcagtgctatccccatcaagctaccaatgactttcttcacagaattggaaaaaactactttaaagttcatatggaaccaaaaaagagcccgcatcgccaaggcaatcctaagccaaaagaacgaagctggaggcatcacactacctgacttcaaactatactacaaggctacagtaaccaaaagagcatggtactggtaccaaaacagagatatacatcaatggaacagaacagagccctcagaaataacgccgcatatctacaactatctgatctttgacaaacctgacaaaaacaagcaatggggaaaggattccctatttaataaatggtgctgggaaaactagctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaaacaatggcaacaaaagccaaaattgacaaatgggatctaattaaactaaagagcttctgcacagcaaaagaaactaccatcagagtggacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaactcattttgatattttttaagttgctgccattgcattgtttcaactttatgaagttcccctttatttttcattcattcctagcaggcttgcaggagcagtttggcaagttaagcaagcttttcagttatcttagtttaaatacattaatgctatatatcaattataaaattagcaaatataatctgtatcctttttatgaaatgaagaatggcattttgtatttcttggttcaaactcagtttgtcttcacccttcctttattatcttattttgttataagttgttatagtagtccctcttgatctgcagggatctgcagtggatgcctgaaaccttggacagtacttagccctatatatactgtgttttctcctgtacatacatatccgtgatgaagtttaattttaaattaggctcagtaagatattaacaataataataaaataagacaattataacaatatactgtaatgaaagtaaaataaacgttacttgaacacaagcactgtaataccgcaatagtcaggatgataactgagacagctactatgtcactaatggactggtgatgtataaagcatggatatgctggacagagggatgattcatatcccaggaaggacaaagcagggtggcaagaaattttatcatactactcagaatggcatgcaatttaaaatgtagggattgtttatttctggaattttccatttaatatttttggaccacagttgactgtggataactgacactgcagaaagcagaactgtggataagcggatactagtgtatatgcatatcctttctcttcctttatgcaggtaattttaatacacattgttttttactccaaatgaaatttagtgtaagggtgaaatttagtagtttctttattgttacctgtgtcttagaaatttgtaacacatataacagatgataaaattaatgttaattagacccatcttagaaagttaggtgggtggctgtcttcctaatctttttcctttgtgttttctcttgctttctgctctatagggatatgtattgtcatcatatgagctattcctcttaagccagtatttcatactggttaccataattgggtgtttctggtttcggcatttagaattaaggtgggggaaaaaggaatcattctcctctacctgtaactttaagtttcataaatataatgtgttgagtcgtagtcatcagagaagctcaaaagtcaatgaaacgtaaggaatttgaaacatatgaaggcttctttcaaaagctgctagaattaccttctgtttatctaaaaccttataattctgtacccaggtatattacctttagggattgagggcacaatgaaacatttttagaaaaaataataaagactaagaactattgaaggatgtacctgtgaaaaaagacactgaaagtaaaaggaggaatgggttacaagattcaaagataaaaatataaattggataaatctaattgagctacatgaaagcaacattggaaacattattaaaacataataaaatgcaatttggggagagaatgattggcattaaatattgtcctatttgtaaagaggatgtatttactaatattaggtgaaacagacattaaggcaataaaagcattatttgggataaataaggtaattaggtaatgataaaaagaactaagtaggaagatagtaacaatttcaaacttctactcagttcataaaatagccttaatttttaaaagcacaacttgacaaaactgtaagaacttttcaaatgtacaacaaaggtggaagaacttaatatttttctcaataattgatagatcaggaagacaaaataaaagtaagtaaataattatctgaatagagttaacaagctacctaatacaaacataaataattattcagcacattttagggagcattgtctatgatctagacacttctctaatcacttgagggaccagcaatgaacacaattggcaatggtcctgtgttcatacagcttacattctagtgggagagtaatagacaaaaataagtaactgataaatatatgatatgctaaatggtgaaaaatgccatgaagaaaaataaagcagattaaaggaggtaaggagatgcaaaatggtagggaggagggttgctattttacatattcagtgatcagggatgcttaactcataagattatatttgaggagagacctgaaagaagtaaagggtgagccatgtgagaagaatgtcccaggcagaaggaacagcagttaaaaagccctgatgcaagaatgtgcttggcctatttgagaaacagcaagactagtttgcctggagtagagtgaggaacggggaaagttgaagaagatgttaccagggaacatgcggggaatcacatctcgtagaactcggcaagcccctgtaaggacttaggcttttgcttaagatgagaggccattgaaaggtttcaagccagagaaatgatgtgagctggctgctgcattgaggcgtaaccacaggggattagggcagaaacaacacttaaaaggcttttgcagtaatccaagtgagtgacaatggtgattcgactattagagtactagagattatgtcctgcatgtattttaaagatagtggcaatagcattagttgataaattggatgcaggatatgaaagaaagagaatcgtgaagaataattctaaagtttttatgtgtagtactggaagggtgaggttgtcgttctttttagggaaagggtattagacatttccttttgaatatattaagcttaaaatatctcttagacatccaaatggagacatcacgttattgttgagtagaggagtttgaagtatagagaaaggtccaagctagaggtaaaaattcaagatttgtgagcctataataaggtatttgaaaccatgagattggatgagatcaccaagggaatgagactgaaaagagaaaaataaggtccaaggacttggctttcaggcacaccaactcttagaagttggggaaatgaggaagacccagaaaaggaggctaaaaagaaatggtcattaagttacctaaaaaattttagggtcagtttgtcaatttctacaaaaaaggtagctaggattttgatgcagatggcattgaatctgtagttcaatttggggagtgtagccatcttaacagtattatcttttaacctgtgaaaatgcaacgtctttccatttatttaggtcttcttgaattgctttcaataatgttttatagtttgtaatgtacgagtcttatacttctttttaaaaacttattcctaagtatttttgatgctgtttttttttttttttttttttttttttgagacggagtctcgctctgtcgcccaggccagactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtcccgatctcctgacctcatgatccacccgcctcggcctcccaaagtgctggtatgctgttttaaatggaattgttttcttaattttattgttggattgtttattgctggtgtgttgaatacaactgtttttctttatatttgagtttctgcaatcttactgaacttgtttattagctctaatggttttgtggattcttttgggttttctatatgtaagagtatatcatctgagaactgaggtaactttacttcttcctttctgatctggatgctttttttcttgcctagttgtcctggctagaacctctagtacaatgtgaagtagaagtgctgagagaatagacatgcctatattgcttttaatcttagggggaaagctttcagatgttcaccattaaatgtgatgttagctataggtttttgtgtctttatcatgaaaacatgttagattttatgaaacgctttttctgtataattaagttgatagttggtttttcctttgtttcactaatgtagtatattacattaattgagtcagatcttaaactaatattgcatacctgggataaatcccatttggacataatgtgtaatcgtttttatattttactggatttggtttgatagtattttgttgaggatttttgcatgtatatttataagggatattggtctgtggttttcttgtgatgtctttgcctggtatgggtatcagggtaatattgtcctcacagaatgatttaggaagtgttccctcctcttcaaatttttggaagactttgtggagcgttgatgttaattaaaaaaaaaatttggagaattgatcagtgaaaccgtctgattcttacttttatttctggtgagttttaaaatgacaaattcactctctttacttggtaaaggtctagttaggctgtttcttgagtcattgtcagtagtttttataggaatttgttcaattcatctagatgttctaatttgttgatatatatttattgatcatagtaaatatttactagtattctcatataattatttttcccttatatagtatttattcctagtattcccttataattattttttgtttccataagattggtagtagtgttccctctttaattcctgttattcataatttgggtcttcttttttttcttggtcagtttagtgatggcgtgtcatttttgttgtccttttcaaagaaccagtttttagtttcattgattctattttttctattctctatttcttttatctctgctctaatttttattattttcttccttctgctagctttgggattagtttgctttttctactttctcaacttgtgaagttatattattgatttcagaccttcttttttaatgtagacattcacatctataaatttccctctgagcactgtctttgctgcatcttataagttttggtgtgttgtatttttgcttttatttgtttcaaagtagtgaatttcttttgtgatttttttctttgacattttgttatttatgcttctatgttttaatttccacacacttgtaaatttcataaatttctcttatttacacatttctagttttcttccatgtggtcaggtatcatacttgtatattttcagtccttttttttttttttttttttttttgtgagatagagtctcactcttgtcacccaggctggagcagtggcgtgattttggctcactgcaacctctgcctcccaggttcaagagattcccctgcctcagcctcctgagtagctgggattacaggcacacaccaccatacccagctaattttttttttttttttttgagacagagtttcactcttgttgcccaggctggagtgcaatggcgctatctcagctcaccgcaacctccgcctcccaagttcaagctattctcctgcctcagcctccctagtaactgggattacaggcatgtgccaccacacccggctaattttgtatttttagtagagacagggtttctccatgttggtcaggctgatctcgaacttccgacctcaggtgatctgcccgccttggcctcccgaagtgctgggattgcaggaatgagccaccacgcccggccatttttgtatttttagtagagatggggtttcaccatgttggccaggcttgtcttgaactcctgacctcaagtgatctgaccacctcggcctcgcaaagtgctgggattacaggcatgagccaccacgcctggcctattttcagtagttttatatttacattcaatgttagccaaaaggccaagaagcaaacagtaattttatattattgagacatgttttatgacctaatagatagctaatactgaataatgttccgttgcacttgagaagaatatatattctgttgttgttggtttgaacgttctatagacatctgttgggtctagtggattatagtgttattcaagttctcttttttccttgctgatcttttatctagttggtatccatttttgaaagtaggttgctgaaatcttcaactattatggtggtattgcctttttgtcttttaaattcttagtttttgttttgtgtatttggggcttcttttattagctgcttatatgtttataattttttatctttttgatggattgacccttttttccttataaaatgcccttctttgtgtctaataagaatttttttaaaggctgtttttttctgacattagcatggccactttagctttcttttagttactgttcactttgcatatattttctcctttttagttgcaaccagtttgtgtctttgactctaaatcaggtctcctgtggatagtatattgttagatcatattttttttatctattctgtttttatttttttacttatgtatttattttttgagatggagtctcgctgtgtcgcccaggctggagtgcagtggcatgatctcggctcactgcaacctccacctcccaggttcaagtgattcttctgcctcagcctcccaagtactgggactacatgcacatgccaccacgcccggctaatttttgtatttttagtagagacagggtttcaccatattggccaggctgatctcgaactcctgacctcatgatccgcccgcctcgggctcccaaagtgctgggattacagacatgagccaccacacccggccctattctgttttcagttggagaatttattcatatgtatatgcccatgcatgtgtatacattatgttagcggtccccagccttttaggcatcaaggtctggtttcatggaagacaatttttccacagaccagacaggagggataatttcaggatggaactgttccacctcagatcatcaggctttagttatattctcataaggagtgtgctacctagatcccttgcatgtgcagttgacaatagggttcgccttcttatgagaatctgatgccgctgctgatatgacaggaggtggagctcaggcagtgaaacttgcttgccactactcacctcctgctgcacgactcagttcctaacaggctatggaccggtactggttcaagtcccatgggttggggacctcttaataaatatttgttgaatatgtgatacttgttgagtgaacaaattgagtggtcacttatgaccaaataagcaaaaatgttaaatataatactaccatacacaatttagccgtatgtggtatgtgttttttggttttttgtttgtttttagacagggtctcactctggcatcctgattggagtgcagtggcatggggctcaaactatcctcccacctcagccttctgagtgtctgggacttctgctgcataccaccatgtctgactagtttttttatttttttgtagagcagtgtatgctgcccaggattggggtatgtgtttacagtaatacacatcaagcccagtaagaatgtgaggactgtgagagtatttgaatattagaaaactatataatgtgatttataacattaatagattaaggaaaatataccatgtgatcaaaacaatgccagaaaagaaattcttatttaaaattcattgcctatttaagattttcaaaaacagtaacaaaaaagaactgttggtaaactaaaagtagcaatgaactttcttgacttgttaaggggtgctttaaaaaaaaaaagttgctgataactatacttcacagaaaactcttagaagctttccgtagggtcaggaatgagacaaggatgcttgcaatccctttttgtttatagcattatactaaagaaactagacaacgtaataggaaaagaaaaagcaacaattgctaatattgtgattattatcacaaagaaagttctagagacttaaacttctctatagttctgtatttttctagagaacttacactgtttatgttacaaaaacaatttaaaattagagaatgttgtaatatttttaatctgaaataagattgtttttagtaattgcattttatagtttatttacaagtttttgaataatttttaaaataaagttatattttttttcctctagagctacagagacttctgaagtggagagtctgcgacctcctcggttcttcaatgaagatggagttatcagaccgtacaggttgagggatgggactggaaatcaaatgttacaggtaaattaagagctatcttataaattaagattaatttagtcaagttagattttttttaagtagccatttaatatatattaaattatttgggcttttatctattttgcttaattccacttataagtttcttatatttacttagattttaaagtacatttatttactataagatttttttttcttttttacaggcatcaaaaagtttgatatgaaaagttaatgcatgactttgcaagtgaaagccaacagtagattttagtcttaaaatttacaaactacgtacagctgtttcagtattttgaatacaaagaaaaccttttgtattggtaacttttaataggaattttaatgaatctggtttttttatagggtgttcttagttctgcactggatttgctagatttgttggaagcctttgtaccttatgtatcctcgtcattggtggtacttacttaaccaattaaaccatttctgttgtggggttattaaaccactggtagcttttataccagatatataatccttatatccaattacacatgaagaaggaaaagcaaaactcaggaacactgctattgtgaattactcttggattcttgtgctttgcctttgaaaatgcttaaatggccatgaccctcttcctgctttattctagtgtagtctttataaaacttgtgggatttgataagcagttcacatgcaaaccagtatcttttaataatacaaagtagcatctggaacaatagacagtttgaagttagaatctgcttagacaactttcttacttggtaaattcgactttttaaaacctggattatgctgtaggtaactagtaatcatatataggctataccagtgtcatgttgtttctgtggtttagaggtggaatactaaattaaatcatttgtttgaaaacaaacaaggaatcattatgttatgtaggcttgcagatactcatggtagcaataaactgttggaatatgaagcttcctttatggctttaatattttaaatattgtgatatttaatgtgatcagagtaaagatttaaacttcagtattttacctattgcagggcatatagtattgcataaaatatacttctaactctttctctgaggcttctaatatacaaaaatgtaaccatagagttaatatgcaatatttagttaagtgattttatactgtatttaaaatgtttttgaagcatcaaaatcattgtatattgggatagaactggtaatctattaagaggttgtgctctaatggacagattgtgcagtctctacaatgacagtgtatcgttctttggaagatagtaaatttgcagaagtcacccatggctgatacagtcaaaacatgtatttctacccaatacctgccttcccttgttagaacgcatttaacaagttactaacattttactagactaaaaatcaaatatagtacgaagtaaggatgagtgttgaggagagtttaggaatatatcctcattataagtgagcacgttatgatacccacaaggaagccatgagataccaataatttctcatggttgataatttgattttagtgaagcttctcattgttttctgaagctttaaactttgagatgtaaaaacatgacttttgactgtgtacttttaaagatacatatttatttttaataggtcagtctcatcattaatcactaaaagagctatttaaatgactaaaaaccacagcacttgtcagccattacttgtttttcagcaagcatttacacagtattagctgaaatatttgtagggattcaccaagtaccttgggatgttgcagttagcatttttttcttacaggtataaaaagtggattgttgttttgatggtggtgggttttgtttttttttttttaatcaaagctctagtgtattattagcaaacacttaaaaaatatgtaaataccagtactgtggaaaataattagatgacacataaactggatttaaaatccatctcatctgcctagattttatgtaagtgatataatgaaggtgccttaaaatatttgatactttcaaatgtttctcatgttattttcttattttctaaaaaagatgtattcactaaattatatacactcatataataattaaatataaaatacattcttttattgtgtacctttctatctagaaggtagcacattattacagtgtttcctgctggtcaaagttgcctattagagaaatagaatggtaattttaatatattcacaaaataccttattgatatcatcaaaccaatttatacattgagtttgtaccaactagtggaattgtcttaggtctattaagttatggaatattatatccataattacagtctgagtcatagctgaaaaaatctgctttaaaattattctcactctttgaacatttcataatcttacatgttttcaagcaatttgccatactctactaacctttgtgcttcttttttcctttgccatgcttacagaaaattcaattctacagggagtggattatgactcacagtagcagtagtgatgatgatgatgatgatgatgatgatgatgagtcagatctaaaccattaaaattcatatgttctttattttacttggaatgtttcattaacatgttttgtatgacttataccataatgcccatatgtccatttatagggaggtaaaacacattttcttttaaaatgttttcctacacattttcataaagcaaaataattgtattatttaagcacagaaaaaaatgtatcttacatccaaagtagggagggcatccaacatattatagatttgcttttatatattttatagctttgtattgcatagtttgtctttaagagttcaagttagacttaaatataattttgatgttcactggttttattttaaattgccttcttatttgttagcaaaatgcctttttttaatggtctctgtaaattttctgggctttaatgtaatgccactgtgtaaaaaaaaaggaagaaaatagtaatagccatttaatgttttatatttatcattttaaagatatttttgtcaaatttcttttaataataataaacatatgtaatctaa

SEQ ID NO: 1480 - DNA, 205562 bp, Homo sapiens
tttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggtaaggaggccgccgccgccgctccccggcctctcgtgcttcccggccgtctcgctgcccgagcggcgtcctgcgttctcggggcttcgagcaccttgctcgccgggtgcagccacctgccgccgcccgcctgtgggtcaagttacgtaaagccgggcggcagttccctggcctccgccctcgagttgtttatattttgggggaaaggagagggtcatgagtgcgggatgaaaaggtctatattttccgagcggagcggacttgccgtgggctccgtgggtctggcgttcaagtcccggcgaggggccgttctctacccctggccccgcacggtccggctttagccgcgcggggcgaggaggcgagacgacgccttcctgggctgggtcccatccctgtcctttgcccccctgggtttatgacgaaggccccagaaatcccccgcgtgttgcatgctgcctcgcacgtgaaggcagggcgctgtgaccggggacgcccgcttccttgcttccccagcctcaattcctggcttcacccgtggtgctttctgctctcccccttccggccctaggacccggacgccggctctctctcgcctgggttcggcggataacaaaaaggaaactcaagtgcaaagtaactcaaacagttgcttgtgtggttgcagttaacagcctgacctaggaatgtgtaacattttcaagactttaggatatgtgggtcagagtgaattgccgaattttaaagaaaaaccagggcgtgcggtgcaacgtctcagacctgcaaaagaccgggctgaacagggccctacgctgcctaggtggtgaaggaccgagctttccttgtgtccgtttagtgtggtattctgccttagtgagagcctcatttttagtgtttccatctgtttttgcattatgcgcttgtttattttaaacacccgctagaaattagactcctttgtgaaatgaatttcccaggccaaagtgagggttaattttgtgtgtgaagtgtgtgtgtttaaatatatatttaaagtaatttattcttgtctgtgcacacacttccagtcttcttctaaaatacttaccttgactcttctcgtttatgagataatgtaaacaggtagtttagtttgattttaaagaatgttactaccgtggggacctagtatcatgatggagagtgagtggactacaaaagctagggatatagtgatagctgctcagcctgtttgattagtacaagaaacttgcagtctgtttatgctgcttcttagttgcaaagtgaaaataaaatttgtctcccatgtacctcagaaggaagccttaagaatacttgaggtgaactttgatctgtagtggagtcttgcttccacattcagggtggaggtttgtctagagtgtgattaatcaacttatttatttgtttaaaatttacatgcagtaaaattcactcttgtgatacagttctgtcttgacaaatgctaagaggcatgtatgcaccaccacaataatggcacataaaaggttcatcaagcctcccgaattctctcagctgctcctttgcagttgatctcaccccgccaccacgcccggctaatttttagtagagagggggttttgcaatgttggccaggctggtctcaaactcctgacctcaagtaatccgcctgcctctgcctcccaaagtgctgggattacaggcgtgagccactgcgcccgcctgactgtaagtatttatctgtttgctggttgaagaatatttcagtttttggaggttataaataaagccgtcataaacattcacgtacgggtgtttgtgtgaacataattgttatttctcttggataaatacctaagagtggttttaaattgggttgtacgttttttttttttttttgagatttatttcatataccataaatttcactcttttaaaatgtacaattcagtgttttttagtatagtcacaaaattgtacaaccatcaccactctctcattccggaatatttcagcaccccaaaattaaatcgtatgtccattaggagtgactcccaatttcctcccttctcactactccacctctggcaaccactaatctttctgtctttatggatttggtaattctggacatttcatttaaatggaattatatgatatgtggccttttgtttctggcttctttaacctaatgtattttcaaggttcctccatgttgaaggatgtatgactatttcatttgctcttagggttgaataatattccattatattcatagaccacaatttatttatctatactcaccagttgctggatgtttagattattcctaaacatccaccttttggatattatgaataatgccactgaacattcatgtacaagtttttttgtggatgtatgttttaaattctcttggatatatacctagaagtggaattgctgggtcatatgctgactttgtgtaaccttttgaggaacagccaaactctttttccagagtgtttgttttcttatggttgagttttgagagttctttaaatattaaggatacaatttcttcatcagatatgtaatttgaaaatactttctcagtcttttcccattttgtcttttgcagagcatacatttttgattttgggaaaagcccagtttataaaacatttcttttatgaatcatggcttttggtattcatatctaagaaatcttttcccaacccaaagtcaaagatgttctcctgtgttttcttaaggaagttttgtagttttaggttttggatttctttttgtataaggtgtgtgatatgtgttgaaggttgaggttcatttgtttgcatgtggatgcaaatatccaattgtttagcaccacttgctaagaaagaggatcctttctctattgaattatctttgcatttcgtaaaaaaaaaatcagtagacttaatattgtgtggctttagtctgtctcaatctgtgtgtctatcatttcaccaatactacactgtcttgataactgtgtctttgtagttagtctagaaatcaggtaatgtgatccctctaactttagtctttaacaaataatttaaaaaataacaagtcattgtccaggtgtggtgctcattcctgtaatcccagcactttggaaggctgaggcgggaagattgcttgagcataggagtttgagattacagtgagctctgatcatgccactgcattccaacctaggcaacagacagcgagactctgtctcaaaataaaataaaataacatgtcagtgttttatttatagaaattggttatgttttgataaatgaaactttaaataatagctggagtatttttttaaaatattctttgagaatttcaaaagtagtaatttgataaatttggaggattttttaaaaacattgtttgaaaatttctgtaatagaaactaggtggccaggcatagtggctcatgcctgtaatcccagcactttgggagactggggagggtggatcacttcagaccagcctggccaatgtggtgaaacctcatctctacgaaaaaaataagatacaaaaattagctgggtactgtggcgctcgcctgtaatcccagctactcaggagactgaggcaggagaatcacttgaagctgggaggcataggttgcagtgagctgagatcacaccattgccctctagcctggccaacagagcgagaccctgcctcaaaaaaaaaaaaaaaaaaaaagaaactggatgctgcataggaaaattttaagataatattttatggtctaacgtgaaggacctattggtagttgtaaatgtgtgcttttgctaggcttctgaaataatccagcaaatttcaatattagcatgttactataatagtatcaattagtattcagtcattgctaataatggatggtgctctgaaaatttgttgctgagatggattctttggaaatcagaatgcatttttcccatggaagcattcttatatatgaatgaggacttttccaaaaacctgtttaactataatgcagcagaagagtgctactgtactgggttcaatacagtaagtagactcactgctagaagactctgtcttacaggggatgaaaaaggaattgagcttcattccaggactgactcttggcaaattttgatgttggtaaggtatactttttatacacttctatttataattctcccttcccatatatcatctagttagagaggtggtaatatttcatagactcatctgaaatttatcttcccaactttctccagcaattttctttttctttttcttttctttttgagacggagtctcgttctgtcacccgggtgggagtgcagtgacgcgatctcggctcactgcaacctctgtctcacggcctcaagtgagtctcctgcctcagcctcccgagtagctgggattaaaggtgcccaccatcatgcatggctaatttttgtatttttagtagggacggcatttcaccacgtcaaccaggctggtctcgaacgcctgacctcaagtgatccacctgccttggcctcccaaagtgctgggattacaggtgtgagccactgcgtccggccatttcacatattttctttaagagctaggctgcatcagaatcagccataggtgcttattatgaatacagaacctgcccccagagattataaattatttatctggagtaggacatgaaaatatttttttaaacaaatgacactggggacttgatgcacagttgggtacattttaagagaacattaaggggaaaagtattagaattttaaatagacaaaagcagtagtaaaagtggcttgtgtgatagaattatcatttgtaacacaggaagtacctgtacttcatagccccttcttaagttagcctcctttgtctctattttgttttctccgaaatcacaatacttggacaaatttgtaatttttttttgataatgcctgacatctttatgtaacattagaagttcagatttcttgtctattaactaacatacgtattctgtttttgaaatgttaatctcccagttttccctttataatagaatcatgtgtttagtggccacttagctggataccgccatgataccagaagcagtacaaaagatgaagattcagttaggatacagttttcgatttttaaggagtcattcttctgtgcccagaatacactagggagccaaacaaatgattcttacagtctggtgttaatgaccaattctaattccttatgtattatttttatatttatgttctaagatactttaataaaactttaaagactatgaaacattttattataaaaagtgttaggagattttacagtgcctctccatatacccattatctagattctgtcattaatattatgtattaacagctttattgacgtataattaacatgcagtaaaatacacgttaaagtctacaatttgataagttttagcatatatgtgcatgcaggtaacaatcatcacatgataatgaacatatctgtcatacctagaagtttccttgtgcctttttgtaaaccgtatcttctaaccctccttgtcccttatacccttcttgtccccaggtttttgctgatttgctttctgttactgcatattagcttgagttttctagacttggataaatgggattgtacagtttgtattctttcagtctggcttatttcagcataattattttgagattcatccatgtggtagtacaatcaataatttattcctttttattgctgaccatagcaagtggtggtgaggatgtgcaaaaactggaactctgttaatatgtctcctggggatgtaaaatgttaaacaacttgggaaaacagtttggcaatttcttaaaaagttaaacatacatcaaccatgttatcaagccattgtgcttctacatgtttacccaagagaaatgaaagcatatgttcatacaaagatttgcacacagatgtgcatagcagctttatttttaatagccccaaatgggaaacagtccaagtatccaccaacaggtgaatggataaacaaactggcatatccatataatggaataccattaatatttaaccacacatgttttgtcacatacctgtccatctgtccatctctctatccatgcagcaattcatattattaaatgtatttcagaataagttgtagagatgagctcatttcctcctaaatacttcagcatgtgtatcattagagtgcaatatttgcttagtttttttccttttgaggtaaaatttatgtagaagaaaatatacaaatcttaagtgtacattgactgagttttgacaaatacatacacacatgtaactcaaacccagtcaagatatagaacatgaccatcaccccagaaagtctttttcctgacctttcctaatttattcctaccctcatcttcagaggcaacaaatactctaatttttttctttctgtcatacatacacatctattctgctttgctgagagtgttttcttttccttcaagaatgttggagccaggcatgatggctcatgcctgtaattttagcactttgggaagctgaggtggccagatcagttgaggccaggagttcgagcccagcctggccaacatggtgagaccctgtctctactaaaaatacaaaaattagctgggtgtggtggcgggcacctgtagtcccagctacttgggaggctgagacacgagaatcgcttgaacatgggaggcggaggttgcagtgagccgagatcgtgctactgcactccagcctaggtgacagagcaagactccgtctcaaaaaaacaaaaacaaaagaatgctggattttgtcaaatgtttttttctgcatctattactattatcacaggatttttttcttttttaatctgttggtgtgatacattacattaattgatctttgaatgttgaactagccttgcatacctagaataaatcccatttggtcatgacgtgtatgtttagcactcagtatctccaggggtttagttccaagacctgtgcagataccaaagtccacaacagggagggcatggaagctccccaccaccttactttgctctgtccatctctttatctgtatcctttgtaatatcctttatgataaactgttaaatataagtatttccctgagttttgtgagttatcccagcaaattatcaaaccaaataaaatcaggtgcgaaccctgatttatagctggtcaatcagaagcacagatcacagcctgcgacttgtgactgacatctgaagtgaggggcagtcttatggaactgagcccttaccatgtgggatatgacattatctctttttttttttttgagacagagtctcgctctgtcgccaggctggagtgcggtggcgcaattttggctcactgcaacctccgcctcccgggttcaagtgattctcctgcctcagcctcccgagtagctgggactacaggcgcctgtcaccacaccaggctactttttgtatttttagtagagacggagtttcaccatgttgaccaggatggtcttgatctcttgaccttgtgatccacctgccttggcctcccaaagtgctgggattacaggcgtgagctactgcgcccggctcgatatgacaccctttctaggtagatagtgtcattatttaattgaattatagttagtgtctgttggagaattgtttagggattgggggaaaaacttcacatatctggttatctaagggttctgtgtcgaatatgagagtagagagaaaaacctttattttcctttgacagtgtcttatcatatttatagctgttttctgttttgttatacttgtttcctttttaaacagtcttcccctcctcttttgccctctctggttttaattgatcatgtgatatgatttaatttttttctcctgtcttagcataccaattatgcttcttaaacaatttatttaagtggttgtattacagtttgtgctgttcacttaaaactagtccaagtccacgtccaaataacattataggtcaggtatagtggctcacgcctgtaattccagcattttgggggactgaggctggcggatcatttaaggttaagagtacgagacctgcctggtcaacatggtgaaaccccatctctactagaaatacaaaaaatttgctgagcatggtaatgtgcgcctgtagtctcagctactcaggaggctgaggtatgagaatctcttgaactgggaggcagtgagccgagattgtgccacttcactctagcctgggcgacagtgcgaaactctgtctcaaaaaacacaaaaacaaaaatcccactatactacttcatggaaaatggaggtagtatatgtaatactctatcttacaatacagtatacagattcctcccttctgcccattgtaacattgttgtcattaatttcacttacctataagctgtaataatccaatgcattgctgctattagtattttagacatttttctattaatttaagaataaggaagaaaagacttaatttaccttcatctcttaattctctaatgctcctgtgaatctgagtttttggtttaaatcattttccttctttctgaagaactcctttatttatttgttttttttaatttttgagatggagtcctgctgtgttgcccagcctggagtgcagtggcgcagtctctgcttactgcaacctctgcctcctgggttcaagcgattctcctgcctcagcctcctaagtagctgggactacagatgcatgccaccatgcccagctaatttttgtatttttagtagaaatggggtttcactatgttgaccagaatggtcttgatctcttgacctagtaatctgcccgcctcggcctcccaaagtgctgggattacaggtgtgacccaccacacccggcctatcttaaccattttaagtgtacacttcatgtcattaagtacacttacattgtgcaaccatcaccaccattcatctcctgacttcaccattattcatctcctgaattcttcatcttgcaaaactgaaccacttacccgttaagcaatgactacccattccaccgtcttcccagaccccagtaaccgttattctacttttgatgtctgtaaattcgaatacttgaagtataagtggaattatacagtatttgccatttgttattggtttcttttacttggcataatgtcctcaaggtgcatccgtgttgtaggaaatgtcagcatttcaataatttttcaagctaaatagtatcccattgtatgtatatactgcattttgtttctccattcatctgttgatgaatagttgggcagcttccaccttttggctgttgtgaataatggtgttatgaatgtggatatttttctttgaagttcagtctgtgctgtcagatttttgggttacatacccagaagcagaattactggatcatatagtaattccattatcaatttttttgaggaattatcatactactttctatagtgactgcaccattttacattcctaccaacagtgtacaaaggtcaccatttctccacatcctcaccaacatttattttctctttttttgatagtagttatcctaatggatatgaggtggtatcttgtagttttcatttacatttctctaattagtaatgttgaacatcttttcatgggcttattgaccatttgtatatcttaattggagaaacatctatttaagtcctttgtccatcttttaatcaggttgtttgttttttgagttgtaagagtttacatacaaacatacacacacacacacacacacacacacaatgttagctgcttatcagatatatgatttgcaaatatttcccattttgtgtgttaccttttcttcctttttttccctgctaacttttattttaggttcatggggtacatgtgtgggtttgttgtgtgggttaattgtgtgtcactggggtttgatgtataaattattttgtcacccaggtagagagcatagtacccgatagatagttttttgatcctcaccctccccacaccctccaccctcaagtaggccttggtgtttgttgtttccttctttgtgtccatgtgtactggatagagtttgaatacatgtccccaccaagtctcatatttaattgtaatccccattgttggaggtggggactggtgggaggcagttgggtcataggggtggatctttcatggcttggtgctgtccttgcaatagttcttgcaagatctggttaagtgtgtggcacctccctatgcactccccctcttgctcctgctgtgaccatgtgatgttctggctccgcttttgccttctgccatgattgaaagcttcctgcgtcctccccagcagctgggcagatagatgctggtgccatgcttcctgtacagcttgcagaaccatgagccaattaaacctcttttctttgtaaattacccaggctcaggtatttctttatagcaacacaacaatggactaacacagtactcaagttttaactccgtcttgtgagaatatgcagtatttggttttctttttctgtgataactcgcttaggataatgctctccagtggcatccatgttgctgcaaagggcatgattttgctccttttcatggctgtgtggtagtccatggtgaacatatactgcattttctttatccagtccactgttgacagacatctatgttgattccatgtctttgctattgtgaagtggtgctgtgatgcacatacgcatgcatgtgtccttatggtaggacagtttatggtcctttgggtatatacccagtaatgggattgctggttctaatggtagttcttaattctttggtagttcttagttcttaaatctccagactgcattccaaagtggctgaactaatttacattcccaccagcagtgtgtaagtgttcccttttctctgcagcctcaccagcatctgttatttttgactttttaataatagccattctgactggtgtaggatcgtatctcactaatcattaatcctctaatgattagtgatgttgagttttttttttccatgtttcttggccgcatgtgtcttttgagaggtgtctgctcatgtccattgcccattttttaaatggggttgttagttttctgcttgtttgtttaagttccttatcgattctggataattagatctttgttggatgtatagcttgcaaatgttttctcccattttgtagattgtctgtttactctgtggacagtttcatttgctgtgcaagagctctttagtttaattaggtcccacttgccttttttttttttttttttgtagttctggaattttcatcatgaaatctttgtcagggcttatgtccagcatggtattccctaagttttcttctagggtttttatagttttaggttttacatttaagtctttaatctatcttgagttgattgttgtatatggtgaaaggtaggatccagtttcagtcttctgcatgtggctggccgttatctccacaccatttattgaatagggagtccttttcccattgcttgtcagttttgttaaaatcagatggttgtaggtgtctggctttatttctgggctcttgacctgttccattggtctacatgtctgtttttgtatcagtgccatgttgttttggttattgtagccttttagtataggttgaagtcaggtagtgtgatgcctcaggctttattcttttggtttagggttgctttggctattcaggctacttttttgggccagtatgaattttaaaatagttttttctaattctgtgagaaataacattggcagtttgataggaatagcattgaagctgtagattgctttgggcagtatggacattttaacaattttgattcttcctgtctatgagcatggaatgtttttccatttgtttgtgttgtctctgatttctttgagcagtgttttgcaattctcattgtagagatcttttacctctctgattagctctattcctaggcattttattctttttgtggcgattgtgaatgggattgaattcttgatttggctctcagcttggatgttattggtatatagaaatactactgatttttgtacattgattttgtatcctgaaagttggttgaagttattagttctaggaacctttgggcagagactatggagttttctaggtatagaatcataccgtctgcaaacagggatgatttgacttcctctcttcctatttggatgtcttttatttctttctctttcctgattgctctggctaagacttccagaactatgttgaataggagtaagtgggtatccttgtgttgtcctggttctcaaggggaatacttccagattttgctcattcagtgtgatgttagctgtgggtttttcatagatggctcttattatttccaggtatattcctttgatgcttagtcttttgagggtttttaacatgaagggatgttgaattttatcaaaagtcctgaatctgaaaagatgatcatgtggtttttgtttttagttctgtttagtaatgaatcacacttattgatttgtgtatattgaaccaactttgcataccaggaataaagtctacttgatcatggtagatgtgctgctggatttggtttaccattttgttgaagatttttgcatttatgttaatcagggatataggcctgaagtttcctgtttttgttatgtctctgccaggttttgttatcagaatgatgctggcttcataaaataaaatgagttagggaggagtccctccttctcaattttttggaatagtttcaataggattggtaccagctcttctttatatgtccggtagaatttggttatgaatccatctggtccagggctttttctggttggtagactttttatacaatttcagaactcattattgctctgttgaggtattcagtttcttccaggttcaatcttgggaggttgtatgtttccaggaattcatccatttcttgtagattttctagttagtgtgcatagagatgttcataatagcctctaaggattttttgtatttctctgggtcggtggtaatgtcccctttgccatttctaattgtgtttatttggatctcctctctctctttttttttctttgttagtctggctggcaatctatcttatttattctttcaaggaaccatcttttgtattttttttgttcagttcaactctaattttggttatttcttttctgtggctagctttggggttgatttgctcatttttctagttcctctaggcatgatgttagttgttaactttatatctttctaacattttgatgtgggcatttagcactataaactttcctcttaagactacattagctatgtcccagagattctggtatattgtatctttgttttcattagtttcaaataattcctttcttttcttttctttttcttcttcttttttttttttttttgagacaggttcttgccctgttgccgaggctgaagtggagtggcatgaacacggctcactgcagcctccaccttccaggctcaagcagtcctcccacctctcagcctcctgagtagctgggactgcaggtgtgcactcctacacctggctaattttttttgtattttttgtaaagacaatgtttcaccatgttggccaggctggtcttgaactcctgggctcaagtgatccccccacctaagccttgcaaagtactgggattacaggcatgagccaccgtgcctggcccaaagaatttctggatttcagtgaaattaagatttcgttgtttacccaaaagtcattcaggagtggtttaatttccatggaattgtatggttttgagagatcttcttggtattgttacctatttttattgcactgtcatcttgagaacatggttggtatgattgtgggatttttaatttgttgagaattgctttatggttgagcatgtggttggttttagatacgtgccatgtgcatatgagaataacgtatattctgtttttgttgggtgaggtgttctgtagaactctgttaggtccatttggtgaagtgttgactttaggtctgtctaatactgtcagtgggtttttgaagtctcccactattattgtgtggttgtgcaagtctctgtaggtctctgagagcttcttttttgaatctaggtgctccagtgttgggtatatacgtatttaggatagttaagtcttcttgttgaattcaaccttttattgttttgtaatgcccttctttgtcctttttgattgttgttggtttcaagtctgttttgtctgaaataagttacccatgcctgcccttttttgttttacttgcttgatagatctttctccattcctttactttgagcctatgggtggcattgcatatgaaatgggtctcataaagacaacatacaattggttcttggttcttcatatgaattgccattctgtgcctttgaagtgggatgtttagcctgtttacattcaagatgaatattgttatgtgctgatttcatcctgttatcgtgttgttagctggttggtatgcagacttgattgtatagttgctttatagagttagtggtctctgtacttaagtgtgtttctgtggtagccggtaatggtctttcatttccatggttagtactcccttaaggacctcttaaaaggcaagtctggtggtaatgagttcccttagcatttacttgtctgaaaatattttatttctgattcacttatgaagtttagtttggttagatatgaaattcttggttggaatttcttttctttaaggatgctgaattaggcccccaatttcttctggcttgtaggatttctgctgaaaggtctggtgctagcctgatgggattccctttgtagtagacctaccccttctctctagctccctttattatttttttctttcacattgaccttggagaatctgatgattatgtgtcttggggatggtcatcttgtatagtatcttgcaggggttctatgaatttcctgaatttgcatgtcaacctctctagctaggatggggaaatttttgtggacagtatcctcaaatatgtttccaagttgcttgttttctctccctctctttcagggacaacagtgagttgtagatttgatctcttcacataatctcatgtttttgggagatttttttccattgaaaagttatttttcctttatttttgtctgagttgatactgaagaaccagtcttcaagttcttgagattccctcctcagcttaatctgttctgctgttaatacttccagtgatattgtgaagttcttgtagtgagttttttagctctgtcagatcagtttggttgtttcttaaaatgactatttcatttttcagctcttgactcattttactggagtccttaaattccgtggattgggtttcaactttctcccgaatttcggtatcttctgagttttatgcccatcatttcagtgtgattaagaaccatcactaggctgggtacagtggctcacacctgtaatcccagcactttgggaggctgaggcgggcggatcacttgaggtcaggtgttcaagaccagcctggccaacatggtgaaaccctgtctctaattaaaatatagaaattagctgggtgtggtggtgggcacctgtaatcctagttacccaggaagctgaggcaggagaatcacttgaacccggaaggtggaggttgcagtgagccgagatcatgccactgcactccagcctgggcgacagggcaaaactctctcttcaaaaaaataaatatataaaataagaaccattgctggggagctactgcagtcattttaaggtaagaagacactcaggcttatagagttgctagaattcttgccctgattctttctcatctttgtgggctgatgttcctttaatctctccagttgctatcctttgaatgaggctttttgcttttatattcttggatgccccaagggtttgaccttgatataagttgagtttagtcgactggcatagtttcttgatgatttctgggtaccaaggctcagctcagcactcctggcatgcatgctataaccctggggtgttaggactaggcacatgactttgttctctgtctcctcgaggttaagcacccattgcactggtggggccaaggtgttcccggtctgctgggcaacaacactctgatggtggggccggcaaaagtgcttggttggggtggtgacagtagggtggtaaggcctgcatatacattggaaaagccgtcgggggaggctgtgggtgacggtgtcctggcaaaacagtgcggggaagctgtgcgtgggtggatgctggtggaggcccatgtgcaggtgctctctggtggttacctggggcttgccagcaaaggagctatagtggtggctgtcgggaagtgctgcggttgggcatcagcgtccattgcaattggatgtggccaggcagggactgtggaacaggcaaccagggatgggggttggggggggcgctcaaatctgacaagccctgtgccatgggcaagatagttctgttctgtctaggtccaatagtcagcaaagaccaaagctacctagaggtgtgtggtgagctttgggagatggacatacctggccatgctccactgcagccattcccacaccaggccttctgggctccgtgcagactggagtcctgtttctgccaacttcccaagcagctgtctttgcaacctcaaatgtctgtaggggtcatggagcctccttcagctaggattctagaggtccatgacaagaacaggctactccatgcctgtttaactcatcctttccccaggagcatttggggtcagaatgagtcatggtgctaggggagctccctgtaaggttcccagctttctcctccttcagcccaggatccgcatcctccttctgttcactctcagtgccttccttccaaagatctgctcagagtgtgctggtcttcttgatggcctggtctcttggtggtggaagctcttcctgactctgtgtctacttggccaccctgactcctctctgttgtctgttcactgtatatagtgtcatgtgaggaataaaagttttaacatttgacgaagtccaattcacctattttttttcttttgttgcctatgcttttggtgttatatccaagaaatcattgcaaaatgcagtgtcacagaactttctccctatgctttattctaagttttatagttttcagttttacatttagctcttggatccattttgagttaatttttgaatatggtataagcctgtcacacaggctggagtgcagtggcgcaatctcggctcactggaaactccgcttcccgggttcacgccattctgctgcctcagcctcccgagtagctggtactgcaggtgcccgccacaacacctggctaatttttttgtatttttagtagagaccgagtttcaccatgttagccaggatggtctccatctcctgacctcgtgatctgcctgcttcggcctcccaaagtgctgggattacaggcgtgagccaccttgcccaacctattgatctttttagaaaactaacagtcggtgtcccggtgcagtggctcacgcctgtaatcccagcgttctgggaggctgaggcgggtggatcacttgaggtcagcagttcgagaccagcttggccaacatgacaaaaccccgtctctactaaaaatacaaaaattagctgggcatggtggtgggcccctgtaatcccagctactcaggaggctgaggcaggagaatcacttgatcccaggaggcggaggttgcagtgagctgagatcgtgccactgcgctccagcctgggcgacacagcgagactccgtctcaaaaaagaaaaaaaaagaaaacgaatgctttatttttatttttattttttttccattctctttcacttatctttgctctgatctttattattttctcccttctgctaggtttgcattttgttttgtttttttccctatttccttaaggaataaatttaggtggtgatttgggatgtttcttctttttaaacataaacagttacagctttatgttccttctagcgctgcttttgctgtatcatactaattatgatggtacagtctttttattttcatctcgatattttctaatttttcttggggttacctttttgacccgtttcttatttaagagtgcttaattttcatatatttgttcattgttctgtttccatctgttatttccttatttattttatttatttattgttactagaaaagataccttgcataacgtcaatcttttataattttacaattttgtttttaattgacatgtattgtgcatatttattaggtacagggtgatgtttcaatacatgtatacattgtataaaaatcaaattggtatttagaatatccatcaccttatacattcatcatttccttgtggtgaggacattcaaaatctttcttctagctatgttaaaacatgcaatacagtattgttaaccatagtcactctgctgtgcaatagaacaccagaacttattcttcccatcttactgtaactttattctcattgaccaatctttacctatttcccctctcgccagtattccccagcctctggcaaccactattctatacactacttctatgagatgtcaacttttttagatttcacacgtgaaatcatgcagtatttgtctttctgtgcctggcttatttcccttagcattatgccttccaggtgcgtctgtgttgctgcaaaggacaagattatattgttttgttttgtttttttttttaaatggggaatagtatttcactgtgtatatatataccacattttctttagcagtgcatctgtttgtagacacttgatttcatatcttggcttttgtgaaaagtgctgcaataaacataaagtccaggtttctcttcaacaaactgatttcatttctttgggatatttatacattagtgggaatgatggatcatatggtaattttatttttaaattttttgaagaacttccatagtgtgttttataatggctgtactaatttatactcccaaaaacagtgtgtaagagtttccctttctccacagtcacaccagcatttatttttttgtctttttgatgatagccagtctaataggttgaggtaatatcttcttgtggttttgatttttatttatctgatgatgggtgatgctgagccttttctcatatatatacctgttgaccatttgtatgttttcttttctctttacaaaaattttgacacttgttttatgacctcacatatatcctggagaatgtcccatgtgcacctgagaaaaatgtgtattctgctgttggtgggtggagtgttctgtatgtgtcttttggtccagttggtcaatagtattaagtcctatatttccttattaatcttctgtgtggttgttctgtccattactgaaagtggggtattgaagccttctactgctaatgtagtgctatctgtttctctcctcaattctgtcagtgtttgcttcatatgttttgctggtctcatgtttggtgcatacatgtttataattgttacatctttttagtgaagtgtcggttttatcattatataatgcccttctttgttttttgtaacagattttgacttaaagtttatatgtctaatattagtataggttgaatatgccttatctgaaatgcttggaatcagaagtgatatggattttggattttttttttcttcagattttagaatacgtacatatacataatgagatatcttggagatgagacccaagtctaacacaaaattcatttatgtttcaaatataccttgtacacatagcccaaagataattttatacaatattttaaataattttctgcatgaaacaaagcttgtgtaccttcaaccatcagaaaggaaaggcgtcactgtctcagctgcccatgtggacaatctgtggttgtttggcatcatcgttattcttgactgaatttatatgctgatcagcaataattttctcacatttattcacacgtaagttgttaacagtaagacatatgaggtaccattaattcagtgaaaatacagtgtgttcagggtgagtaagcagcacagtagcatcactgggaatatatgtatccactgttaaacagcagcagcaacaaacagtggcaggcaggctctcagtctccacctacaatgctgtgttttgattaaaaggtaactgtagaatgtactgtatttatttattttttttttcaagtgagaagaaacattagaagcagttgaggggcccggaattggatcctcaggggatgaggaggcattttgctagatggcttttaaaaatgtttcctccagaaccatctgcctcactaactcttttttgtctgagaagtctctgattttataaactgtcataatttattgttctgttatgaatgcctgctgctccagtcctttaataagcccatcacacattttcaccatgtaccatgtggtctataggtacctttttgcattggtaacatcatcatctttatcttcatcatccacttgtggtattatgtctgcactcagaaagtttccgattttggagttttggattagtgatgcccaggtatctttgctcttttggttatttttgcatgggcttacttttttttaaatctttttgcttttgacctatgagtgtccttagagccaaagtgagtttcttgtagaccacgtacttttattttttttgtctctctctctttctctctatttatttattttgagatggagtctcactctgttgcccaggctggagtgcagtggcgtgatgtcggctcactgcaacctccgcctcctgggttcaagcaattctcctgccttagtctcccaagtagctgggattacaggcatgcaccatcacgaccggctaattttgtacttttagtagagatgggatttcaccattttggtcaggctggtctcgaactgctgacttcaggtgatccacctgcctcagcctctcgaagtgccaggattacaggcgtgaaccaccgctcccggctgggatcctgtttattttaatccattctgccaatctgtctttttgtaggagagttaagccatttatatttgaagtagttacagatagggaaggacttaatattgccattttgctaattactttctatgtgtcttacagcatttcttctttctgttttaccccttagtgcctttcctttggtttagttaattttttatagcaactttgattcattttgtgtttaattaactaataacataattaatattaacatcaagatagcaatgaggtctcgctgtgttgcccaggctggacttctaggcttgtgtgatcctcccacctcagcctcctcaagtagctgggactacgggtgcctgccaccatgcctggatgacttttgtgtatgttctaaaggtattttctttgtggttacgatggggttacatgtaacatcctaatgttatagcagtgtattttaaactttcattaatcccattacctgtatgttacagcttttgcaattgtcctatagttcttagacattctgttctattatttttctcattttctttttttattggctttgaattgggaagtttttatttacgtatcttggggcttactgattttgcattaaataattttttctcaatggtttattgcaagtatatttaaatgtagtttactttttgcatgttgatcttgtatcatgctactttgttagactcatttgtataattctgattaaaatgtttgtatatattaacattgagctacaattgcagaggtcaaaagatacaattagtgaagatttggtcaagcatactctgttagactatgtagaagaatgaaggtgagataataagattataggcagattatattatctgttatgcacattatttatatatttttcctgattatgacaggaatgaagcatacatattaactttttaaaatgaaaaatatttgattgtttgaatcttttttttaatcttttttaggagctgtggccctcaagaatcttcaaattaaagaaaatgccctggtaggttttgactatgaaaaatttgtaaagttattgcatttaattatgtataattcttcctgattcagtttgtcaccttaaattatttaaatttgagaaagttttttgtaaataatttttgcaaaatgtaaattttgctaaatggagttttaatctccctgaaagcacaaatggacagtgtgattttttttctatttaaaaatacatattgttttaggctgggcatggtggctcatgcctgtaatcccagcactttgggaggtcaaggcaggtggattatttgaggtcagtagttcgagactagcctggccaacatggtgaaaccccatctctactaaaaatgcaaaaagcttcgccaggcatggtggtggacgccagtaatcccagctgccagggaggatgaggcaggagaatcgcttgaacccaggaggtggaggctgtagtaaatggagatcgtgctactgcactccagcctgggtgacagagtgagactctgtctcaaaacaaaacaaaacaaaaacaaacatacaaaaaatacagatgtttttatttcaaatttttaacttgttttctgattttttttttaagacaggctcatgctgtgtcaccccaggctgcagtgcagtggtgtgatcatagcttactgtaggcctcagctcctaggctcaagctgtcttcccctttcagcctcctgagcagctgaaaagtttttaatctgataaagactagttcatttttttaattgcttgtgcttttattgtcatattcaagaagtctttaccgaatctaatgtcgtgaagattttcccttatgttttcttctaagagttgtatagttttagctcttaggtttagatcttagatccattttgaggtaatttttgtatatggtataggataagggttcagtttcatgtttttgcgagtggatatctagttttcctagcaccatttatttaaaaggctattctttgaatggggagaacgttttgaaagtttattttttacaaaacgcgtattttgcaaaatagagttttaatctccctaaaagcataaaatgacattgtaattgccacttctttttcttaaaataatataaaattggtaatgatttgatatgagtagattttctggtcatttttactgtagacctttatccccaattattattaaaagagcagcttccctggattttatggatttgatagtaatattgcagttatatgtttatatatttaaataaatgttgatgataaggaaatgtgtaagtttattaaaaaatcccttgaaataatttttggaagtaaagagtattcatttatgttgttaaactctatatctactaatgttttgtgtatatataaattttttctgtagagtcaactggatgtaccatttaaagttaaagttggtcacataggtaagccatattcattattgggatatcctccttcctggacatgcagccagaataatttgcctaatatatctattatgtgatatttttcatgtttctgagcatcaattaaaaataatcatgtgtttttgtctcagtagagctttgttgtgcaacttaaaaatattgtccgatacatatatcccttgcctagtatttgatatcctaatacattacatatctctttaggtggtaaattgagttaattcaaaggattacctctaagggagagcttaactgtttcagtttcctaggtttctgtctagttaccactgctatattttgattaacattggatatattgtgtaaagaataggttctgcatcatccaggccctgtgactaggggccgatttgaaaactaatttctgctctgcaagtttttgtatggtttcagaaaatactgtgctttttcttgtttggtattatttttaccagtgtttactgtttatatcttaaatatattggttgagcagtaaatgattggaatttgaggttttaacatctttaataaaaacttatctgtcatgtttcttgtgttacagttttactggtttaaatattgtgcaagataatagtgtctttagttgggacttggagatatttttgttatatagatagttttgtggtaggatgtatacattgttattgaagctatactgttgtcacttggggaacaaagtattctgaaaggttacctagattacatgataaaggtcttcataattatgtgtacttatggttggtattagaccacataccatagaaaactttcatcatcatatgttactgacagtagaattctatcctccccactcctaccttttaaagactgtttactgtaagagggggagaatgtcacccatttttatctacctaacattttaattttttcatatttctgattatttacatgtgtacattttaaatacttacaagtttatatgtattgaaatacttgtaattatgctatttttacagttttatattttttcattagcgtataaaaaggatttctcataatctgagttgatttgatctcatttattctgtaccataataatccagtgaatgcatatttggatattgtagaataattttatttttccattggtacagaagtattacaatacatatttttatataacttttaaacttttaccaaaggtcattgaattttacagtgatgattgtcgtatttcagtgtatgtaaatttaacctcaattcaagaacagtcaaaaaatatatcaggagagtagatagactattttctttagaatctgcccgccttctcttttcttgcctaatcttgtttaaaaatgataaggtaatttttagtgataatataagatagtagaaagtacactgaactaaacccaagataattttgagagtcatttaaggtgttgtgtacctctgtcgtagcacctgtcttttaaaaatatcactgttttttcccccttctagtagacatcgagtttcttgagaagaagtgggtttaatttttaatgtatcctcaccacttagcacattacttggtatatatagtaggggcacaatttattgtatgaaagtaatacatgtttccaaatgaatgatacagtagtacaatcagttttataggaatgtatgtccccttgctattattgggtattgatctttcaaaatttccctcgtttagaatgcagaattatagatatatcaaatataaatacacatgtacatattataaaagaggttgtcttctgtggaaggtttttggaattacatctgtgtatttttttgaaatttgccaaattttctactaggagtctacattttataagggaaggaagaaaaggtttgtttgtttgtttggtttttgagacagcatcttgctctgttgcccaggctggagtacagtggtgcgatcttggctcattgcaacctatgccttcctggctcaagtaaccctcccacctcagtccccgagtagctgggactacaggtgtacgccgccatgcctggctaatttttgtagtttttgtagagacagggttttgccatgttgcccaggcttgtcttgaactcctggactcaagggatcctcctaccacagccacccaaaatgctggggttacagatgtgagccactgcgcctggtcaagtttggattttttaaaaaaacatttgtggtgaaaatggcacactgttaatatgtgtttattatttttacagttttgtaattgctctttgtccttttgttcatttactttttttgaagtattactgtatgtattttaagcagtctgttggtacatttataaataaattaaccgtgtcaaatttgttacagttttttcacaatcttattatttcattttggttatatttttggtctgtacagaaatttgaaatgatccccatgttctctggtttaaaaacttagaaagttattcctcttttagaaatcagatagtttagaggccgggcagggtagctgatacctgtaatcccggtactttgggaggcagaggcaagaggattgcttgaggccaggagtttgagaccagcctgggcaaaatagtgagactgtgactctacaaaaaatataaaaaagaaatcagatagttcatttttctctgaagtgatattatatgatgaaatctttttctcagtttgaagttttctacacatggagtttataaaatatcatgagatggatctaagtggatttaaaaaaatttcccaatcactaaccagttttagcaacatagtatatttaataatctattccttacacaattatggcagctgtataaatctagacactcataccatttaaacaattctaaaatattttaaaactctctattacgaaaatattctcaagatacaaaactagagtgagtagtataagaaaccccatacatagtgtttttgtagttcaagaacccttacgcttaaaaaaaaaattctttgctgtttgattttcttaggatgttttcattagtttgcataattttcaaatattacccagaatattttattattactttatgtgtagttttcatatatatagtttatatgtatgattattaccatatgtgtatatgtgaattactatacatacatacatacgtatgtaacacacatatacataatgaaaaatatacatacacacacttatttaaagtatacaatctacctttcattgcggggaggtaaaggtctcactctgtcacccaggctggagggcagtagcatgatcatggctcactgtagtcctgacctcctgggctcaagatcctcccacctcagcctcccaggtagctgggactacaggcacatactgtcacgcctggctaatttttttagtttttattcatagagacagggttttgccatgttgcctaggctggtcttgaactcctgggttcaagcgatccacctgccttagcttcccaaagtgctaggattccaggtgttagccactgcgcctggcctaatctaccatcttaaagcattaaaaaatataggtttagagtaagaactggggaaattcaaagttatgatattaaggattgttgattaagggaagaagaacattgttttgtttatggtacagagaactgtaaatagaaacttgtatatttcgaatataatctaggttttccaacagtactgatataaatacaataatttcaaatcattacaacaaacacttgttgtttgtagttgtaaaatagctttcaataaagtgattaaacgcttaaggacaaaggccactttattatctcttcaatgcctgacagaaaatagactaaccataaatgcaggttgaaggagtaatattttttgtcctttttttttttcccaaaaaaatgtaggtaatcttaaacttataattccatggaaaaacctttatactcaacctgttgaagccgtattggaagaaatttatttacttatagtgccttcttctagtaagttaaatttaaaaaaattataatttaagttattcttttttatggatggaaaaatatttatattcaaaatacttttggaatttttttgagattttaatatttaaatttgatatttgttaattcaaattaaattggtttttactctacatttttggcaactttgaattatttattatttatttattattatttttttttaagatggagtctcgcactgtcacctgggctggagtgcagtggcaccatctcagctcactgcaacctctgcctcctgggttcaagcgattctcctgcctcagcctcctgagtagctgggattataggcgcctgccaccacgcccagctagcttttgtatctttagtagagatggggtttcaccgtgttggccaggctggtttcgaactcctgacctcatgattcgcccagcttggcctcccaaagtgctgggattacaggcatgagccaccgcgcccggccaattaatgattatttgtaaggatttttttggaatgactatatttaaatttaaggtagttatgattcttcctttttaatcttcctataggaataaaatatgatcctttaaaagaagagaaacaactcatggaagcaaagcaacaggaactgaaaagaatagaagaagcaaaacaaaaagtagttgatcaaggtaaagaaaacagtaaataacaatgctaataagagaagtagaaaagacctaaatatttatcataattgaatattatttttctctggagatgctgagattatttcagaaatatgatagaatctcattgcatggggaattttaatgtggtttgtatgctttgttatgtgtacaggaattttaccttatggaaatttatcttaaggcaaataatatgtctagcttattattattattaggtttacatattttttatatatatatatatacacacacacacatatacatactaggtaaggtcagtttttaatgatagcaattaattttatcaagcatattttcttaattttctagcctttgcttttgtattccttttatatcaattcttcacccttttggagatacttagtttcttgacatatttctatttgcctctatctgtttatttaccctctggcttcacatattttccaattaaacttagacaatatgttccattactgcaacctctttttcattattggaagcggtgtcctgaagaaatctaattccttttcacctgttctctgatccttactgccagctactttttaaactctcacctagtgggttttttgccttggcatgtaaatacgctgttctttatcttgaaacatgaagtcattttcttaacctagtcatctgtttatgttcttctcctctgtcattcatttaatagttaaacatcttaaaattaaaaagtttactgacttcactgtctctgaaatgcattgattttcttttaataaaaaataataagcttcaataatgttttacttgttggcaaacattaatagagatttaacatgtaattcttggcaatatctcttgtaattctgttttttctctgtaacagttactttatattatgtgtagtcatttatccttacctccagtcctctttcctaagtctcttaggccttttctttttaaaaattatttttattttatcaagataatatatatacatagctttaaaagttaagcagtattatagtgtccggattaaaaaaaaaaaccaactgttcctggcccaggcccgcacctatattactaaatatggtgctcaaacctctgtgtcttgatttatttagatattatatatatatatatatatatatatatatatatatatataaaacgtgttatatgtaacataacatgcatattatctataacataacatattttataacatataattaatgacattacatattttaaactcatctcgtgtttcattggcatatatatgacatatataatatataacgtgtaatatatatattacacacacatccttttatgatgtactatgaagattgaccctattttttcatcttctctatatagttctgtcacatttttggttaaatcagaattcattgttaatagtatcatggctatatataaatgttttatttatatataaataaagtggctttaagtatgactgtttattttgtaggcttttagttaacctccctgttctcccatgtacaaaatttggatcctattagggccattttctctaaaataaacccttgtgttctcactagggtgggaaagggatgttgcttggatattgggctgggagagaaggggacctaacttaactgctccttatacagatttaaatcagttcttgtgttatcttcctctctctccactgtgttccatgtttgctattttttgtttggtggggtttccagttcctgtgtctttccagggttctgtgacttggatttttgttgttgttgttgtttgttttaaactcatcttgtgttttgtttcattaccctgcaagatataggcattgatatgcttttcatgtaaaatggatagttggttttattcaggattggtactttattgacagtaatatgcaaaaaaagagcaaagggatttaaggtgttggtaaaataacatatcatggaatctgagctgcataaggaagtcaggaggaagtagtgggtagagaaagaaagacaacatttaatcgaatgactaaatgaatttataaaagaaaagattttattaggtagtggtgagagtcaaagattaaaatatgatcctctgtctttaaagagcttgtattctgttgtctacttaattctataatctatttatatgtatatatattcatttaactctggtgtatttgaggtacatatgattagtatcttcagctttcctttatctaaggcctcctgggccagctgaatttgagagtaataggcaattagaggaaaagatagatttatatgtattatttctatataggagtagaaatatgaaaagaggaacagaattagaaataaagaatatagctttcattggcatttttaaggggagaaaaaggataataactatgattatcaaaggcatatttcaaaaaaattaggaacctcaattctttattcttctttattcttggtttttctttttttttgagacaaagtctcactttgtctcccaggatggaatgcagtggtgtgatctcggctcactgcagcctccacctctctggttcaaacgattctcctgcctcagcctcccaagtagctgggactacaggcatggaccaccatacctgcctaatttttatatttttaatagagacggggtttcgccatagtggccaggttggtctaaaactcctgacctcagatgatctgcccaccttggcctcccagagtgctgggattacaggtgtgagccaccttgcccctccaattcttgattctttctatttctttggaaagtaatggaacttgagatagttaatgctgttttctgaacatgaaatagttgatgaacttctttcatccttgttcaaaagaagaaagaagatcttatttcctattttgtatttactgggggaggaggatattcaactgttttacacatctatacacaggcaacttaatggtggtatcactaattttgagagagatttctgctttgctgctgttagtggattttctcatttaagtctattgtaattcttacccaataatcttcatttttaaatatatttttgtactcaggcataggttaacagaaattataaaatttaatgccagtaaattctacatggtctgctttagtctcatggcacaataaactagcttttgaaaaatgtttacttgcttttgaaagacttttggaaagcaagctattagtgttctatttacatatatatgtatatttcagcaaggcaacgtaagcatgttacttcagtatgtggatatttatagagtatatttttcattcaattttaaaaaaggaatatttgcaattgtagaacaacatctgccggaaaaacaggacacttttgcagaaaaattagttacacagatcataaaaaatcttcaggtgaaaatttccagtatccatattcgttatgaagatgatgtaagtattttaatatgtgatatttgtttttatatttatatgtaagttattttactatttaatgacacctactttttaatggccaatctgttaaatcccaaaaggttacagagctaaagatgatgtgatccttcttttctataattatagttgtaatttgcagtccttagtgttgagtgcttgattttacactttcccaaaatgttcagacattagatcatgaaggaaatgccttgggaattatgaatttagcagttatgtatttttaaaatactttaaagtatgctatatttacctcctggatggagtactggtctagcaattagtggagctagccttaaataattccttgatcctgaataggtcatttgttttctcttaaccagataattatttgctttataatcctattttgttagtcttttttaataattttttttgtaaactggaaaacatgcagtataatattcctgtgtaacacgaatacattaataattagtattctaatttgttttaggaaaaatataggaatgaaagtttttctggaaagtaataaaatgtttctgaatgtttgaaataagttacttcccaaaaagttatccctccctcccttcctccccccacctccctctctctctctctctctctctctttctctttctctctttctttctcttctcctcttctctcccctcccctccccttgcctccccttcccaagacaaggcctcacactgtcgccaggctggagtgcagttgcccgatcatgactcattgcaaccttgacattccttgctcaagtgatcctcccacctcacccccacccacccaccctgcagtagctgggactacagttgcaccccaccaggcctggctaattttcttaacatttttttttgtagaggcaggatctcactgtgttacccaggctggtctccagagctcaagcagtcctcctgccttggccttccagagtgctgggattacagatgggagccgctgcacattgacagttttttctataaagtggattttatccaactactaaaaatctgaataaattttactttctttcctctttagatcacaaatcgggacaaaccgctgtcatttggtatttcccttcaaaatctgagcatgcaggtattttgtttataaaagaatcttaaccatatttaatgtgcaatatagtctattaaactgctactatttgtatatgccagcatcagaaataggtgtctatgtagaacgggtgcacaaagggtcttcattggattggaatcgagggtatgtagattcacatttcaaaaaatggttgaaaatcaaattcagaaatatgaggtcctattattattggtaattatgatgttagatgcttttgcttactttaagaaatccatttccaagtttgtaatgagtaagtaccaaatacaagtaataaatgttcatatctgaaacttcgataagccttgaaaaacaaaaatcttcagtttttctcaatatcattattaatattgtagcatagtgttttcctgtttaatttttgaaattgaggaattttaaaaatataagaacatgtagagaattttgaaacatatgcttgcctccagaatggatggctgttaaattaagagcctattaaaatagcctatttgcttaaagtcttaaatatttttataggaataagctgttttggataaagtttgaatcccttttgttttctacttccacccacccgtccttccccagagataagtatcctaaattttaaaacttttatataatatatctattaaaaatgtaggattataaaagtttacgcgttttatatgactcttttatgagttcctttttgcactttccagtgttgttgacatttatctgtgttaccacatgtaacaaaattcattcagtttaactgctgtgtatttcattgcatgattttatttgttgtatctattgggttttgtgtaagatttctttttaattttattattatttttaaattgggcagcctcccaagccagagcaggctcagagagactccacagtttctttttaaaatgtggccccactgcaacgaaaaaagaaaaaatgccctccaaaaagttactcaaatactctcattaagttgaaaaataagaatggagaattagccattggattgggcaatgtgaagatctttggtaaccgtgataacagtagttactaatcatcacctttggaaacttgtctgccagcctagacctgttcagttagaaactctaggatttggttgcagcaatctgtgttttacaaagccctctaggtcagggttcctgggccacagaacaggaggtaaggcctgggagtgagcattaccgcctgagctctgtcagatcagaggtggcattcgattctcgtaggatcctagcgaaccttattgtgaactgcgcatctcagggatctaggttgtgcccctgatggaaaagttatctcctatgaaactggtcgttggtgccaaaaaggttggggaccactgctctaggtgatcctaatgcatgctaaactttgagagctactattctaattatccattcagttcgtctccacatagaaacgaaaaccatctttctgaaataaagatctgatcactttattcctctcagtggcttttcattgctcttagttttatccttaaacaacttataaaccctttttaaaccgaccccaggcaatatacctggttttactttttttctctgtctgttttgcattatattctcctgcatactgagctacttcagttgcctgaatgtgccatatatttgtgtacttttgggctctgcctgttgtgaatcatattccctgtcgaccttagaatcaataatttttagttacatgttatatattaggttatatataacatctctttatccatcacacccctgaattggatgctcctgccatgccctctcaatgaaatgagagggcattttttttgtagagacaaggtctcactttttgttgcccaaatttgtctcaaactcctggcctcaagcaatcctcccaactcagccttccaaagtgttgggattacaggtgtgagccactgcacccaatgatacctgcaaatctaaatagctcctagaacattcttttataagttaaatgagttatgagttttagaagttaaatgagtatttaacttctgctgtggcacttacctgttggaagttgcctgtttctttgtttgcttttctgacccgcaatgagctccttccttgaaagcagacactttactgtggtcagttagtattttttgatggagtgatatgtctttaaaggcattttcatgaaagggacattggtctagggtatggtagataatgatttattactctgctgtttcaaatggaatgacctttttactgccattgttttttttccttttcagacaactgatcaatactgggttccatgtttacatgatgaaactgagaaactggttcgtaaggtaaataaatactgtgtttgtcaactcatggacttaagagaattttggaaagccaaatgataatatatagataaggatgtatgtgaattttgcttatttgtttaactctgtgatatggctcacttaattatttgagacttctgaaaatagtgtatgataaaaattcttcaaagaaaatgagacatctaataaattttattttcagttaatccgattggataacctgtttgcctattggaatgtgaagtctcagatgttttatcttagtgattatgataactccttggtaagtaaattttttctgtatgtatttgttggtatcatattttgcatgaggtttaattcattgtcatttatctaatatactgtagtcagtattttttcctaggcacaatctattagcagaatttacagatacaggtgaagatgtgtgtaactatacacaaacatgaatacatacccccatatctttttttttttttttttgagacaaggtcttgctctgttgcccaggctgaaatgcagtggcacgattatagctcactgcagcttctaactcttgggctcaagcaatcatccttcctgcctcagcctcttgagtagcgaggactataggcacacgccaccatgcccagctaatttttaaatttttttgtagagacaaggtctcactttttgttgcccaaatttgtctcaaactcctggcctcaagcaatcctcccaactcagccttccaaagtgttgggattacaggtgtgagccactgcacccaatgatacctgcaaatctaaatagctcctagaacattcttttataagattagtttggtgagatgttgtttaactactttaatattttgccatagctaagttctaagtttgaattggtttttaaaattgcttttaaacatttttcttttgcagataataggattttttaggataaagacatattggcatgaatatggctaggcgtggtggctcacacctgtaatcccagcactttgggaggccgaggcgggtggatcacttgaggtcaagagttcaagaccagcatagccaacatgttaaaaccctgtctctactaaaaatacaaaaattagccaggcacggtggggcacgtctgtaatcccagccactcgggaggctgaggcaggagaatcgcatgagtccatgagacaggggttgcagtgagctgagattgcaccactgccctccagcctgggtgacagggggagactccatctcaaaaaaagacatattggcatgaatataaataaaagcaatttgtcttttaataggacgacttgaagaatggcattgtcaatgaaaatattgttccagaaggttatgattttggtaagtacattttataagataaaaaaagtagttaaagtaattggtataaattttaaattagcattgttgctatcactgtgctagttcctgttaaatttccttctatatagttaaatgtatttataatgtatatacaaaagcaaataatattatattttttagtaacgtattttattgttatgaagcttttgactatatttcaaaactataggggaaaatgtccaacaaaagatgttaataaattatgataaacctctaaggattattcagtaacaattagggtaatatttatgaagacatttcaaaatggcaagtaaaatttaataaggctagctagtacagcctttttcgaaatagtaagatcacgctgcatttaaaatttttttaatttatacttttctatgttttcctaattttccaaaatgagcatccattacttttacaatcggaaatgaattactaaaacagaaagaaaaaaatcagtgctgtttctcagtttcccaagtagctgggactatgggcacacactgccacacctggctaatctctttcgtattttagtagagacggggtttcaccatgttgcccaggctggtctccaactcctgagttcaggcaatctgcccgcctcggccttccaaaatgctaggattacaggcatgagccacctgggaacctgggaggtagaggttgcaatgagccaagatcacgccactgcactccagcctgggtgacagagtgagactccgtctctacaaaaacaaacaaaaaaaagtgctgttttttctatgataagggcacttaataaaagttggtgatggataacttaattattgaatttgcatgcctgatgtcattaaccatagaatatccttcctgaaagtatttcctttcttggctcagtgatacttttctgtctatattatacaccttcatgactactcaagtgattcttctttttgtgcccactcttaaaataattatttttattggtttgaatttagtttcattttcttgattctcttctcataggaaatattcagaacagatgagttatctgtcatatgtgtttatgattttcaaatccataatcgtaaattcgacttatttctcctttgccctgaagtcatttttgttgtatcagagttcagtgaggagagagaaagtactgagtaatttgaagaggacaaatttaatataaagaattaccaactataagaggagactggagtaacaagggactgtctcataaaaatgctaaagatatagacagaagaaacatcccctaccctagggctaagacggggtgcccaaaagagagggtccccctccttcaggactgagttgtagaccttgttggaggacatagcgtggcttattgaatggcaggaaattatctgtggtgctgtgccagcaaaacctgttggtacttcactctctggaactttctggaaattacttttagggagcctcatggaggggtgtctctctgaatgcactccagtacaaaactgccttagcaaggtgctgggggaagttgctggcatctggctgcatctagctgccatgtactgcataaggccggtgctgaagaactccgtgctggaggaaccagacactgcagaagctaccggttctgtaggagctgggtgtgggagaagccgtgttcttgcaggagtctattgaatgaacatactggaaccaggcagcataactctttcctcctgcagtgtctctccagtgtcctctactgataaagcttaacattacgccagctggaaaaagaaaaaaaaattttttttctctacattctctgccttcaaaggaaacatatttaaagatccccaaatcatttttcagagcaggctatgaaggagaagtttggagctcagaagtaaaaaattgataactggcatacctgttggagagcgaagggggaatgaagggtttctttttgtttgtgtttatatttaatcagggagatgacagcttgtttttaggctgagatgggaatgatccagtagaacatgacaaattgacgatgcaggagaaacgggggacagtttctggattgatgtaggtgaaagagaatggtgtctagtacgcaagtgaagagctttgctgcatataggagcatagttaatttatatgatagagtttagttgtgagagaagtccttatactgagtagatgagtagatatggtgataagagttgatgtaaattctcttctgagctcttcaattaaaaaatatgtatctgaggtatgttagggttctctagagggacagaactaataggacaggtgtatatttaaagatgagtttattaaggagtattgactcacatgatcacaaggtgagatcccttaaataggccatctgcaagctgaggagcaaggaagccagtctgagtcccaaagctgaagaatttggagtttgagaagaagaatttgaatgtttgagggcaggaagcatccagcacaggagaaagatgtaggctcagaggctaagccactctggtctttccatgttcatctgcctgcttttattctggccatgctggcagctgattagattgtgcccacccagattgagggtgggtctgcccttcccagtccactgactcaaatgttaatcttctttggcaacaccatcagacacacccaggaacagaagttgcatctttcaatacaattgagttgacagtcaatattaaccattacatgagatgttggaggtttttggagggaaaagagggtatgaaataggaatgctaggggagtgagagagtgaaatgacgagggcagtattctcaaagtatggttcaaactagcaacatcatttagaaatgcagatttctagggcctttcccagacctcctgaataagaacctctggaggtgaagctcagcatttgatgtttttgtatttaattttttatttgtataaaattgtggagtacaatccttacatggatatattgcatagtagtgaagtctaggctttcagtgtttccatcacctgaataatgtacattgtccccattaagtaatttcttatcatccacccctctcccatttctctacctttctgagtctccagtgactgtcattccatgctctatgtccatatatacacattatttagctcccacttacaagtgagaacatgcagtatttgttgttctgtttctgcattgtttcacttaagataatggcctccagttccatccatgttgctgcaaaaaatgtgattttcttctttttttggctgaaaagtattccatgatgttcatgtaccacattgtccggttacctgttgatggacactttggttgataccatatctttgctattgtgaatagtgctgtggtaaacatacaagcgctttttttttcttttttttttttggatagaatggtttcttttctttcgggtagatacccagtaatggaattgctggattgaatagtagttctgtttttagttctttgtgaagtatccatactgttttccacagaggttgtactgatttacattcccaccaacagtaatcccttttctccacatcctcaccaacatgtgtcattttttgtctttttaataaaaaagacattatagttttaattttcatttctcggatgatgagtgatgttgagcagtttttcatacacatgttggccatttgcatatcttcttttgaaaaatatttatgttctttgcccacttttttttttttttttttggagacagagtcttgctctgtctcccgggctggagtgcagtggcgcaatcttggctcactgtaagctccacctcacgggttcatgccattctcctgtctcagactcccgagtagctgggactacaggcacctgccaccatgcccagctaattttttgtactttaaatacagatggggtttcactgtgttagccaggatggtctcaatcttctgacctcatgatctgcctgcctcggcctcccaaagtgctgggattacaggcgtgagccactgcacccagccctttgcccactttttaatggagttgagttttttgttgttgctgtttgagtttcttgtaaactctggatattagtcccctgtatgattgatggatagtttgcagatattttctcccattctacagtttgatattttaataatctctccaggtgattctaatgaatactaaagtttgagaaccactcagatagactagggttcaataaggttctcatactttgagaacattgccttttttttttttttttggaaagggacatgtagtaagttaaatattttacattttgcaggccatatacagttcctgacacattcctctttgtttcttttaaacaactctaaaagtgtatgaatcatctttggctcactggctatacaaaaataggctgtagcatggatttggatgattcctggactgaaggactgttgtgtaattgctcagcagcattaaggatgcacttgagatttatgacactaaagtgagacccagcagtatgtttttacccccggccgtgttcagctccttaggggcactgtggagttaagttggttactccacactgacgaagtgagaagttaaggagtctatgcaaaggaatgattaaaataactgatggtggaacttcagtaaggtggggatggactgaggatgtgaagcagaggtgaagggcagagaaaggttggaggatcagtgaattgtaggtccagggtagcttctgtcaccagccactaaatttatttatttcttctgcttttttttttcaatgtaagaagaaatacagaagaaagaacaagatctttaagcatttatttatattcaaatgaacatattcttgaatgtttaatgtttaagaaattaaatgttagtccatatcaatgattaaaataaaaggaatatatcatctttatatacagattagcttataatttaatgatggatctttgtctagattctgctattactggtcttcctctgaattgttcttattctttttggcaccaaacacaaagagttgagaggaatttatcttagattatgggttcagccaagcaggtaatccagagcaaactttcactcttcatctctctccttttaccaattaaaaggaagaacacagatggatctagagaaattgatcagaaattcagaaattataattatataatggaaaccagtgttaatcctcttagcatttctaatgttcattcattctgtaaaactgtgtacttgtattaaaactatttttttgattttttttttcttaaaatgtttctgcttttaagtatcatattggtattttgagggggagttcaatttgcctttattgtatttatggaagacagtgaattttaagtaggaaaaagataaagaatcttctccacacatggttcatctgactgaaccatggcagtgtgaacatctgggaactgtagaaggggtataaaataaatggaaatcagtgttttcaacttcatcactttattgccttgagactttggaaatataactcagttttttttccatttttattatttttcagtatttcgtcccatatctgctaatgccaaacttgtgatgaatcgccgatctgattttgacttttctgcccccaaaataaacttggaaattgagttacataacatagcaattgaatttaataaaccacaggtgattttctttaatataattttcaattgtgaattattgtttgataaaagcaaaactaagattttaaatgtttcactaaaattcatgatgttatatggtagcatttccctaaaaagtcagtaatgtaacttttatcttcagcaattgaacaaaaaaatgtgatacatttaagagctttaattttccattctttagtatttcagtattatggagcttcttgaatcagttgatatgatggcacaaaatctgccatataggaagttcaaacctgatgtgcctcttcaccaccatgccagagaatggtaaatgccttgatttttttttttttttagattttaaaaatacaacataaaaataaatttctcgacttcaagaataatctttaagatataccatttttaaggtctgatacaaaccataattgatttatagctagaaatatatgtagctgctttagcttattgagttaatgaaactgatttaagggattcttgctaacacagtttacaactcgagatgctcgaataccatagttttcatttactatggacgggtcagtatatttagaattattacaaaaacaaatcctggtttgttttcttgcattgtctctccccaacccccacctcagcttccctatcagatacactgaaccaatattattaaacctgtattttaaaagctaaaaatgttacggagtctatgcaggataatcccattttaaaactcaaaagtcttgttattccagtttttaagctattccctagtttctagaagttacaattactctttcagttgactatttcagttattattcagatgactaaatgttatttgccaattaatgccttaacagttcttgtgtagaactatatttaacaaaatggagtgattttgcttattttcacttaagaaagaggaaagattaatattgaatggattattaatgcaaatggagttgggtaaaaaggaagtactcagataatatatcattttcctaatctttgtattatagttatgtatgttgttagagtagaagcaatgtcagtaatgtttcatactgttgatttgagggtgttaaatgtttttctttttttaactaggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggttagcatttaaaatgaaattgttgagtgttttatactacatagctccttattggtcttcagtgactgatactccctacctttcattccaatttttattgaccttttcatctcttttacttagacttttttgtgcttctgttcttaacttcagctgaataatacaagatttgttgaaattctccagtgagcttttgaaattcgagattattctcaatcggaaggaatttgggttcatgcaaatagtatgattatgtcatttttaacctcaaaagtctaaatagtgtttgctacattgattccaacttctctgtgttggtttcaaagccttttatgtgtcaccactacattttccctatgttacaatctgaccatgcactaatttaatgtttcctgtactctgtatatttaatgctcattcttttagccacgcctatgctcataaatgctacctgcctttatctctctacctactcaattctactcatccctgaagttctacttaagtcttagtgcttgcatgaatgtctctgaattttctgcttatacagagccctttttctcttaatttttgtggtatctctagtctctaccagtagttttacatttaattatctatcttgagatattatttttgtattaatcttgtcttttagcattatgacatatttcaagagggactcttttacaaattgatgaactatagcttagagagattaaggggagttagtctcttgaagttaatgtaaacattctgaatccagaatgaatttctaatttatagattagattgacttttacttttattttcaatgtgggagactttctgaagacctagggctgttaggaatgcctgggcttagagtctttgggggatgggttcaggttgtcttagtcttgaatcataacctgagtcctccaagtctggataggagaaccctgaataagttattctgaaataataatgggttgtagttacttctcttgggggaaacatagtttgatcatgaaattctcaaaagtaattatgggtatgtcaagatagctgtgatgaaagatttagctaatctcagcttatttcaatagctatgacaactatgaaaagtgttaagtattaaaaacaagttttaagtgtatctgggtctacttgaaatacaggcatacttcactttattgtgctttgcagacattgtgttttttacaaattgaaggtttgtggcaacactgtgtctagcaaatctgtcggcaccatttttccaatagcatttattcctgtctatgtgtcacattttggtaattcccacaatatttgaaactgtttcattattattatatctgttatgatgatctatgatcagtgatctttgctgttactgttgtaactgttttggggtgccacaaactgcatccatataagacagctgttaaattaagtttagactaaagctgcctccttacatattttaagtttggccaaaaggtttctttgtacgccataaactatagcttaaatggaagtataaacagactctagtctactcttgtgccaatcaccaagttttggccaatcacatgtggccagttgttcaaaccgtgttcaaataaggtgaacactaagctataaccaaaccagctgtttctgtacctcacttccattttctctatgtcagtttcctttttctgtccataaatcttccaccgtgtggctacaccagagtctctgagcctcttctggctctggaggctgcccaatttgcaaattgttcattgcttaattaaatcttttaaatgtacttcggctgaagtttttattctaacacagcaaacttaataaatgttgtgcgtgttctgactgttctgctgactggctgttttcctgactccctctgcttgggcctccttattccatgagataaaatattgaaattaggccgattaatagccctacaaaggcctctaagtgttcaaatataaggaagaatcatacgtctctcactttaaattgaaagttggaaataattaagcttagtgagaaaggcatgttgaaagcagagataggccaaaagctaggctgcttgtgcccaatggttagctgagtcctgaaggaaattgaaagtgctattccagggaacacatgaatgataagaaagtaaaacagcctgattactgatgtggagagtgttctagtggtctagatagatgaaatcagctacagcattcctctaagccttatccagtgcaaggccctaaacatattctcttcaatactataaagactgagagaggtgaggaagctgcagaagaaaagtttgaagatagcagagattggttcttgaagtttaagggaagaagctgtctctataacaaaagtataaggcaaagaagaaagtgctgatggagaagctgcagcaagtgatcctgaagatctagctaagatcattgatgaaggtggctatactaaacagattttcagtgtagatgtaacagccttttactgagagaggatgccatctgaactctcctagctagagtgaaaaagttaatatctggcctcaaagcttcaaaggacaggctgactctcttgctagatgctgacgtagctagtgatttcaggttgaagccagtgattctttgccattctgaaactcttagggcccttaagaatatgctaactctactctggctatgctctatacacggaacagcaaagcctggatgacaacatatctgtttacaacattttaaacccaagctcagacctactgctcagtaaaaaaagatttttttcaaaatattattgctaatagacaatgcacctagtcaccaaaagctctgatagagatatacaaagagatgaatgttgttttcatgcctgctaacaccacatctgttctgccacccatggattgaagagtaattttaactttcaagtcttattatttaagaagtacattttgtaagatgatagctgccttatgaagtaggcagctatcattcctctgatggatctgggcaaagtaaattgaaaaccctctggaaaggatttgccattctatatgccattaagaatatttgtgaatcatgggtggaggtcaaaatatgaacattgacaggtgtttggaagttgattccaaccctcatggaagaccttgagaggttcaagatttcagtggagaaagtcactgcagatgtggtggaaatacgaagagaactagaagtggagcctgaacatgtgactaaattgctacaatctcatgataaaactttaaccaatgaggagctgcttcttatagaagagcaaagaaagtggtttcttgagatgaaatatactcctggtgaagatgagaacattgttgaaatgacaattagaaatttacataaaattagttgataaagcagcactgctgtttgagaggattgacttcaattttgaaggaaattctgtaagtaaaatgctatcaaacagcgttgtacgctacagataaatcagttgtgaaaagaagagtcaattgatgtggcaaacttcagttaagagattgcaatagccaccccaaccttcagcaatcaccaccctgatgagtcagcagctatcaacatcgaggcaagatcctccatcagcaaaatattacaactcgttgatggctcagatgattgttagcattttttagcaatgaagtattttaaaattaaggtatttatgttgttttcttaagacaatgccattgcacccttaatagactataatgtagtaggaacataacttttatatgcactggaaaaccaaaacatttgtctgacacttgccatactgtggtgatctggaactgaatctgcagtatctctgaggtatgcctgtatcttaatgataacatacaggctgtacacataatatgaaggatttacgattatatatctttgtatagattttttttgagacagagtcttgctttgtcactcaggttggagtgcagtggcaccatgacccctcagacttaagctgtcctctcatctcagcctcttaagtagctcggactacaggcatgtgccaccatgcctagctaatttgtatatgttttgtagaggttttgcagtgttgcccaggctggtctggaactcctgagttcaagtgattcgcctgcctcagcctcccagagtgttggggttacaggcatgagccactgtgcttggccttgtaattatatttttagttgaaaatgtaactaatatgtttacccttatctgtagtttaaacccaaataaaatcattttaaacaatgcatgtacatattttaatatgtgtttataacttgaagagtttggaactctttatgcagaatatgtattatttcatttttcaaaaaattactctctaatttactaatttccatgctgatatatgttcaagcattgcttcccagaatttaacatatgtattatattgatgaatgttctgttgtttgcttcctattatatcttttctttagtgcagccatttgatagattatgtgcttaagttaattatgtaaagttatttttgtaaagttaacacatttttgtttatatttttcaggagttggaaaaaaccttggatgtctttaatataactatagctagacagacggcagaagttgaggtaattcttggcttttcaattagtaaaaataattctgaattccatatagatatgacagatgtgatattattaatcttatactgtaacatattgtttccaaaaagtggttcaatttgctttttagtattataagaaaattatttaatattttttggcacatccatttaaatcagacagatttctatgggaaaaaatctttctaaatatttgggcttttcaaatattcagttatgaaggtaaaagccaatttattttttttcaatcatcatttcttataagatggtggaaaaactatgtggtactcctaaattcttatgttcgactaatgttgcagtttctgtgttctgttattaatgtgtatattgtttacattcattttgctcaagaggataagttctcagaatgtcttgcttatatttgtttcagttgctaaataaaggataatgtgtcatttatttgaaaatttattcattttaggtaaagaaagctggatacaaaatttacaaagaaggagtaaaagatccagaggataataaagggtggtttagctggctatggtcttggtcagaacaaaatactaatgaacagcaaccagatgttcaacctgaaagtatgtccatttcattttacagcatagttaatcactgggtgtcaaaataaagttttgccattttttgcctaattaaagtaaatagacattgaaatatatttatttaattatatataaagttattacaaataaaactattaaaacattgaaaatgtgtattagtttaaaaataaaaaataatttaaaaatcatgctagtgcttacaaaaagagctttatgcccagagatttagtgaatgcatatagcacagtaataaataaataaaaattccaaagtgttctccattgtaaatttttattgaagttgtttcttggaaagatttttgatttttaactaacagcttaagagtatagctttggaggtttagagacttaggtatatgttttagatctatcacttattagcagtgtgtctctggcaagttatttaagtgcactaaacttcagttttatcatctataacatgggaggaaattacaatgttaatactacctactttttatactaaatgtgttgattagcacagtgctattgtctaatatagttagccgtttttgagctcttgcttaatacaaatattataaattaatgttgctaaacttacatatttagcaatttatattttggataattacttgtaaaattgccagccccattcaaacattcagtgtttataatttcttaagagcgttcaagaaagtaaatttcacattctgtttattaaaggcagatacattgtgttaattttattgtttttatttaagaacataaagcacttctttctgatttgtagctcttgaagaaatgttgacacctgaagaaaaagctttactctatgaagcaattggctatagtgaaacagcagttgatccaactttactaaaaacagtaagatgttttcttgccttataccttagaatatatttatttatttatttgtttagagacagggtctcactctgttgcccaggctggactgcagtggtgtgatctctgctgccagccttaacctggcctcaagcaatcctcccacctcagcctctcgaatagctggagccacaggcatgcaccctcatgctagctaatttttgtggttttttttttgttttttttttttgatagagatggggtttcgccatgttgctcaggctggttttgaacttctgagctcaagcaatccgcctgcctcgacttcccaaagtgctgggattataggcatgaaccactgctcctgaccttatgctttggaatttaatgttacatatgtccatttttaatcctttcaaaaatatatgttactgacttgttctgtgatcttttttctgggtctgtaattgcatttattttaatttctaaggtagggataaatattgtctctttttttggggtcaatgtgatgattcttgaagaaataaaatgtccttaaaatatttggtggtttttgaaatgaatgtactataagaatatttgttatgcttatatatatatatatgttttcattttattcttctgaatataccttagtttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaagtaagtattaatttatctttttttatcatatatgaaaaaacttcactgtgttcttagacattaggtcacaatcttagtcttttgtaaagagcactatagtttcatatatccttttgtggtttcaggaaaaaggttttttttttaattgttaagataatacatgttcaatagaaaaccacattccagtgaaacatagggcattaaagaataatacaaaaatgatcagcaactacactacacaaaaagaaacagcattaacaatgtggtttttatctgagagtttttagttttattttttttaaagtagctttgagatgtaattcacataccctacaattcatttaaagtgtgtggttcattgatttttcacaactatattatatagtaatttcacattggtatatttacgaagctgtacaaccaccagcactgtattagtccattttcatgctgttaatgaagacttacccaagactgggaagaaaaagaggtttaattggaccaacagctccacatggctggggaggcctcagaattgtcaggggaggcgaaaggcacctcttccctggtggcagcaagagaaaatgaggaagatacaaaagcggaaacccctgctaaaaaccatcagatctcatgagacttattcactaccatgagaacagtatggggaagccacccccatgattcaaattatctcccaccaggtccctcccacaacacgtgggaattatgggagtacaattcaagatgagatttgggtcgggacacagagccaaaccttatcaactactatctaattctagaactttattttattttatttattttttttgagacagggtttcactctgttgcccaggctggagtatggtggtagggtcttggctcactgcagtctctgcttcctgggctcaggctaacctccagcttcagcctcctgagtagccgtgactacaggcgcgagccaccaacaccttgctaatttttagaatttttgtagagatggggtttcaccatgttgcccaggctggtctggagcttgttggctcaaagcagttcgccagcctcagcctcccgaagtgctggaattacaggtgtgagcctggctcattcgagaatatgttaacaactcccaaagaaaccctgtaatcattagcagtcactcccaagtgcccccttacccagcccctggcaacaactaatttactttctatttgaaaggatttgtccattttggacagttcatatgaatgtagtcatacaatatctggtcttttctgtttggcatttttcacttagcatgatgttttcaaggttcatcctgttgtagcatgaattagtacattcctttttattgcctagtaatctctattatggacgcatcacgttttgtttatccatttaactgttgaggatatttaggttgttccttctttttggctcttctgagtattgcagctatgagtattcatgagtaatattttgtttggaggtgggttttaattttcttgggtagacacctggggtggaattgctgtctcatatgctaatactatttaaccttttgaggaactaccagactgtttcccaaagcagcctcaccattttacatttccatgaacagtatatgatgtttccaatttcttcatatcttcatcaacacttgttattatctgttcttttgattacagccattctagtgagtatgaaatggtatctcactgtggttttgatttgcattttcctgatggctaaggattttgagctttttttctttgtgcttattggccatttcacgtgcatatcttctttggagaaatgtctattagattttttttcctattttatgttgggttgtctttttattatcgatttgcaagagttctttatatattcttgatacaaatctcttattagataaacaattttcagttattttctctcactgtgttttctttttatttttcttaatggtgaagtcaaatttatattttttttgctacacatgcttttcattataactcagaaatctttgcctactccagtggtacaaatatatactcctatatattcttataagaattttatgctatttcctcttatatgtagggttagaatccattttgagttaatgttagtgtgtggtgtgaggtgggggattcagcttcattctttttcatgagattattcagttgtcctagcaccatttgttgaaaaaactattttttcccattgaatgatcttggcaggcttgtcaaaatttataagttgatcataaatgtaaggatttctagactcttaattctaatcccattgttctatatgtctagccttatgccagtaccctactgtcttaattatggtggctttatagtagaacttgtaatcaggaagtatgactcttccagttttgtttttttgttttagctgtcctgatttccttaaacttctgtataaattttaagattatgttgtccatttatgcaaaaaaataagctcagatttgataaagattgtgttgaattttgtggatcaattttgggtgtactgaacaaattattcagcacaaattattcagctacttatctaaacaatattaagtcttccaatccatgcacattggatatcttttcatttatttagatttttaaaatttgaacaacgttttacagttttcagatacagtacacctcttaggttaaatttatttgcaagtattttattgtttttgatgatataaatggaattgttttcttaatttcattttggattattatgtgtatagaaatacaattgagttttgtatactgcacttgtaccctgcaaccttgatgaacttgtttcattagttcaatgagtttttttagttgattccttaggattttttatatacatgatcatataatctgcaaatatagttttacttcttccattccgatgtggatgccctttcttttgttttcttgcctaattgccccggctagaacctccagtagtattttaaatagagattatgagagtgggcttctcttcttgtttctgttcttcgaaggaagtgttcatcctttcaccattatgatgttagatgtgagttaggtgtggtctgcatcattttacaatcccaccagcaatgtacgtggattcatattttttccatatcattcccaacacttgttattttgtttttttattttaaattatagccatccttatgggtgtttagtatcatattgtggttttgatttgaattcccttaatgactaatgatgttcagcatcttttcatgtggatattggccctttgtataagttcattgggtcttttttttaattgagttatttttcatttgttgttgaggtgtaagaattcttttgtattctggatactaaactgtcaccggtacatgatttgcaaatatttccttctattctttattttgtgatttcacttcattgatactgtcctttggtgtacggaagtttttaattttgaagctcacttcatccggtcttatattttgttgttcatgcttttgatgtcttatctcagaaggttcacctaagccaaggttgtgaacgtctactccagtattttcttctaagagttttatacttctgtcgcttacatatacgtttatgacctgtattgagttaatttttgtaaatggcataaggaattggtacagctcatttcatttgcatgtggatatcccggtgtcccctcacacttgttgaagacactattctttcctcaatgaacactcctggtaccattgttgaaaatcaattagccatagatgtatgtatggctttatttttggactctcaattctatctcatttttattctagactttcactgtgattatcattataccaatatcgtactgttttgattactgcagatttttagtaagttttgaaattgggaagtgtcttccctattttgttctgctctttcaagaatgttttagctgttcaagggttgcttacaagaccttatgaatttgaggattcacttttccatttctggaaagtgtctctttgaaatttgatagggattgcattcagtatgtagattgcttttggtagtattgccataataacaatattaagtcttctgtgaacatgggatatctttccatttaaataaatgctaaatagatgctttttctgtttttatgaagagtttcagaaggattgttattaatccttctttaaatattttgtagaattcactagtgaagccatttggtccttgtattagtctgttcttatgctcctaataaagagatacctgagactgggtaatttataaaggagagaggtttaattgactcatagttcggtatggctggggtggcctcacaatcatggcagaaagcaaatgaggagcaaagtcatatcttatatggaggcaggcaagagagagcttgtgcaggggagctccctttataaaaccatcagacctcatgagacttattcactatcatgagaacagcactggaaaaacctaccctcttgatccagttacctcccatcaggtctctcccacgacatgggggaattatgggagctacaattcaagatgagatttgggtggggacacagccaaaccatatcagctgaattcttctttgttgagagtttttggttactgatttactccttactagttataggttttactataagtaagtttaaaaggttatagtaagttttactatactaaagtttatagtaaagttttactgatagtttataggtttataagtaggatctgtaggttacagtaaagtttactataggtttttaaggttatagaaaagttttacttcctattagttatctgattttctatttcttctcgaggcagtttttgtaatttatatatttctaggaatttgttcatttatctattttgttggtactgttttttgcagtactcttttgtagtactttttattcctctatggtgtgtcataatgcctccactttgatttctagttatagatatttgcatctttagtgttttttttcttattttaggtaaaggtttgttaaatatgttaaccttttcaaagtggcaactttgattttttttcattctctctggtgtttttgttttctgtatttcatttgtctccactctgacatgtattattttattcatactgtgagctttgggtttaatttgctcttctctttttagttctttaaagtgtaaagtgaggttattgatttgataatctttcttttttaatgtaggcatttgcaaacaaaaatttccctgtgagaactgctttggatacatcctgtatgttttgtaatattgtgtttgattcgcatccatttcaacgtattttctgatttctcttgtggttttttttttaacctgttgcttgtttaagagtgtttaatttccacataattgtgaatttttcagtttttcttctattgagttctaatttgattccattgtggttggagaagatgcttggtgtattattaaacttgttgagatttgctttgtgacctaacatttggtctatcctggagaatgttccatgtgcttgcacttgagaagaatgtattttgctgttgttgggtagagtagtccatatttgtctgttacatgtagttggtttataatgttgtttaggttctctgttactttattgttcctctgcctaaatattcctcatttaatggaagtgggagattgaaatttctaagtgttattgtgagctatttctccctttaattctgtcaaggtgtgattcatatattttgaggactttggtgtataaatgtttataattgttgtatctttgatgaattgagccttttaatcaaactataatgaccttttcttcttgtcacagttttctattgaaagatatttaagttaattaattaattattaatttagatacagggtcttgctttgccacccaggcttgagtgcagtggtgtagttatagcctcactgcagccttgaactcctgggctcaagtgatcttcccaccacagcctcctgagtagctggaattaaaggtgtgagccaccatacctggctaaagattattttatatgttagtataaccacccagctctctcttggttatgagttgcatgcagtatattttttcatcctttcactttcaacccatatgtgtctttggatgtaaaatgagtctcttttaggcagtatgcctatggtccctgacttaggctaagtatattaaatacatttttgacttggaatattttcgatgggtttattgggaaataattagtcataagttgaggagcatctgtattgttgtatcatgtttttttcatccattctgccagtctctatctttcctttgatgagtttaatttcatttacatttaacatgtttactggtaggcaagaagttctgccattttgctatttgtttattgtatgtcttataccttctgtaccctcagttcctcagtactgtcttcttagtgtttgttaattttttgggggatatatttttatttcttcctcatttctttttccaaacatattttagtcattttgttgagggctactatatagggattacaattaacagtccaaatttaagacagtcaaatttgaattgacactaacttaactttaatagtgtataaaaactctactcttatgcagctccattcttcatctttacgttatcattttcacaaattactgctttacatacttgtgttcattagtctaggtttatatttgtttttatgtgtttgtctttaaatcatagaggaattaaaaagaggagttaaaaaccaaaaatgcaatattactggctttcttatttgcttatgtagttacaattacaacagttctttatttatttgtatggctgcaaattactatctaatatcctgtcattgcagtctttaggacttcctttaacctttcttgtagggcaggtctactaatgacagacagactcagtttttgttcatctggaaatgtgttcatttttccttcattttagaaggatagttttgtcatatatagatttcttggttgacattttttttcatttagtgctttaagtacatgatcttgctgccttttggactgcatggtttctgaggagaaattagctgttaatctattacatatcttgttatgtgatgagttgcttctctcttgctgctttcaagattttccttgttttagcttttgacagttggattataatatgttgctgtgtgagtctctgagtttatcctaattggaggtctttgagcttcttggatgtataaatttgtgttctttatcaaatttgagaagtttttggccattatttctcccagtatttttaatgtctttttctttttctcatgtccttcggagagtcccgtagtgcatatgttgttccacttgatggtctcccactttaggcactgttcattgttcttcattattctttatgctccacagactcaataatttcagttgtcctgtattcaagtttgatgattctttctttgggctgcttagatcctctgtgaaacctctctgcagatggttcccaaatcatgattgttcagcttatgatttttttgattttagaatggtgcgaaagtgatccatatttagtagaaatcttactttgagtatccatacaacctttgtttttcacttttcagtacagtactgaataaattacataagctatttaacattttattgtaaaataggccttgtgttagatgatttttcccaacgtagactaatataactattctgagtacatttagggtaggctaggctaggctatgatgcttggtaggctaggtgtgtcaaatgcattttaaacttatgacatattcaacttacaatgattttattgggacataaccccattataagtcaaggaacatctgtagtgaagttttcatattggctgttgtacttttcaccttcaaaatttctgtttggttctttttaataatttctgtcgatttatattctgtgctcaaatgttattttcctggttttctttagtctttgagtgtaagcttatttaacatgatggcttagtgaacataatgctagtcttcccttttctgtgtaagctttgtacatttttgtttaaaacttgatgttttgagtggtataatgtggtaactgtggaaattagatgtcccccctctccatggttagttgttgttgattgttgaaggatgtagttttccatttgtttacctactgtagtgggtagaattgtatcatccaaaacattgtcaatttctaattcccagtacctgcaaatatagccttatttggaaatagcctttgcagatgtaatcaagttaaaatgagttcatgctgtattagtgtttgctctaattgaatgatgtgtgctcttcaaaggaaagagaaatttgaacacagactcagaaaataagacagactagagaagacaatttgcagacagacataaagaggagaatgccatgtgacgatatcttcttagctgcgcccatattaatgtagattttctgtaacgtggtgtggggattagaggtgggaaatgatcatagctcagatgccacaggctctccctgttcttatcaagttttagtagatttttttgtttgttttgagatggaatgccactctgtcgccaggctggagtgcagtggcacaatctcagctcactccacctcctgagttccagagattctcctgcctcaggctcccgagtagctgggattacaggcatgtaccaccacacccagctaatttttgtatttttagtaaagacagagtttcaccatgttggccaggatggtctcgatctcttgacctcgtgatccgcctgcctcagcctcccaaagtgctgggattacaggcgtgagccaccgagcccagcctagatttttttgaataaaagtttttctgtttgctgtatgcccttagattgatttccagagattttataattttcaccagttctttccctgtttggtttgctggggagaagagttgctgagctcctcacatagtcattctcgaagtcctgcctcatccttggtttttaaatgtttattaaattgttttatttttttgagacagagtctcactctgtcacccaagctggagggcagtggcatgatctcggctcactgcaacctccacctccctggttcaagcgattttcctgcctcagcctcccgagtagctgggactacaggctcatgcccccacacctggctaacttttgtatttttagttgagacagggtttcaccacgttggccagtttggtctcgaactcttgacctcaagttatccacctgtcttgacctcccaaaatgctgggattacgggtgtgagccacatgtctggcctttaaatgtttatttttatttttagaagaaaacatgtttatagacttgtgttaaatatgcaaaacttttcagttttacattaagcattgtagatttactgtcattttaattttagcttatcataacttttttacatataagtcaacacaaataggattctttgtgaattaatctatgtcaatttagaggaatcattgtatgtcttctttgatgggaatggactggagtcagaaatgcaaagtgaagttgtcttcattaattttttaaatcattttcaatttttaaaatccttcacaattttactgatcgctgacttttttcttttttttttaatgcagatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcagtaagcatttttttaaattactaagttttaatataatttagtttgctttgagtttgtgttaatgatgtttattttaacagaggacagtgaatagtatagtggaattcttcagacctccaaaagaggtacatctagcacagctcactgcagcaactttgacaaaactggaagaatttcgcagtaagacagcaacaggtaaatgccaatattaatgttggtgaattaaatactgtatcctatattaaacttttatttatggtagaatgtttttagtaaagtttattttaaatttattatatttctagactggttttagtttaacagaaactaatttagtacttttatgtttaaaggcagataaaaccataatcattttttacactcagaaagttcatacctagtaaccacatttaagttagttgcaaaattttgcttaggatacttggacctctatttatgacaaaaactggcctctcgttttcctttcttagaatgcgttccagattttgatatatcagcctcagggaaaaaagttctatccttttttattctctaggagagtttgaataaggtcgggtacgatttcttccttaaatatttggcagagcttaatggtaaaaccacttggttttggagatttctttgtgggaaagtttaagattacagattgaactttttaattaaatagttgaccatagagattatctgtatgattttaatgctttgtaattggttgggacttgttttctagctcaatgtatgatattaaaaaaaatgttcctcatatgctgaaaaggctgtcttttcatatctatacctattcattaggtatggattgttaatcctttacttcaaattttttgtatccttactggattttttttttccccttttgtcaccttgttctaacagttattaagagaaatacatgaaaaatgcctcattatcaatgtagatttttctatttctaatagatctgtcagtttgtttaaaaaaataaatttggctgggcgcggtggctcacacctttgatcccagcactttgggaagccgaggcgggtggatcacctgaggtcagagtttgagaccagcctggccaacatggcaaaatcataatagagacggggttttaatagagaccaggtttcaccagcctggcgacagagcaacaccctgccacacacaccaaaagtaataataataaaaattaaaaaaaaaataaattttaagactgtcattaagtacatgcaggagtaaattatttttcctcctataaaccacatctttaatgctttaatttttttccctttgtacttttttattttattttatttttgatctgatgtcagtatgaagtacaaagtttcttttcgttagaatttacctggtatatattttttcttatatttttactttttccctgtgttttcagatgtgtcatgtcaacaacatgtaataggattttttccaatctagatttatggtccttattttttatttatatctactttttgcatttaattaatttatttaggcttatgtctaacatcctattttgtgcttttgaatttggttttccttgttttatttttcttgccttcctttggataaattctaggatacctttcttcccccttccctacaatctactattgggaagttaaatattctctatctctttttattttataaattacagtatacatttttgtaaaaatataaatttaatgaaaaattttatattctcctagtcattatatggactttagtactcttgaactttatataccatccccatatactattttttttacttaaaaatactttattgtactgtatgtatatagttcatggtagtttacaattacttgtgcatttactaccttctttgctcttcatttctcttatagcttacactttttatttgattttattttctttctgttggaagttcattttttttttttttcaacctctgcctcctgggttcaagcgattctcctgcctcagcctcccgagtagctgggattacaggcacccaccacaacgcctggctaatttttaaaaaaatttttaatagagatggggtttcactgtgttggccaggctggtctcaaactcctgacctcagatgatctatcctcctcgacctcccaaagtgctgggattacaggtgtgagccatcggacctggcctggaagttcatttgtaaacttcccttgtaaatattttctcttgtaagaatctgctggtggcaaatctgtggtttgtttttgttatgtttttgttttttttttttttttttgacagtgtcttgttctgtcagccaggctgggggtgcggtggcataatctcggctcgctgcaacctctgcctcccaggttcaagcaatttttttgcctcagccttctgagtagcttggattacaggggtatgccaccacacccagctaatttttgtatttttactagagatggggtttcaccatgttggccaggctggtctcgaacttctgtcctcaggtgatccatctcagcctcccaaagtgctgggattacaggcatgagccaccatgcccgttgcatattagcttgacatgatactactgtatgtagaattaaaggttgatgttcattttctccttaacacattgaagagggcattctgtctttaggttttcattactgatgttgagaattcaggtgtcagtgtgtctgctgtttttttttgtacattatctacccttttcttttacatataagaactttttatcttttgtattctgttgtcgcaatttggtgtatccagctatagatttgctttatatatcctttttgggattcactggatttcatgaatctgagtactgggatttttaatgagttctagaaaatctatctggaaaattcttagccactaactctttacatatattctcttctggaattctggctaaatgaattttagcctttcttactccatcttccattctccttaacttctgtatcctgctttctttccatctgtttcttctctgtgttacatgctgggtaatttcttctaatttatcttctcatttactgagtccttctgtagccatgcccaatgtggtatcaaatctcttcattaagtttaatttcagtgattatatttttccctttaggaattctgttttgttaaatttaaaatctgtgttgtcattcttttttggttttgtatttcccacggatatctttacacttgtcttttttttttttttcagagatcataagtacagtattttatattctgtctcaccagttaattctctctcttcagatagtccgttatatgaagacttttgtggttctgtttttcctatcttctgtcttttgtttttgttggtacttacttatggtaacgtgtgtctttttatgcttggtaatttttaattgtaatctgctcattttccttagaatattatttgggagaattctctgaagcctgagataagtgggccttcatttcgggaagatttatatttcttctgccaggtaccttgggtatgttggtggcatagctaaattaattgcttaagatgttctggactgccaaagaattcttgggctacatacctccttgaggaatatatcatacttatcattcacagaggtattacctttttctcctaatttttctcacagcctttgtttgcatccccctgtgagagtgttttagggagaggaaggttttacttcacaattattctttctttgagtgagtgtcctttaagatttcagatttgtgaggagaactcttgcaagactctccatctttgtcttctgtttcctgtgttctgagaggctgaaattatctttggagtaagatccaatttcattgtcaaagttttaaaattctggttttgttaagcctgggagtacacttctaattgaactcagaatttgtcccattttggtggctataaaacctggcatgaaattatgatttttctcttgccatttttattatattcactttatccttattggtagatatgagatatactatctgtcattttcctttgttctctttcctaagataaaataatttagatgagtcaagaaatcacattttgataagaccttcaggaaatgtctaactagttgtcttttgttaggcaatattataataggcatcttgattcattattaatttttcttttttcacagaaaagtgtgtgttatattcttcaaaatatatgtgtcttctctggcttttgctcatttttctctactatttttatatctgaatagttttaaattagattgtacatgaataccttacctctagaaactgtagggtttgcatttattcctgtattctttgttaaaatctgggaattccattcctagtttacattctgtatattggtatattatatactgagtagaaaccaaagcataagatcaggctacttctagtcagtttttcttgattgatagaaactcatagttaaatacaaattaatcatattggaaatccactatagacattcagattttgagattttttatctctaagatttatttacctcaacttttattacttaaaaaaattaccaaacagtaaatatccacaatataaagttcacatgttacagaaatatgttttagaaagtggaagtcttcagtattttaccttctgtacataataacctttaaaatttgaagtctgttcttccaactttgttttcttttctataccaatagtataaaaatgctaattctatgaaaaaaaatggaaagcttctatgataggtttttgcacttaatttttaaaatttaatatattttggattttttctagaaagttaaaatttacctatttgtgaagagactcatatatattataatgattctggttacttaggttctttccttccctcatattcctcctttcttccttttattttgttacattctcctctattaacatcctggtttctttcttgtattataggttgagtatcccttagcagaaatgtttgggatcagaaatgtttcagatttcagatttcttcggatattggaatatttgcattttacttacttgttgaacatccttaattgggaaataggaaattcagagtattctaagcagcattttctgtgaatatgatctttgaggatcatgttattgtggtgctgaaaaagttttagatcctggagcgttttgattttggattttcagattagggatgctcagcttgttattttccccttcctttctaagaactcaaggtctttcaggtctttttgttgtcaactatggcatgagcttacagagcctgctcaactagttatcctttgtctctggcaggaaaacagatgtggtcgtttgctaaaactcttctttcagagtacaaggttctctgataggatcatagtgaatcattttctttcagttatttcatttatttactcatttaaatatatatcaagagcctaatctatatgtcagacactatgctaggttttagggaacatagcaatgatcagaatggatgtagttcttgcctattgatagatgttatactcttatggataggacaaatataaaactaagagcaatatactggaaatttttgattaatgctgtatgggtccaatcaggaaagaaaaaccacacagtaattttgataggtatgtttaatgtaatgaattattaactgtaatgagggactgttttgttactccaaagagtaactttaaagaatgtaacaagaggccaagcgccatggctcatagttgtaatcccagaggttttggtggccgagcggggaggaacacttgaggtcaggagttggagaccagcctggacaacatagtgagaccttgtctctacaaaaaattacaaaattagtcaggtttggtgacgtgtacctatcgtcccagctacttggcaggctgagactggaggattgcttgagcccgggaggtcagggctgcagtgagctatgatagcaactcctacattccagcctaagtgacagagtgagatgctgtctccaaaaatacatatatttaagaagagtagttatgaggaatatagaactgagacagcgttccctaggaagaggtctctctcttccctgagaattgaaatccacactttgttgggagaaggaacctctgtgagtcattgaatggtagaaaagccattcttgtgtctttctggtaatctgctctctaaaactttctggaaatccatcctctgaggtaaaaaggaaaaatattcatggggcaatgtctcactgccctcgttctgctgtgaaaccacctgaggagggttctaggggcagaatactggcttttgagtgctgttatgtgcacattatgcattgtgttggagaaaggcacagtgttacaggatattgctaaatgagtgtactggaaccaggaagccagctcttttctcctgcagtgtctctcctgtgttctttatctatttcagtgctagttggcaaaggaaaatcatttaagcaactcagatctactttcacagagcagacaagtgggtgaatttggagctgagtgaggaaacaattctataatcagcccaaatgctgtgaaagaaatgagaatggatagatgccccaatttagtcttggtggtagtgtcagagaagatctctgaaaattcaacattaagatcagatatatatgtaggatccacactgctaaagggtataagaaagagccttcaaggtgatggtccactgtgaagagcttaacttagcaaacaattgggtgaatttggaagttgtagaaagctgaattggttctaatgtaatgagtgaggggagagtggagggatgttaaagatgcatactcttgattatgcaaatatgaaagtcatattaagcagttaggattttgttgtaagtgcaatggaaaataggggagagacccaatcaacctaaggtcaaaataaaatactccccactcccttccattaaaaacaacttagagaaatcattgtgtcctggtatcaagaaaggctttgttgaaactaaggcttgtggtaggacttccagggagtaccagaacttagatttgtagaagccagaatacttgaggaatccttagactagagatggaaatgaagatagagaaatgcttaacagatagtctctggagaatcttgaatgtcagattgacccttctggatgcttcttgttactttagtaaaatcatgccatctgtgtttgaatccaaatcatttggggaaaaagaatgaataactgtttgagtcaattctgctcttaagtttcaggctaattggatggtcttcagaatttttgatgatctgtcagtctgttttcaaacctctatctcacctcaccttccatcctcattttaagagatttcacttgaatttgcttcttacaggctatgggaaatgccagggttttttcttcctctctctactagagtcttgcttgggctacctgtgcaaggccgttggaatcccttaaagatgacacagttttgataacagtttctcatatttcaaggaagagctgtcccagatgtaatttattagtgttatttttataaagactactggaggcagcgtaatttgtgaagaaaagaggtttatttgtttcatggttctacaggctgtacaagaagcatgactccagcatctgcttttggtgagggtttcagaatgcttccactcatggcagaaagagttggggagcccacatgtgcagagattacatggcaagagaaaggaaggaggtgccaggctcttttaaacaacaagctctaactaaaagagcgagaactcactcattaccatgaggacaacatcaagccatttgtgaggactctgcccccatgacccagacaggtcttattagggtcccacctccagcattaaaaatcaggtgtcagcatgagttttggagggctaaaatcccaaactgtagcacaggcttaggttatttattttctattttaatttaaatagatatttaaaacagaaggtattttaattacttttaatttattcattttctttctgttggcttgtatatcaagctgattatgtgttggcacttgacacttgctcaatgtctgcttttaagctttataattgtatatgtattttatttgtaattttaagtacattaaaattgttgacatattctttaatttgaacatgtattctttaataataaattcttaactttaaaggttatattcaaatatactgacctgcctacattttgtgtgtgtgtgtgtgtgtgaaaaaatgtgcctttttgtttgagtgtcagatctttttaaactttttaagtcaaatatctttcatttactctaactgatttgatggctgctcatataattttttctttaagaaagggttcacatctcatagaaaataatttgtttagatttaaaagctgatgctgatactggacttagggacataaaatagatgaatttggtatactaatcacatgcaagtgaatgaattaaatttattagactaaaaaactccaagtgaatgaaggacctagggaatggaaaactctggtttgttgccttttctggtttgcatatgattttattgaagatgatttgataatccaggattttttatattctcagaataatattaagatcaagtgttattgttcagtatggtaaatgtagcttatgaagtttatgaattgagaagtatctatgtagattctaagagttgttgtgagtaaatattttatgccactgaaactttttttttggtctgtatcttcccaattttacccaaattgagtttataggttaaaaattttttttggaagaatcactccaattttgtactcagctatatttaaataggagtacatgcattggcaggtattttaaattttatattggaagtattttgctgaggtcattttaaaattaatactaattttacattaagattgttttatcagttcatatatttagtgattctgtatttctcgagtaatttgtgaaaagtattcatagaaaagatttacatttttccaggtctactgtatattattgaaacacagaaagttcttgatctcaaaattaatttgaaggcttcatatattattgtcccacaagatggaatttttagtcctacatcaaatctgcttcttttggaccttggtcatctaaaggtatatactaataatatttgatttatgatacagcatttggggtgtttctttgttttaaatgtattttgttttttaaacagtttgatttattgctttttttcctagatttgtggtagataagtaagatttgagaaatctccctttctgttaaataaagtgaagtctcaattaggtagttttcctacacttatgaaagcaaaatgaccaattaaactctgcagggcaggtttgaatctaagcttgattgactgattgattgattgattgattgactgattgatttgagacagagtctcactctgtcgcccaggctggaatacagtactgcgaccttggctcactgcaacctctgcctcctaggttcaagtgattctcaggcctcagcctcctgagtatctgggattacatgtgcccgccaccacgcccacctaatttttgtatttttagtagagacggaatttcactatgttgcagactggtctcgaatgcctgtactgaagtgatccacttgcattggcttccctaagtgctgggattactggcgtgagccaccgcgcctggcccgaatctaagatttatatttgtagtatttgagagttgtgcttgagaagcttatttctttctcaatttagacctattacttgattacttaaagtatatagaatgatagagaattgtggaaacaatcaaatacgtcttcatctttctgaaattttttgtgcataaaactatatatatattgacattttaatatttgtatttaataattctaaattgagaaatggccttcttctgtttacctaagtcatttccctttttttctttcttttttttttttgagacagagtctggctctgtggcccaggctggagtgcagtggcacgatctcggctcactgcaagctccgcctcctgggttcatgccattctcctgccccagcctcccgagtagctgggactccaggcccccgccaccacgcccggctaattttttttgtgatttttagtagagactgggtttcaccatgttagccaggatggtctcgatctcctgacctagtgatctgcccacctcggcctcccaaagtgctgggattacaggcgtgagccaccatgcctgaccctttttttctaattatatacttttttctttccaaattttcagtagagaatacatttttttggcggtattctagatctgtgctcttcactatagtacccacttcccagccacatggggttatttaaattaattagaattaaaattaattcagtttcttagtcatattagccacatttaagagtttaatagtcagaagtggctagtggctactgtattttttgtttttgtttttgagacatagtctcactctattgtccaggctggagtgcggtggcgtgatttcagctcactgcaacctctgcctcccgagttcaagtgattcttctgcctcagcctcccaagtagctgggatttcaggcgtgtgccatcaagcccagacagtttttgtatttttagtagagatggggtttcaccatgctggtcaggctggtcttgagcccctgacctcaagttatctgctggcattgacctcccaaagtgttgggattacaggtgtgagccaccgcgcctggcctgtatttgacagcattgatatagaacatttccattattgtagaagttctactggacagcgttgctgtaaatcattaaatgtagaggaatatctatcacaatttaaagaaccaagagaggtggataatattagaatgctttttctggccacttaacaaaaatacgtgcctgtccttgatactgacatcttcccttatcctatttttaaaaattctgcatttgttaattgtgtaaacgcccactgggtatatatttataataaaatttatacagcttattattcatatttgaattttattcagttgtttcaagggcagtgtggtataatagagcataaggttaggagtaaggatatctaattttgtgactttaggcaatttgcttaacctgttacctaaaatttattacttttcaaacagagataatctttttttgagtgtttacttcacatgagctatatagagggaaaaaaagttaaaaaatgtatgtgtacacacatgtatttttatgagtaagatctttatgtactattgtggagtcatctccaggatgtttaagtgaaaaaagtaatgcgcacagtatgccaataaaggagagatacaaatataacttgcctggagttgcataaatggcagagttggaactaaaattcagctatcctatttaattctggactcttttacttcttattgtacagccatgtcagtatttgtcatcatgccatagaaacattttataagctaaatttgtctcttgatcttgctcttaatcagaaggcctcttatcacatttaaaaaatttgtagacatattattcttcaggaccatcttggtttcttttaatgcaagtaaatgggaaatatatcctaatatgtaaaaatttactttatcgctctccttattattatatatctcatcgatgaggacctttctaatagccttattatgtatgcttacttgtgaatttatcctctcctattaacattttataagtctaaaaattaaacactttatacttacattttgaagtattttgcatagtctaaactattaaaattaacttgaaggtgacgagtaaaagtcgttctgaattaccagatgtgaaacaaggtgaggccaatcttaaagagataatggatagagcttatgattcatttgatattcaacttacaagtgtacagctgctttacagtagagttggtgagtataaaatgcattatttgttgattgattttgttgaagtgattaattaggtttttagacactttgaagaccttcctcttaaatgtgttagaacgtctatatttttgaattagaaatgatagtaaatattgtctagctgttcttaccaggagcagtcttgcccccccaagagacatttgtcaatatctggagacatctttggttgtcacaggtagagcatgagtggcactcctagcatctagtgggtaaaggtgagggatactactaagcatcctacgatgttcaggccagtccctcataataaatatcagtagtgctgaggtcgagaaatcctgatctgtaccaatgttttccagcctttgaccaaagttggcccatattgaaaatgatattggtattactacacagttggataaccagaagacattgctcagggccagaagtaagcagcctaggggctctgacagtcatggacagccatacaaagacgagggtcactctcctagacatacttgtatctcattcactgtggtataccagtcaggagtctgatttagagctagttttgaagatgaagtcaaagccagaaattcacttgccaagagccatttaagtagttagggagagaccccagactcgttcagctttcttttcgttctgtcatactgcttttgaatccctagagtgttagtgaacatgcagataattcagtaaaatttgatctgttgaagagatccatatgtagagatctaagtgtttgtatgcagtcagattttaattacctgagctaaccaataaaaggagaaacaatgagaatccaaagtagttgttatcaaaattgttaatttgtataggactgaaacattttatttcttcaattatatttgcttcaggatagtgaatgtagtttgtatttttatcatattctaattgtggtggaggaaacccaaaggtatagtgggtggcagaagtacgttattttcagaattccacaaattctttttcagggaataaattactgggtttggttttccttgactgggattttatctgactcatagaattattatgttcaaatgagatagtatatatgaaaatgcattatatgactgagatcccattaatcttgttatgaatttttaaagttatttctttctgattatacctatttcagaaaatctgaacaactgagaaaccaaaaagataaacctttatgttactgcttaggcaggaacactattgatattttgttgcacatccttttagtatgtttttcagtgtgtgtacctgtgaatatatgggatgtgcttgtttggtgtttatattggaggtatttgtgaatgtattttttttacatgatttatatagttttatatccaggtattttttcttttaccagtaatattttggtcacttgaactcatggtttttattgtctatattatgctatatggctatggtctcagttatttaaccattcccttatggaacatttaggctcgtaactctgcagtgattgttgccaatcaacaacatccaagtagacttggatgtgaatttcagttttatcactagcagattgatcataggcaaattataaattcttttgagtctcagttttctaaagtgggattattatacagaattttgagaattaacatttaaacattacctagaagagtagaaattataaatcttgaataaatggtagcttttattagttactgttaaagaacctcactttttactaccttttgcattattgctttactgccatgttacttttttgggtaaggtatgtggttggtgtagtgattgtcagtggatgcgcagtagatttgataacctactgattgtatgtacctgagaatgtgacattaagattacctagatgtggggaaatttcctcatataatggaatgtgtgactatgaagtattaatagttattttaggttttgtgtgttatagttacgttaaatatgaactattttctgtacttaggtgataattggagagaagcacgaaaactcagtgtatctacccagcatattttggtacccatgcacttcaatttggaactgtctaaggccatggttttcatggatgtaaggatgcccaagtatgtactgtttgtttcatgtgaatatggattttctgggtaattctgtagctagggaaataccatacttaactgactcttccttgtgtgtgtggtgaaatgtatataactgactcttccttgtgtgtgtggtaaaatgtatataaaatttaccattttgataatttttaagagtatagttcattgtcattaggttcacgcatgttgttatgcaaccatcaccaccattcatttccagaactgtttctcttccaaactgaaactctgtactcaattaaacaataacaccccatttcaccctgcacccagcccctgacaacaaccattatatcttctgtctttatgaatttgactattttaggtgcctcatataagtggaatcatagaaaatcagattttgtgtgcctgggtttcttcacttagcataatgtcttcaagattcatccatgttggagcatatgtcagaatttcatgtatttttaaggctgattaatattccttatatgttgtatatactatgtttttatttattcatccttcaatgaacatttgtgttgttaatgctgtttggctgttgtaataatgctgctgtgtacaaatatctgcttaagtccctgatttcagtatttttgggtgtatactcagaagtagaattgctggatcatattatagttcagtgtttaagttttagaggagtgctgtgctgttttttatagcagttacaccattttactttcctaccagcacaagagtttcaatttcttcactgcctctacaacacttggtattttctgtttttttattttaatagtcatcctaataggtgtgaagtgatgtcatttttctaatgcttagtgatgttgaacatctgttcttgtgtttgttgaccattcatgtatttatttggagaaatacatattcaagatctttgcccatcttttaatctggttatttatttttttctgtttttcgagatggagtctccctctgtcacccaggctggagtgcagtggcatgatcttggctcactgctacctccacctcctgggttcaagtgattctcctgcctcagcctcctgagtagctgggactacaagcgcatgccaccacgcccagctaattttttgggtttttggtagggatgggatttcaccgtgttagccagggtgggcttgatctcctgaccttgtgatccacccgcctcagcctcccaaagtgctgggattacaggcatgagctgccgcacccggctgagttgtgagagttttaaaatatattttggatattaactctttatcagatatatgatttgcaaatattttttctcactctgtgtttccttatcactctgttgattgtggcctttgatgtctaaaagtttaaaatttttattgtccagtttatcttagttgcctatgcttttggtgtcatatccaagaaattattacaaaatccaatgtcataaagcttttcttctttgtttaccttaaagagttttatagttttagcttcttttatttagatctttgatccattgagttaatttttgtatgtgacatataggataaggaccggcctttattcttttttttttttttttttttttttttgagacagagtctcgctgtcgcccaggctggagtgcagtggcatgatctcggctcactgcaggctccgccccccagggttcacaccattctcctgcctcagcctcccgagtagctgggactacaggcgcccgccaccacgcctggctaattttttgtatttttagtagagatggggtttcaccgtgccagccaggatggtcttgatctcctgacctcgtgatccgcccgcctcggcctcccaaagtgctgggattacaggcgtgagccactgctcccggccttattcttttgcatgcaaatatctcatttcctctatacaatttgttgaaaagactgtccttttctcattgaatggccttggtaccctagttgaaaatcatttatccatatatgcaagagcttatttttgggctttctgttttattccattggtctctatgtctttattttcctgtaccacactatttagattactgtagctttataggaagttttgaaatcaggagatgtgagttatttaactttgttctttcgattgtcttggctattcgggatcctttggtattccatatgaatcttagcatgttttcttttcttgtaaaaaatgttatagagattctaacaaagagtgtatcaaatctgtagatccctttgaatagtattgacatcttaataatattgactgttatagtccatgaacatggaatatctttctatttatttgtgtctttgatttcagcaacattttctaggtctcagtactaaagtctcttgcctcatttcttaagtttattctttgtgatgctattgtaaatgaatttaaaaattttggggggattgtttattgttagtatgtgggaacttaactgatttttatatcctgcaacttgtgaatttgtttacaattctaagttttaggattctaaagttctaacagatttaagattttccacatataagatcctatcatctgtgtatggagttaatttttttccctttctgatatgggtgccttttatttctctttcttgcctaattggtctgtctagaattttttagcactctcttgaatagaagtagtttaggttggcatcctcaccttaatcctgagcccagaggaaaagctttcagtatttcaccattgagtatgatgtcagctgtggggtttttatggatgacctttattatgttgaggtagtttccttctgttcctagtttgctaactttttattatgaaaacgtgttgaattttttcaaatcctttctgtgctttgagatgatcatgtgatcatgtaaaaaatgatcaagatgatttttttccttcattctgttaatggggtatgttaccttaattgctctctatatattaaatcatatttcttgagtccagcaaaaaatccttttattccaggaataaatcctcttattctaggaataaattccaagagtaaatgatatataaaccatgtaatgggctattgatttaggtttgcttgtgcttttgggttttgcattaatatttttcagatatattggactacagatttcttttcttctagtatctttgtctggctttggtatcagggtaatgctgtctttatagaatggattagaaagtattcctgcctcttcagtttttgattgtttggtagaattcactattgaagcgatcagatcgtgggaggttttctttattgggaggtttttgattactgattcagtctccatagtagtttatccagattttgtttcttcataattcagtgttggtagatttgtgtttcttggaatttgtttcatttaaggttatccatttgttggtgtaaaattgtttgtaattgtctctctcttaacagccctttttgttttgtaaaatgagtagtaatgttaccactttcatttctgatttaaattgagtcttttctgtttttttctcagtctaactaaaggttttcaatctcgatcattttgaagaaccaactcacatttttgttgatttttttctctattgtttttctatattttatttatttctgctttcatctttgttattttttttatttcgggtagctttaggtttagtttgctgttctttttctagttccttaaggtgtaaagttaggctattgattttaggtctttcttctttattaatgtaggtgtttacagctataaagtccgcttttggcagacttttgctgcatcctatgaattttggtatgttgtattttcattttcatttgtcttgagttattttctaatttcccttgtgatttctttgatctcattgcttgtttaaccatctgtttttaaatttctatacacttgtgacttctacactttttccttctactcttgcattctagactcatttcatcattattggaaaagatacttcttatgatttcacttttttaacattttttgacgcttggttttttacctgacgtataatctgtcctggagaatgtttcatatgcacttgagaaaaatgtctattttcctggatggagtgttctatatatgtcattttagtccagttggtcaattttattggtccagtcccctgtttccttattaatctactgcctggtgtttctattcagtattgacagtgagatattgaagtctcctattattatcaaggaactgtctgtttcttcttcttaattgtgtcagtgcttgctttatatatttttgaactctgatgtttggcacatatatgtttataattgttatgtcttcttggtgaagttatactttcattatcattatgtaatgtccttctttattgcttgtaacagtttttgatttgcagtctattttggctgtttttgttacaggcatccctgctctcttttggtgattatttgcatggaatgtctttcttcattttttttttcacttttaacctgtgtgttttctatgagttaacgtgatctcttgtagacagtatgtagttgcatcctgttttttaatccattttgtcacttgaagtttttaattgagaaaaaatatatttacatttaaagtaaatacagatggggaggacttacttttgtcatattgttatttgctttctgtatgtcttacagcttttttgatccctcatttcctcctttaatggtgccctttgtgttcagtggatttttgtgtgtgacatgctttgattcctctctcatttccagttttgtatattctacaagtattttctttgtggttaccatagagattgtgtataatatcctcaagttataacagtctatttatttattatttctttatttttttagacagggtcttgttctgtcacctaggctagagaacagtgttgtggttgtagctcactgcagcattgaactcctgtgctcaagtgatcctcctgccttgtcctcctgagtagctgggactacaggcacacgtcactacactcagctaatttttaaatttttttgtagagatgggtcttgctatgttgcccaggctataacagcctatttaagattgaggcaggttgcatagtcttatacctgtaatcccagcactttgagaggccgaggtggtaggattgcttgaggcaaggagtttgagaccagcctggccaatgtagtaagaccctgtctctacaataagtaaataaataattaaataaaattagctgggcataatggtgcatgcctatagtcctagctacttgggaagttaaggtgggaggatagcttgagcccaggaggttgaggctacggtgggttatgattatgtcactgcactccagcttgggtgacaaaaattttaaaaagtgaaaaataaaactgataccaagttagcttcaattgcatgcaaaaactctacttgtttcctgttttgccccctccagtttatcttattgatgtcccagattatatttttatgtattctatacccattaacaaagaattgtaattatttcttatgcatttgtcttttaacttatgtagaaaataaatagtagagttataaaccaaaattctaataacatttgctttatactcatccatgtatttacatttactgggattattatatttcattgttagctgaagctatgtgcctgagatcctaagtagagaagtctgttgaactagactgggccatttagattatttatttctaaatagttttagactgtaggtagtcatttaacttcttccttgtaacagcaccttttttctcccttacaaatattcagacctcaggcacagatctattttaaaatttaaccaaaggcttttctcatctaacatctaccaaacacttccaggagagttgctactagcaaggcaacatgagaaggcttcatgcctagttaaagtgtactaggaagaatagagggaattagagagactctggccttttcctatatggtacatggggtggacattgtttttaatacttattatacttaacatgtaaaagggagagacccacactcttttttgttgacctttacctcatagtgactctatctactaacaaatattgtccagggccctaaatcttactctcctagattttcttttcttagaaaatcaaagcatgcactgagagtcttgaggcagaggaatggctagaatttggtttaagagacagaaggaaagaaaaccatgctacgcattcccttgttttttttcaaatccagctttagatatggttcaatttaaagagaaaaggcttaattcttttcatttctcccaaattatgtctgctgcttgtttactcttttctactgtttcttgtaaagtttttcattctgtgataaagattaaagatctgtgcgatttcttgttgtaagcatatgactaagaattgattttttttagcatagtttaagtacttttcttcttggtaagtatgctataatcttggaagttacagggtaccagaaaaagtaggtgatatttctctgagggaagaaaagggcagcttttatcttggtttggacttgctctgtcagtatatgcttaggaagaatttatgtcttgtgatgcagggaatatgtacagcatagcaggaattaaaatagctgattataagggtacagggcagaaatgacaatgacttaacttagaaagatgaaatcttagaagttatttggtttctattttataatattgtgagcagtataaagtggatatgatatgtcaaatcctgaaactccacaggtgtcaggaacattcccttgaaagttgagctgcgttaagttgaaggcaaataaaaggatgcttgctatttggtagatactgttttggtacccagcatctttagactgcgcaacttgcagatttttcaagaaagtgaaaaaaagtttaagtgcattaagagaaccgattcataatgtttaacaaagttaaactactactacgcttgtgattaattacaaatatttaaggtattggaaataaaagaaagcttgtaattttctgtaggactccagtacatttttagaaagataacgtaagtaatcagtgtgcgtacgtggaaaaagtaatttttagggaaaatgcagggataaaaatggggagtgaaaactttctctctctctctctgatagtgaaaactaactttctgtctctctcaaaggagactgtcaaggcaattaaaagaataataaagcactctgatgtggttttgctcaatgatctttgatacatagtctcatgagcaggctatttgcactgccaaaccttagttttctcataggaagcatgtacatataggaacttaaatagagagcaaaaataggttgtctgcctcatagattgtgaggactgtttacaataatgcatgtaaagtgctttcctcagtgcctgtcacatgagaaacacttgattagtagtaattgtcaattgtatatagcaaacagtagaaggacattacatgaaataagaacataaacctctgaaaaataatgagtttagcccatctaatgaaactggttaatacggtaagacggaaattggaatagagatttttagtgtttaaaatcacatttgattcagataatttgagaacagtctttttaattagtgcacttaaatcagaataattcctttataattacttatttttatcttttcaaaacagattcaagatttatggaaagttacctcttatttctttacgaatctcagataaaaaactacaagggattatggaattgattgaaagcattccaaaacctgaaccagtaactgaagtatctgcccctgtcaaatcattccaggtaatgttactttcaaaattaatataagcatgaattaagaaagtccacaaatagtatttcaaacaatcacaggaattttatataagacaatttgcaatttgttttgaatagacattaagaaaattactttttttttttttttttttttttgagatggagtctcgctctgtcaccaggctggagtgcagtggcgtgatctctgctcactgcaagctccgcctcccaggctcacgccattctcctgcctcagcctcccgagtatctgggactacaggcgcccgccaccacgcccggctaattttttgtatttttagcagagacggggtttcaccgtgttagccaggatggtctcggtctcctggtcttgtgatctgcccgcctcggcctcccaaagtgctgggcttacagacgtgagccaccacgcccagccagaaaattacatgttgagagagaaattgaaatggtaaaaagtataaatagttaagaaagatataaaataataaatctacttttctaatttctgcagcctccaatccctctcctgagcaataacactgttaactactgcttctctagtttttaaaaaaatttttgtggcatatactagtacacacatgcacaagaacatgcatgtgtgtgtgtatgtagtatgtgtgtgtatacatacatgtatatattcattttttttttttgaaacagagcctatctctgtcacccaaggtggagtgcagtggcgcaatctcggctcactgcaacctctgtctcttgggttcaagcagttctctgcctcagcctcctgagtggctgggattacaggcgcccgccaccacgccagctaatttttttttgcatttttagtagagacagggtttcaccatcttggccaggctggtcttgaactcctgaccttgtgatccacccgcctcggccttccaaagtgctgggattacaggcgtgaaccaccgtgcccggcctgtattcttttatttttaaaattaaatgaaatcattatacacactattctgaatctgtattattttcaccattattatcatatatgccttagataaatttttatgttagcacatacagatctacctcatttgtttatggtgatatagtatttcattttctgcatataccatcttttgcttaatatatcttcttttgatggatattcacattatgagtgtttacagttatgaaaaatactgctttgaacttcctcatatatatacatatatatgtgtgtatatatatatttgcttatacttttattcataggataaattcctagaaatggaattgttgagtaaaagaggatgtgaattttaaattttgattattttgccaaaaaaaaaaaaatttttttttttttgggacgaagtctccctcttttgctcgggctggagtacagtggcacaaccttggctcactgcaacctccgtctcccaggttcaagcggttgtcccatctcagcctcccaagtagctgggactacaagtgcgtgccactacacttagctgatttttgtatttttagccgagatggagtttcaccatgttggccaggctggtcttaaaatcctgacctcaagtgatctgcctgcactgggctcccaagtactgggattacaggcgtgagccactgtgcccagcccagatttgcttaacttatagtttgctaacagtgaatgaatatctttctctgctttcattactgagtattagcaaatgttaaaattttattcgaagtgaaaaaaatgtcttctggttttgatatgcttttttaaataagtagaacatactttcctaagtttactattttaatttctgtttttggaaactgctgttcatgtcttttttctattgggttatggttgtctaattaaggaagtaacctgcttgtcatttaaaattactgttttttcctcattttattgtttggttgttttttatctcatatgtaaatttatttttgccaggcagaagcgttttattttttacatagtcaatttttttttccttcatgatttctggactttgtattatgtgacttttccctttccaagagaatttcagaaagaaaaaaaatatattcacatttccctccattttcgggggtaacagggggttctttactcatgtttaaatgcttttcttttgaagtagtttcaaacttgaaacattccaaaaatagtgtaaagaaggtttttttttattattatattttaagttctgggatacatgtgcagaacatgcaggtttgttacataggtatacacgtgccatggtggtttgctgcacccatcaacccgtcatctacattaggtatttctcctaaagctatccctcccctagcccccgacccctcgacaggccccagtgtgtgatgttcccctccctgtgttcatgtgttctccttgttcaactcccacttatgagtgagaacatgcagtgtttggttttatgttcctgtgttagtttgctgagaatgatggtttccagcttcatccatgtccttgcaaaggacatgaactcatccttttttatggctgcatagtagtctatggtatatatgtgcagcattttctttatccagtctatcattgatgggcatttgggttggttctaagtctttgctattgtgaacagtgctgcattgaacatacatgtgcatgtgtctttatagtaggatgatttataatcctttgggtatgtacccagtaatgggattgctgggtcaaatggtatttctggttctagatccttgaggaattgccacactgtcttccacaatgctggaactaatttacactcccaccagcagtgtaaaagtgttcctgttttgcaacatcatctctagcatctgttgtttcccaactttttttttttttttttgagacggagtctcgctttgtcgcccagcctggagtgcagtggtgcgatcttggctcactgcaagctccacctcctgggttcacgccattctcctgcctcagcctcccgagtagctgggactacaggtgctcaccaccacgcccagctaatttttttgtatttttagtagagatggggtttcaccattttagccaggatggtctcaatctcctgacctcgtgatctgcctgcctctgcctcccaaagtgctgggattacaggtgtgagccactgagcccggccccttttcccaactttttaatgaccgacattctaactggcatgagatggtatctcattgttgttttgatttgcatttctctaataaccagtgatgatgagctttttttcatatgtttgttggccgcataaatgtcttcttttgagaagtgtctgttcatatccttcgcctactttttgatggggttgttggtttcttacttgtaaatttttttcagttctttgtagattctggattttagtcctttgtcagatggatagattgcaaaaattttctcccattctttaggttgcctgctcactctgatgataatttcttttgctgtgcagaagctcattagtttaattagatcccatttgtcaattttggcttttgttgccattgcttttggtgttttagtcatttagtctttgcccattcctgtatcctgaatggtattgcctaggtttccttctagagtttttatggttttaggtcttacatttaagtctttaatccatcttgaattaatttttgcataaggtctaaggaagtggtccagtttcagttttctgcatatggctagccagttttcccaacaccatttattaaatagggaatctttcccccattgcttgtttttgtcagatttgtctttaaatagggaatctttcccccattgcttgtttttgtcagatttgtcaaagatcagatggttctagatgtgtggtgttatttctgaggcccctgttctgttccattggtctatatctctgttttggtaccagtaccattgctgttttggttaccgtaggcttgtagtatagtttgaagtcaggtagcgtgatgcctccagctttgttctttttgcttaggattgtcttggctatacgggctcttttttggttccatatgaactttaaagtagtttttttgaattctgtgaagaaagtcaatgataacttaatggggatagccttgaatctataaattaccttgggcagtatggccattttcacaatattgattcttcctatcagtgagcatggaatgtctttccatttgtttgtgtcctctcttatttctttgagcagtgttttgtagttctccttgaagaggtccttcacatcccttgtaagttggattcctaggttattttattctctttgaagcaattgtgaatgggagttcactgattatttggctctctgtttgtctattattggtgtataggaatgcttgtgatttttgcagattgattttgtatcctgagaccttgctgaagttgcttatgagcttaaggagattttgggctgaggcattggggttttctaaatatacagtcatgtcatctgcaaacagagacgatttgatttcctttcttcctatttgaataccctttatttctttctcttgcctgatttccctggccagaacttccaatactatgttgaataggagtggtgagagagggcattcttgtcttgtgccagttttcaaagggaatgcttccagtttttgcccattcagtatgatattgtttgttgctttgtcataaatagctgttagtattttgagatacattccatcaatacctagtttattgagagtttttagcatgaagggtgttgaattttatcgaaggccttttccgcatctattgaggtaatcgtgtggtttttgtcactggttcagtttatgtgatggattacgtttattgatttgcatatgttgaaccagccttgcatctcagagatgaagccaacttgattgtgatggataagctttttgatgtgctgctggatttggtttgccagtagtttattgaggattttcacattgacgttcatcagggatattagcctgaaattctcttttttgtgtgtgtctctgccatgttttggtagcaggatgaggctggcttcataaaatgagttagggagaagtccctctttttctattgtttgggatagtttcagaaggactggtaccacctcctctttgtgcctctggtagaattcggctttgaatctatctggtcgtgggctttttttggttgataggctattaattactgcctcaatttcggaacttgttattggtctattcagggattcgacttcttcctgatttagtcttgagagggtgtatgtgtccaggaatttatccatttcttctagatttttgtagtttatttgtgtagaggtgtttatagtattctctgatagtagtttgtagttctgtggaatcagtggtgatatcctctttagcattttttattgtgtctgtttgattcttctcttttctttattagtctggctagcagtctatgtattttgttaatcttttcaaaaaaccagcacctggattcactgatatttttgaagggtttttcgtgtctctatctccttcatttctgctctgatcttagttatttcttgtcttctgctaccttttgaatttgtttcctcttgctcttgcttctctggttctttaattgtgatgttagggtgttgattttagatctttcccgctttctcctgtggggattttagtgctataaattttcctctaaacactgctttagctgtgtcccagagattctggttgtgtctttgttctcattggtttcaaagaacttacttctgccttaatttcattatttacccagtagtcattcaggagcaggttgttcagtttccatgtagttgtgcggttttgagtgagtttcttaatcctgagttctaactggattgcactgtggtctgagagactgtttgttatgactgccattcttttgcatttgctgaagcttgttttaccttcaattatgtgatcaattttagaataaatgtgatgtggttctgagaagaatgtatattctgttgatttgggggtggagagttctgtagatgtctattaggtccacttggtccagagctgagttcaagttctgaatatccttgttagttttctgtcttcttgatctgtctaatattgacagtggggtgttaaagtctcctgctgttgttgtgtgggagtctaagtctctttgtaggtctcttaagaacttgctttattctttaagaatgttgaatattggcgcccactctcttctggcttgtagggtttctgcagagagctctgctgttagtctgatggtcttccctttgtgggtaacctgacgtttctctgtggctgcccttaacattttttctttcatttcaaccttggtgaatctgacgattatgtgtcttggggttgctcttattgaggaatgtcttagtagtgttctctgtatttcctgaatttgaatgttggcctatcttgctaggttggggaagttctcctggataatatcctgaagagtgttttccaacttggttctattgtccccgtcactttcaggtacaccagtcaaatgtaggtttggtctttgcacatagtcccatatttcttggaagctttgtttgttcgttttcattcttttttctctaatcttgtcttcatgctttatttcactaagttgatcttcaatctctgatatcctttcttccgcttgatcgatttggctattgatacttgtatatgcttcacgaagttctcatgctgtgttttcccactccatcaggtcatttatgttcttctctaaattggttattctagttagcatttcctctaaccttttttcaacactcttaggttcattgcattgggttagaacatactgctttagctcagaggagtttgttattacccaccttctgaagcctgtttctgtcaattctgcaaactcattctccatccagttttgttcccttgctggcaaggagttgtgatcctttggaggagaagaggcattctggtttttggaattttagcctttctgcactggtttttccctaatctttgtggatttatctaccttgagtctttgaagttggtgaccttcggatggggtttctgtgtggacgtcctttttgttgatgttcatgctgttcctttctgtatgttagttttccttctaacagtcagacccctttgctgcaggtctgctggagtttgttggaggtccactgcagaccctgtttccctgggtatcaccagcggaggctgcagaacagcaaagattgctgcctgttccttcctctggaagcttcgtcccagaggggcacatgccagatgccagccagagctctcctgtatgaggtgtctgtcgacccctgctgggaggtgtctcccagtcaggaggcatgggggtcagggccccacttgagaaggcagtctgtctcttagcagagtttgagtgctttgctgggagatccactgctctcttcagagccagcaagcaggaatgtttaagtctgctgaagctgcacccacagccgccccttcccccaggtgctccgtcccagggagatgggagttttatctataagcccctgactgggctgctacctttctttcagagatgccctgtccaaagtggaggagtctagagaggcagtctggctacagtggctttgctgagctgcagtgggctccgcccaatttgaacttccaggcaactttgtttacactgtgagggaaaagctgccttttcaagcctcagcagtggtgattcccgctccccccaccaagcatcccaggttgacttcagactgctgtgctggcagtaagaatttcaagccagtggatcttagcttgctgggctccatgggagtgggatccgctgagcaagactggcttcagccccctttccaagggagtgaaaggttcatcttgctggcattccaggtgccactggggtatgaaagaaagctccttcagctagcttgatgtttgcccaaatggttgcccagttttgttcttgaaaccctgggccctgttggtgtaggcacccgagggaatctcctggtctgccggttgcgaagactgtgggaaaagtgtagtatctgggctggagtgcaccgttcctcatggcacagtccttcagggcttcctttggctatgggagggagttccctgatccctttgtgcttccggggtgaggcaaagccccactctgcttcagctcgccctccgttggttgcatctactgtctaaccagtcccactgagatgagccgggtacctcagttggaaatgcggaaatcactggccttctgcattgatattgcctggagctgcaggttggagttgttcatattcagccatcttgccagccaccagtgtagagaagttttatccccagtctgttagagagtatgttactacctgggcgtggtggctcacatctgtaatcccagcacttagggagcccgaggcaggcagatcacttgaggttaggagttcgagaccagcctggccaacatggtggaaccccgtctgtactaaaaatataaaaattagccaggcatggtggtgggcatctgtaatcccaactgctcaggaggctgaggtaggagaatcacttgaactctggaggtggaggttgcagtgagccaagattgcgccactgcactccagcctgggcgacagagcgatactccatctcaaaaaaaaaaaaaaagaaagtgagttaatgtcccattactcctgaatactttagtgttttgttgtattcttttcctagtctgttggtgagtttttttgtttctttaattgtcttttggagggcaaaagtttaattttgatacaattgactttagcaatattttctctagatattgagctttttgtatcacatctctgcaatttttgcctaatttaaggtcaagaagatttttccctatgtttttttctagaaattttttagagttaggttttatacttaggtctctcatccatttaatttttctatatggtgcttgtgatgggatcctctttctagttttacatctgcacttagttatttccattttgtttgttaaaaagactattcttttactattgagttgactatatatgtgtaagtctatttcagactcttccagtgatttctgtgtctatcatttccatctgtttctgtccttttgttgatatcatactgtcttaattatactataacttcatgtcttgaaatccagaaaggttagtcctccaactttttgtatttccaaaatgttttcgactgattcctttgccttttagaatcaacttatcaatttccacaaaaattctggctgagatttggatagaaattgtatcattaatttgggagaattaacattttagcagtattgagtctttcagttcattaacatggtatatctctccatttgcttaggtctttttaagtttttaaaaattggttatttgtagcttaagcatccgtttgctaatatatgttgttaaatttgtacatagtgtatgggctgaattgtgcccttcaaaatttatatattgaaccctaattctgctatttcacattgtgactgtatttacagataggttctttacagcagtgattaagttaaaatgagaccactagggtgggcgctaatccagtttgactggtgtctttataagaaaaggaaatttggtctcacagagacaccagagatgcatgcacactgaggaaagcccatgtgaggacacagaaaggaggtcatctgcaagttaacgatagaggtggcctccagaactgtgagaacatagatttctgttgttaaagtcacccagtctatgctattttgttatggcagctctggcaatctcatatacgttttggtaccaagcagtgagttgttgcttaacaagcacttagaaatgttgaagtggctttagaactgggtaatgggcagagactggaagaattttgaggcacatgttagaaaaaaacctagattctatcgtttaataaattattgatataaaatatggacgttcaagctgtttctgttgagacctcaagtggaaatgaggaacatgttatttgacattgaagggaatgtggtccttgttataaagtggcaaagatcttggttaaattatgttctagtgatgaagttggatatttagctgtggagatttctaagtaaaatgttgaaggcatcgtcttatttctcattgcagctggtcaaatcacttgaggccaggagttcaagaccagcctggccaacacgatgaaatcccgtctctactaaaaatataaaaattagctgggtgtggtggtgcacacctgtagtcccagctactcagaaggctgtggcacaacaatcacttgaacctgggaggcggaggttgcagtgagccgagattgtgccactacactccagcctgggtgacagaaggagaatctgtctcaaaaacaaaaaaaaaattgtacaatatgtggttaatatgtgtttgatttattacaaagatgccagcctagctaagtgggggaaggatcaccttttcaacatatggttctgaaacaaccggatttccatgtggaaagtaaattaatttcaacccttatcttatatgcggaatttaacttgaagcatagacctaaatataaagtccacaagtgtaatttctggaacaaaaaatgtaggttaaaattttgaatccttgcagtaggtaaagataccttaggatataaaaagcgcaaatataacaggagaaaaaaataaataaattggactttataaaaattaaatttttctgctgtttggaagacattgttaaaaaaggtgaaaaggcaaaccatctaaccatccacttgggaaaaatagttgcaaaaatatttttacaagtccagacttgtatctagaatatatgagaagactaacagctcaataataaatgactaaacaggtagcatgaaaagatgttcgactttattactcaccagaaaaatgcaaatcaaagccacatagaaatactactacacaatggttagaatggctaaaaataagaagaatggcaataccatgtcaaggtgttgccatgacaaggatttaaaactctcatatgttacttgtgaaacttgaaaatagcataaccctttgtaatttagtttggtagtttttaaaaataaggttaagtatatacttaccatatgacttgggaattctactcctaggtttttacccaagagaaatgaagtcacatgcctaccaaaagacttgaactagaatactcacagtagggttattcataatagtaaaaagttgcataaaacccaattgtctatccagaagtgaatggataaggaaaaatagtatattcatacagtagactactactcaggaaaaaaaatactaatacatgtagcagtgatgggcagtgattgagtgtagggggagcttccctcaaaactccagggcattttagggaatagaacgcaggattacttggcaattcatttaagaacttaacaaaacttgtattctaaaacctaacaactacattataaaagaggaaaataatagcccagtttcactaataaatgtaagatacaaaaatttcaaaacattaaaagttgaaattaaggtaacatagttgttacttttgggaggatgcctaatgattgcaaggagcttaagggaggcttatgagttgcttgtaatgtttcatactggacctgggtggttggtaggttgagtgtgtttactttctgaaaatgtattgaactttagagtttatgtacttcgtgtagtagattataatgtgcttaaaaaaaatgctgctgctgcttccaaaatgagcagaatttcacagaatggcaaacacaaataaccaaggaagctatttgtgtttgatatgatatgtaaccgttatgcatttgtgaaattgtaattaaaactaggatgacatggccaatgagactgatataatttgaaatctttgaacaccctaagcattgtgaggatatggagagatagaaactgtgctgctggtgttagtgtaatgtcttatcaccacttttgaaaatggtttgatagtgctcaataaggtgaacatatataattttactgtttgggaaagttttatccacaagcacctatgggcatatcaaggatgtttatagtagtgctacaagcaaaagcaaaaatctataagcaacacagatactcaccaacagtatagtggacaaataagtagtggtttcttcatcagtgcaatacaatatcacagtaaaattcagttaactatcagtgtggttaaaatttaaacattgttttgtaaaggaagtcacaggaaaatgtatgtcatatatgctacagtttggaaagaggcaggggtaaacgatgcattatttagataatcattcataggtgctttagtacaaacaactaaataaaagcaagatcatgatgagaggtagggaacgtgacaaggaggaatgagatccgggaggaacacataagaagatgcttctaggtcaggatgtggtaatgttttattgcttggctgggttggaaaattcagatgtgtcttttattattatttttttaaactgcaaaatttgtttttatatatgctgtatttctccaaactgtaaaaaagtaaatttcctgaaatacctttcagagatcaaaaataaaagtaagttcctcaattctagaggctttaagtattgtgacttgtgtgttcctcacagatgtcctgatttaatactatgttgacttaaaatataagatctgtttctactcaaagcctgtcatcaaggacattattaaaacagttctacaatttttatttagccttaaaattgtaaaactacttctttaaaatctgcgttttataatgtatttttctaatttaaacctgattatcttctcagttaattcaaattggatagctttttgtcaaaactgttgtagaactttgaataaacattttttgaataagcggtgaataaacatttttgtgctaatcaacattgaattacttttctttcagattcaaacatctacttctttgggaacatcacagatttcacagaaaataattcctctcttggaacttccatctgtttctgaagatggtaaaatgaaactgcttaaggatatttttcttattttattaaaataatttctgttttgaggcatatttttctcaaaggaccacacagaggaaggaaaatatcttttccttttaaaatctaggttcttgactgaggctctatgaatggaagacagattaacatgagaaaacaagcagatttactagcattcatatttcatgggtacatgcaagaagctcaggaatgagtaactcaaggtggtgattaaaatttgggtttatataccagtttgggcttaaacaaaggaaaagaggttttgggcttcagggataggggttgctggggaggcaaggtatatgggaaggcgaccagaaaaagtatggtacacaagggtaaagtttgttacgcagatatgtcagtgttttctccgttgataagaatgtcttgggagtaagagtcatcttccctggtacagaaaggaagatacctttacaaggtagatttctcttataaatgttaatttcccttagaaaagggaaacttaggatctgtcttcagagcttttcctgtgtctgctgtttcttaaaataattgactcagtgtaatccttatgccaaaaagacatgttttcgagtggcgtattttggtcttctgtagtcatataagaaatttaaggcaatagcagatatttgtatattttcaggaaattttaactaaaatttattttaaatagcacaattccttaaagttgcttttgcaatgggatttttttggtataaagttgaacagaaaatgacaaggaccagccaggcgcagtggctcatgcctgtaatcccagcactttgggaggccaaggcgggcggatcatgaggtcaagagatcgagaccattctggccaacatggtgaaaccccacctctactaaaagtacaaaaattagctgggagtggtgctgcacacctgtagtcccggcgactcgggaagctgaggcaggagaatcgcctgaacccaggaggcggaggttgcagtgagcagagatcgtgccactgtgctccagcctggtgacagagcgagagtccgaatcaaaaaaaaaaaaaaaaaaaatgacagggaccactaataagttaattatctttatttggctgtgagttaaaaaacaccacaaaacttcacagatgtcttaatttctaatgtgttttttagttatttggaaaattttgctatagtatatttaaaacatttttaaaaatataattattaaaggaaaatcatcaataattatctacatttacatataaaaatatataactattctgataccaaatatgtgctttttaatgaccgtattagaaaaggtgtatgtctatatttttaagactttaaaaattgataaatgttaaataacagaaactgccatgtcgattcttggtttcttagagaacaatttttctttatttatagtcaccagagagaagttgtttgtgagatcatctactttaacttcagtcttagtttattagggatatacttctgattgtttcatttaaacctagttttaatggttttactaagttatctaatgctttttcagtcctttttaatatcagcatatgtgtatgctgatgtgtattacatatcaacgtatatgtacatatacctatatttgtgtatatatatgtatacaaagtagtgcttgatctcagtttacttcattcagactctgctgctaatattgcagagtttatacctaagtcctgttacactatccaggtagagtgagcatattaacatattactttgagtattcatggtgtgtataatcatcggcattggcatttcctgtaaaatttaagcaattttaaaatagactatttcaaaagatgggcttcttaagctaaagattacatcttaataatgttccatgcttctttataaccaagaatgttatttaaaagtagagtatccctttgtttaaaatggacaataaaaaagtacagtaatgtctatattattttctgtttatttcggttctcatgttaatatttgatatttaaaagagagccttagtgttttagtgttcatatttatttctattgaaatactgttaaattgatcattttaattattgacttaaataatgttctgtgaaatgtagattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggtaggtactacggtaaaattaacatggcttaatttgtttgctgtttctatatttacagcttactatatagtctcattgttaagaagcactatctttttcaccctaattaaagtaattccagacttgctgtgtgattcttggtcactccccgccccccccttttttttttaaataagattaacttccttaatcaagagtgaaggatttaaatttattcagtacatgtttttgtgaaaacgattatttatgttgtgtgtgtattgtatgtctgtgtgggtataaaatctctcctaaattttaaataataatatatcaattgtatgtatacctcatatattcacatgtaaccactatgcacataaacatgtttttgttttatgtagtggtaatttcttttttctttcttctccaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttgggtaagaatctctattttttaaaataaataaattaatttcattgtttgactacctgctagagagttttcaattctttaggctctgaatcagtacatttgctgaaatattctcagagaaccattcctttttgagttaatctttaacttttatagttggtaatgtggggggcacaccggagataaaatgaagataattttattcattatggaaaatcagatgataatggttgaattttaaatctacttaactgagtattggaacacttaattagttttctattgttgctataacaatttaccacaaacttagtgcttaaaaacaacacaaatttattatcttagagttctgtatgacagaagtctgacacaagtctcactgggcaaaactcaaggtgtcagtaggacttccttttaggaggctctagaggagggtccatttcattgttcagtcaggtgttgacaaaattcatttacacatggtttaagtctatgtttccttgttgcctgttagcggatggctgcccttaggcctcagttgcttttttgcacgtagctgctaaccacaataaggcatcagatcctcctcatgttgccatatctctaacctcctcttctgtgttttgcttccactcttaaaactccagtgattagattggacacacctctataattcaggataatatacctttaaccttaaccttaatcccattttccaaggcccttttgccatatgagttaacatattctcagattccgggggattagagcgtaggtatctttgttgggggcagagggcagtattctccttactgcaaaccttttgtgttcgtaatggatatatgatccctaagaaactattctgtttcctatgttaggtaattaggagggttgtatttatatttcttcatttacattttttggatttttccttgaaagataattgtgaatagtagaggcaattattaggacaccagtttcattttattaaactcctttgtagcataataatattatgtatgagcagaggtggaaataaaattttttaaatagactattttttagagcagttttagatcatgggacaattgagcagaaggtacagagatttcccatatactccttgtacccacacctgcatagcctttttcattatcaacatcctccactagagtggtacatttgttacaactgatgaacctacactgacacatcgtaattaccaagagtccacaatttacattaaggttcactgttgctgttataccttctgtttggacatgtataatgacatgcatctaccattaccttctcatgtggagtagtttcactgccctaaaaatcctctgtgctccacctatttgtccctccctcccacttaacccctggcaactggtgatccttttagtgtctccatagttttaccagcatgtcacataattggaatcatatatatccttttcagattggcttctttcacttagtaatatatgctgaagttacctccatgtcttttcataactgggcagcccatttcttttttagcaatgaatgatattctcttgtctggatgcaccacagtttatttatccattcatgtactgaaggatatcttggttgcttccacggtttggcaattgttaataaagctgctgtgaacatttgaatgcaagtttttgtgtagacataaattttcagtttcactgggtaaataccaaggaacatgattgctaaatcatcaagaaacagtttgctctagtaattggaaagaaaagtaaaccaacgtgacagtgttccctagtaacccaggaactttatagcagttactaagttttttttattattattagttttatttatttttattttttgagatggagtctcgctctgttgcccaggctggagtgcagtggcatgatctcggctcactgcaagctccacctcctgggttcatgccattctcctgcctcagcctcctgagtagctgggactacaggcgcccgccaccacgcccagctaatttttttttttttttttttttgtatttttagtagagacggggtttcaccatagtctcaatctcctgacctcgtgatccgcccgccttggcctcccaaagtgctgggattacaggcgtgagccaccgcgcctggccacacttattaagttttatgtttattcttatgtttgctttgccaagaacaaaggattaaaaaacccttgcaaacagaaaaaagagtatacaattattattgcgcttatttctgtaatatttttgtttctgttttctcagagggagtgaatagcagtttcttgcacaaagtaaatgatcagtaaatggttcaatgaatgaataaatgtgtaaacaaagtgggaacttttttaaggcttcaagtgtggctagcacttggagtagaaaacaggtttatgtgctaagcattaggtttggagaactctgtgcaatttgtggcatttttttctcaggaattgtaggattagtttgtagtcctttcttccagtctttagatactaattttctagcaaccgtaagtcatttggtgatgagagttttaaaagctttctataaattctcttctacactggttttcttagtatagcacattttgagcagaagcagtaatattaaaatgggagagttcctttattcccctcgcaggacatgccacaggggtgtgtatttccctagagggagcatgcagatgggcaggtgcagaggctgtggggagtgcttttgggctccggccccaggacagcatctaggggtaggtgtctacaacccctgaagcccaaggggcatgtgttacagtatgctctttcaactttgccatctgcagacagcttttgttaatcacctcgatagaccgtcttccttatcgcaagggcagggggccattgtgactgcctgagttcttgcccagtgtaccagaagaattggatgacatgtgggctggaaggatgagtgcaaggttttattgagtggtggaggtggctctcagcaagacggatggagagccggaagtgggggatggagtgggaaggtggtcttcccctgaggttgggccacccagcagatggactcttcactgacagcccctagttgaactaccccagcgtccggacgtccacgtccttcctcttctctctttttctgccatgctgccctgccactctctgccactctccaccactcttttcctctgctcttctcaatgctcagctgcttgtatctgtgcccactaaggccttgggcttatatgggcacaggatggtgggtatggtgggccaaaaggcaacttttcaggtgcaaaaacagaaatgcttgttctcgtttagggcctccagtttttaggcttgagggtggggcctttgctggggaactgccctcttctacccagtatttccctgtctgctgtccatatcagtataactaataaagactgattacatggtaatagggtttattttaatctaaactaatatacagaaaacttaatgtttcatctcattcccggtctgtcttctgaacagctgggttttcaaggactctgatgatttcctttttagttatttcagtgatccagggccagaattctcttcctgccctttcattgttcctaaaaaccattctagtttctctttagttgattcctgttttttcttaccttacctcctatctaggtttagaagggtatgagacttcagtgttgtggcacatgaggaggtaagggaattgtgaggagaaattaaatttttagagtttaaagaacaaagaagtaacttgacttgggtgaggtagaatccaaggtccagaactcatataggaaagccttcttttgcaattacataattaataagattgcttgcatttattttcagttacctttccgatgaaaagataatttttaaaaaattatttttagatgaaaacaagaaaccagtttatttggttacaaccctggataacacaatggaagacctgttaacgctggaatatgtaaaggtaagcagtttcatttatatctgcttaatatggtaagtatgctgctgaaatgttaagttttgtaagtttggtattattcagtttatttaatcttcactgtaacataatctctttgtaactcctaatactaaggttttttttattttgtcatcttgtattaaatagttgtgatttataaatacttcatatagcaaaataagaagattgtgttctaagtagaaatgacctggagtttgattttttttttctcccaacaggggtactgagaaagaaacacactttttagtcttgttagagtgtattgttttatgtgatacaagatgatgctttcactttcttttccactgttttgtgaagttacttgatattcctagggtcaataactccattccttttttattgatttatgatattcattttatcgtttgttaagcttttctatgtactatggtctatttctaatttttccatgtttctgctgacttccgtgtttctgcgtcagactattttaataattactttataataagaataatgcagaaagcatttaatcactttaaaaccatttttgctatccattattgactagatgtcttaagatttttgttgtatatgcattatatagcttttatgtagcaaaagtattctagacctaaagaaaatggataaagaaaatgtggtatatatacaaaatgaaacactattcagctttaaaaaagggggggaatcctgtcacttatgtcgacatagatgaatgtggaggacattatgctaagcaaaataagccaagcacggaaagacaaatacctcatgatcttctttatgtgtggaatctaataaaactgaacttatagaagtagagagcacagtgatggttaccagagggtagcagggatgggagggagggaaggagagggaatagagagttgtcaatcaaatggtacaaagttccagatagacaggaagaataatttttgagatctgtatacagcaggggaactgtaatcaataataatgtgttgtttattttaaaacaaccaagaaagtgaatttcaaatgtctcaccacaaagaaagataggaaagcgaggtgacagatatgttagttagcttaatttaatcatttaacattgtgtacatatatcaaaacatcacattgtcctccataagtgtatataattatgatttgtcaatcaaaaatattaaattttttaaaaagaaaaagaaaacacagagtatttggatacttggtggacaattctgtcacaaattttgtttttaaatacaggaagaattaggaagaaccgtacagagttgttgatgaccgaatgattattctccacacttgataatatccaacatttcctctcttaataataagaatgatagtacgtaacatttattgaatacttgctatgtgccagagagtccaatacttacattttcttttgttctggtgaagcggttgcttatttaggtaattatatgtgtgtgtatatgtgtatatatatatatatatatgtatatgaacagctggaaaattatataaatgtgtattaggactataatgtgattgtatatgtatgtcttcctaacgtgttctaacagatttgttttctctttggataggctgaaaagaatgtacccgacttgaaaagtacctataacaatgttttacaattgattaaggtatgagtagataatttattttttaattatgtactatttcttatggaaattattttctaactggaattgtaagatccttaaagataagaaaatattataaattatatcctttatgccacaaagcatagtgccttgtagagagctggcaagcaaatatttattgacctatcactaaaatcagctttgttctttaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattaggtatgttttttaaaaatttagcatcaactttttttttttttaaccatgtaggtcaataaatctagaccctgactttattattaacttcaaatattggcttcagaattctgttgcctaggttaatatctagaaggattcattatatgccaggataattttagaaaataaaggaaactactggcgaagaaaatgttgcttttgtttatcgtatataataattgtttttagtttaagattatatagtaggagtattagattaaaaaattttttttcttccacctcccagtaggaggattagatttaaattaaaatttatgcatttcatgacattattttagattagacaaatatgactaacaaaatttgagtattgtcagctgggtgcggtggcttatgcctgtgatcccagtgacccagggaggtgagcgctgtggggattgaggctcaaggatcacttgaggccaggagttcaaaactagcctgggcaacatagcaagaccctgtctccaacaaaattttaaaaattagttgggcatggtggtgtttgtctgtagacccagtttacttgggaggctgacacattagaatcactggagcccaggaattcaaggttgcagcgatctttgagctacaattgcaccactgcactccatcctgggtaacagagagagactctgtttcgaaaaaaaaaaacaaaaaagagtatcagagcatattttaaaatcagagtatagtactttcgaagcagtgaaaagttgcaattttgataatgacaagtatcacctagtaattattggttctcaaaaaattttgaaatttatagctacagtgttttagtttcaaatgtttagtttcttcttgaaacagtgttgtctatttgcttttgtttttgttagattttattgttttttagaattttcaattcagtagggaatatcataccttgctttcaactgaattgcagatcaggttttctctgatatcactatttgtggtgatatttcagttactttataagtatagtgaggtaactactaaatgtttttcctcatgttttataatatgaatttttttttgcagctttaaaactatccacaaatgaagatatcattactttgcagattttagcagaattatcgtgtttacagatctttattcaagatcagaaatgtaacatttctgaaattaagattgaaggtaataaaatttcacaaaaagcaaattaaaagacattaaatgaaagaaaaggcagtcattcttttgttcccttagggcttgattctgagatgattatgaggccttcagaaactgaaataaacgcaaagctaaggaatataattgttttagattctgatataacagctatatacaaaaaggtaagaattcttttaattaaataatagtacatcattaaataggattgtcctttaagagtggtcataggtatcatttggacatttgtcagaatttagtagtatggcttattatgtgcatgggttttggagtcaggcataattgggttcttagctctactccttagtagctgtgtgaccattagcaggttacctaatcttggactctgtttctttatttgtaaaatgaggattacagtatctcataaatgagataagtacgaataatgctgcaggaacaaagttttgggagagaacctagtaaatacctttttcactttttttttttttttttggttcatgtactctgaatcttgtaatgcattttagatacatttgagggtctgaagtctgaggaagtgagattttttataaagcttattgtcatcagcgatcactagtatcgttgttgtaataatgataagagagtcctttgaactggatgattagttgttgaaggttaggtaatttgttactggttataaaacagtgaggttcctgctgcagagttgaacaggcaacatcctacctgaagcaggcaggattatgtatttaaggaggttaaaggaatatcagatagtaggatcaggaaaaactgaagtacttgttgagtcaggaagtcagcatttggaatatgttgagaagaaaggaaatagataaatagattttgccagtaatactgtagtgatgaactgatttttatgtttaaaaaattcttatttctaatatcttcttgttatggcttatttagtgggatagaaaaacagttccaacatcaaaaagaagtgactcatagcaataaggaacaagaaattttccagaagccgtggttttatttgcttctattgcttttattttaaaaatcataagtatcagagtatttaagaaataggttatccattttattttccctatctagaaagtaaagctcacagaaataaagtatctacgaaaagttatacagaactgagagcatgatccaacccattgatttttttctctgtaattttattttattttatttttttattttttttgagacagtcttgctctatcacccaggctggagtgcagtggcgcagtcttggctcactgaaacctccacctcctgggtttcagtgattctcgtgcctcagcctcgtgagtggctgggattacaggtgcgcacaaccacacccaactaatttttatatttttagtagagacagggtttcactgtgtttggccaggctcatctcaaactcctggcctcaagtggtctgcctgtcccggcctcccaaaatgctggtattacaagcatgagccactgtgcccggcctgtaattttatttttaatatatctacaaggttaaaaattcagtttacagaaagttacaaaataaaaaaaatctttctccttgtcttcttgcacgattttcatttccctttccctgtttctttgattccattgtacatggtttttaaacaaactgccttgtttagtaactttccacgtgtcaaagaaccagagaggcataaggtttttgcccttatgaaatcagacctgattatgaatcagtttcataagccttgtacagcgatatatattattgtgccagttttaagtgtactgagacattgaggccctcaactttaagggtgggagcccccagaccatttgtttgactctgtcttggagcagcatcctccatttactgtagcaccattggacaaatactgtttttatttatatatgccataaggtaaaaaggattcttgctgacctgatagtctcatgaaaaacatatcatagtaaattagtttctgatatcttcttcataaaaaatattttgaaagtaaaggcttaaaaaaatccaatttttaatgcttaattcttggtgatgggtacacaagtctttctaattattctcaacttttctggccttgttattaggccaacacttgcttcatgaaatgagttgggaaatgctttcttcctgttttctgaaaaatttgtatagaatttgcattattccttaaatgtttgatggaattatcagtgcaaatattttttgtgtatagttgagtctgggattcactttattttattttccatatggcattcagtatccaaaggagatccacacactgcatttgattgatataccacttaagtctgttatagtttatgaatttcctttagtttcttctctgcccttgtgttagccatttgttgctatcttatttattctgtacaattttccatagcctgtatcttgctgattatgttttcatgctatttaacatgttactgtatcctgtgtttccttaaatcggtatttaaatctcagggcacagtgagattcagggtttgggagtaggggttggcaagatacttcatagttggtagtgtgtgttttcataggaggcacatagtgtgtagctgtcttttttttcttttctgttttgcactgtcttggaatattttcttttttttatgttagaagctatttgttgttatttcctgtaatttggtcttgaagtctgtgtctggagagtggccataagccaaaatagccactttctagcttgcaggcatgttggtcagatgggacatcggggaggcaacacaacaaaacaccctcgaggggtgcccaccagggaggctgacaggaagtctggaggcagtagggacgtttcttcatttattaaatgggagagttcaccagtctttatgctggtatcaccaatcattttggcttttcaaaagtttattctccagtagatttcttaggcagggctcataggaacaataatccttatttatatttgcagggtagtttgactggattttaaattcttgccttgaattttcttttctagatgatcttaaaacatattactccatgtcttatggcctagtattggtgttgacagttctgatgacagtttgactttctttcgcttctaagaactttgccattttccccagacattcagagctaatttgaagctttatgtagggactttggacaggtagacatcacagttgatggtcaggaactggtctagcaattttatgggttctcagattgagagtatctcttgttcttaggctagttagtttccgttgagaaaaatactattaagtataagcctggcagcctacattccagaagccaattggttgaaagaagtggaggcctcatcatttagtttatagatttttgcttaaaataaccactttttaacatggtgttttattaaccgtctttctgtacctgaagtctcctagaccacagcctttctgctctaaactctgtcgagcaaatctgttctgttgaactcggagaggaacagtcatatagtcctactcatgtgacatgcagaggctattcggtttattctaaactaatttaccagtatttatataattatatagatacaatttatacattaatatatatgtaaattatatatgtataaatactggtaaataaattaagaaaaaactaattatatatattatataataatatattttatatatacataaaattctctctctctctctctctctctctgtctccaatcacacaatcacagctcactgcagcctcgaccttccctggcccaggtgatcctcccacctcagcctcctgagtagctaggactgcaggtgtgtgccaccaggcccagctgatttttgtagagatggggtttcaacattttgctcaggctgccctcaaactcctgagctcaggcgatctacctgcctcggtctcccaaagtgctgtgattacagacatgagctgagccacagcgcctggcctatttgagatactatagtcagcaaaagataaaaagcccttctccacgtggaataaatagtagttaatcagtaatataaaacaatattagagagtgatatgtgctttgaaaaccaagaaagcagggtaatgtgacaggtaataattcacgtggcgtattaggattatcaagaaatgcttttttacagtagaaacatttgacagaaatctgagctgtggatttgagccctgttgaaagagctttccaggtggaggaaagagcaactataaaagccttgtagcaggaaggtgcttgctatattctgggaggttttagggccctcagtaacctttgggtagaattatttattagtttctgttttggtttagtttttactttttaaagtaagatttattgagacaatttacctatagtaaaacttacctcttttagttataattctgtgagttttgacgaacatatactgttgtgtaacttaccttcagcatatacaatgggtctgtcaaccctaaatattcactactgccctttgaggttagcccttctccccatcctagcaccttagaatcactgcactgtttttcgttcctgtagttttgcagtttccaaagtatcaaataaatggaatcatgcagttatgtagtctttcacgtttttttttcttagcatgtgagattataatttttgtctttttatgtcttgatcagcctggttaacgatgtatcgattttattgatactttgaaagaactggcatttgtttcaattgaatgttctctgtttttaattttatttatttatgctcttttaagattccttccttctgcctgctttggatttaatatgctcttcttaaggtggaagtttaaattattgatttgagaatgtctttctgttgtaagcatttgctgctataaattttcctttaagcactgctttagctgcttcctgtaagttttgatatgtcatatttttattttcattcaattcaaagtattttctaatttctcttctgactttcttttacccattgtttatttagaaatatgttatttaacttctaaatattttgagattttcagatccctttctgttactgatttctagtttaaattcattatggtcaggggagaaaccgtttcagttcgtttaaatttgttgatgtttgttttatggcccagaacatatatgattaatcttggtgaatgtttcaagtgtacttgaaattaatatgtgttttgctgggttgaatgttccatttgggcaagtaggttggtggatagaattattcaggctactgattttctgtttactggttgtgttgaagcctctgattataaccattgatttgcctgtttctcctttcagttctttaagttttttgctttgtatgttttggagatctcttgttaggtacatataaatgtgtatgaattttatgccccttttgtgattatgtgatgtgtctttttatctgtggtaactgtgcttgttctgaagtctactttggtagtaatatagccattccaggtttcttcggttaggtttgaatggtctatctttttctgtcctttagcttttaatggatgttttcttgtttaaagtgggtttctgttttttgatgcaaagtctcactgtgttgcccagggtggtcttgaactcctgtgtttaagctcgcctcagcctaagtagtaagtagctgggattatatgtgcatgccaccacatctggcttaaaatgggtttcttacagtcagtgtatatttagatctttcttttttatctaatctgacaatctcttggcttttaatttgtgtttagactattttataaaactaattattgatatgattggattgtaatctgatatctctaattgttttctgttctctaattttgtttatcctattgtattcctccttttggcctgatttttgattaattatcatttattttatggtttctctagggtttacaatgtatatatctttaatcatagtctatcttccaataatattttattgttgtacatatagtgtaagaatcttacaataccatgcttccaattcccatttcctatctttcttggtatcatcataatttgctttactttggtgcatgttgaaaactcacaatgtgtacctattgaatttggtttagtcagttttctttggagcaattagttttctaaagatgttttatatttttcttcattgcaactctttctgtaactacttcatgtagtttctgtctattgtttgtatttctctctgaaatactttctcatttcttttttttttttttgagacagagtcttgctctgtcgcccaggctggagtgcagtggtgcaatctcagctcactgcaacctctgcctccggggttcaagtgattcttctgcctcagcctcccaaatagctgagattacagatgtgtgccaccacacctggctaatttttgtatttttagtagagatggggtttcaccatgttggccaggctggtcttgaactctttgacctcaggtgattcacccacctaggccccccagagtgctgggattacaggcgtgagccaccgcatctggcactttctcattttttataatgcaggtctgccagtaatgacttctctcagttttttgggtatagatgagaagggagctgggaaaaacctttatttcaccctaatttttctgagtgacatttttgctgggttgtgttttccccctttccaactgttaaaagatgtgatttcattgttctttgttacacatacttttgatgagaaatctatgacatttcttatttttgttcctctgtacataattggtcatcttttttgactgctttcaggatttatatatggtgtgactagatgagtttaattgtgttttgatatttgtcctgtttgggcttttctgagctacttggatggatctgtctttcaatatttttcatttttttcttcaaatagtttctttgcctctgtctccctttctctcccccaccccctggctcccctgttttctcctcctccactttttccctgttcctcttcttgaattcctgaaattcttgctggatttctgtttatagtcccacagcctttggatgttctgttcaagttttttccccattgttttcttagtgccttttaattcaaataatttatcttgacctattttcaaatctactgattttgtccttggctctgatgagtgtactgacaaacccactgaaggtattttcatttatgttaccatgttttttaatctttaatatatccctttgactcttcttttttccattttctctgctataataatattcaccatctattcatgcatatgttccactagaagcctttaccatattaatcatagtaattaaaattaaaaattttagtttcaacattgatgttatagatgagtctgattctgttgattcctttattatttgcttgaattttttcccttgcttttatagggcatctcataattattgatcgaatgtcagacatcatatcatgcatagcaggagtccccaacccccgggctgtagaacggtaccggtctgtgacctgttaggaactgggccggacagcaggagttgagtggtgggcgagggagcattattgcctgagctccgcctcctgtcagatcagtgggggcattagattctcatagtagggtgaaccctattgtgaactgtgcatacgcaggatctaggttgcatgctccttgtgagaatctaaagcctgatgctctgaagtggaacaatttaatccccaagccatctccccaccctccaaccccccagccccacttttgtggaaaaattgtcttccacaaaacagctccctgttaccaaaaaggctggggaccacagatgcatagcataatagagactgaggtaaatatcatagtatttatgtctggaaacggggatgcctcttttctgctaagctattagcttggggtggggggttgagcttaggttggtttgaattccagattaatacgatttccttcactacattactgcttcagtttcctttagttgtaccttgtgcttagggtggctggaggctgtgttgctcagattttgctccgtgctgagcctttgacctttcttctactcttgtacctcagaaaattctctttccacattcttagctctttcctagatgttagaggctcctgctgcttgtttcttagtgcttgtgagcttgatgtatttggggagaaggcaaggtggtttggataggcttgttagtgttcttgtccattttcactcctagccagggctgtttctgtgagtctcagaaatggagtattcttggccatcctgcccctcctcctcatggcatctgattgatatctctcgtatttcctatgtgggattgactatccttcccttccccagcagagggagacctctaatcatctggccccaggagagttcttgttcttcccctagagttttattttattcttgtccctaggatactgtatcttcacctgtgccctgagggaaacaaggtttactgcccttcccctagtttcttatggctattgttttgagtagttgataatcttggtggtgctttgggccttttctgcagtggaggctcctcaccttttccagggtcataccaaggaaagccttctcttgtttcccacttgcacccatctcccgtctttctcaagagctcctcacgtgtgtggctctcagggattctgcatctcacattagtccacacttatcctttatcattttagctgaattattcttacctatattgtatagtatctgacatctctttctcctctctaccacaagtgagctggtgcttattttctctctctccctgaaggtacctgtttgtccttagatttttagggatctttgttgtcctgtgacctcagattgctaatggttttaagaaagttatgatatcatagtttatcgggttttttttccttttcttaaggtttggaggggccctcactccagctttgtgcaccctaggcagaagcaggactgtagacttcttttcagccctgtcttgtacctcagccttcggaggtcacttatacctctggttctggaggattctttgttctgtagttgtaactgatttgcttgttgatggctcttcagctccctgttcttgcttgcttctagcatttaggagaattgagaaagttatgagcttagtgctctgtccctcttccaaaattttttttaacattttacatctcctgttgtcgccaccatttttaactgttattgcagagcttgagatttttaaccactgtaggtaatttctggttggcaattaagatggccctttacaatctgataaggaacagaagtatagcaataggaggagactcctttgaagaatccagaaaaatctattcacatacctcaaatcaggaatagatttcagtaaggtgtagatatacagtgtttttcaaatttttgtcagtcaatcaagaaatacatggttactctcattacgaaagtatacttgcaaaatgaaaatgcatattcagatatttcctcttctccattaaaaaaaaaagaaaaaaagctggagccacacctactaccttgattttatgacccacaaaggaaattgccaccaccaatttgtaaaagtttgtagtgtaggttccaataaaccagttacagtagaattgttgcctcatttgtacttggcttgtgaatacttgggagattttctaactatgttttgttattttttactgttttatttttgtactgaaaatacatcatttcaaaaatggattgtgataattaaattttctcttattaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggtaagtattttattaaattattatttattttatactaattggaaattgctatatgtcaaatatggatgaagactagtaagaattccttgcttgagattttttctgattttttaaatcttctgggtaccatttattatacataataaatgtgtagttccttatttatataacatcgttttgacataggaatattctaattaattgaaatatatatttcatatagtaacattaagtttatgtgcattatatatcataaatatgttatatattaattagaaccttcgttttatatgtcattggcttaagtcttcgttttacctgacttgcaactataatttaaaaatactgaatatataattgaagtttgttttggtctgaagtcatcattaagaaaaggttattttaattttctagagacaaggtcttgctctgtcacccaggctggagtgtagtggcatgatcgtagctcattgtaaccttgaactcctggattcaagtgatcctcccgccccaacctcctgagtagctgagactacaggcacatatcaccatgcacataccaccaagctaattttttttttcttcaagtttttatagagatggggtcttactctgttgcccagtctggtcttgaactcctggcctcaagtgatcctcctgctttggcctcccaaagcgctgagattacaggcattatgtctggcccaagaaaatcatattttcgattgcattgtcattctgtgaatatcagggactttaaggagttagatttaacccctatatgactccaccctaaggcatttcggttcttatttcggcttttcttgtttcattttgtttcggtttttgtttttcccttgctgtcagctgatattttttcctgtgggtgtcacacctatctccataacatcactattcattcttttaaaatgctgtctcagtgttttagtgtatgaactaggtaatcaaatctaaggctgtagtggaataaataggccaagtgtggcaattcttataagcaagaaaagtatttgcgtgttcatttgaatgtatttgggaatgtggagccctcttttgttatttcaaaattctaagttaattccatataatgttgctgttttgtgatcttttaagccataacatcattttgtacacaaaaatgtaaagataaacaagtattccttgttgaatttcttctcttttaaaaaaaattagagttgggttcttgctctgcagcccagactggagtgcagtggcgtgctcctagctcactgcagcctcaaactcatgggcacaagcaaatcccatctcagcctcccaagtagattaaattagtagggacaacaggccctgctaattttttatttttaattttttttttaagacacgatctcgctgtattgcccaaactggtctagaactactggccccatgttatcctactacctcagcctcttaagtagctaatttatttttataaccaaaaaaatcatgtcacttgagccctcttgtacttatacttagaaattactaaaatgttaattttttctttgaacatgaaaattaggtataagagtataaatatagataattatattttatgtcattgaagtttttttttggaatttggaaattggaaaattattttgaaacttcttaaacatattttatttatttatttaccttacaaatataaataagctctctgtccactgaggttgtatagagaaatagggttgtttttcattagggaaagtgagataagggaagtagatatctgtaagacattccagtgatcccatttagctttgttctgaggactagatttttattttatctgtgtctttgtgtttctcagtttttgtggcagaaaattaagatttaatatagacagtaagattttgaataaataatgcttggttgtatcaagtaaaagtttttttttaaatggaggtaaaaccataaatatcaatatatatttaataagtcgtatttattaataaccttaagaatataattctgttatcttacaggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacaggtaagcttttcacaagtatatttgtgtggaatgcaatatttttctaactttttaaagactttgatgtcttgagtagtctgtttacagtgagattttattttattaattatacataacttagtgattctctcttccttaagtatattttggcaaaatcaattatagtctttgcattttaaaaaacctagaaagtgtttgaaaatttctccttaggtaattaggaaaactataaaatttattatctgaggaagtatatttgtgcttttttgtggttcattataaattacatggctatggaaaaaatgaggaatttctaatgtaatatgtttattcactttgcaaatacattatcatcttatcttctctgtcggttgttgctgtggctctgatgctgtaatttaaacgaacatgcagtagcatacaaccttattcgttaacctgtattcgttaagcatagggttaggaattaggcggataaccaaatgttcaaatagttcgagagcttttatactgtgtcctctgtgtttctgtgctatttctaattgcccattctgaatttatgccctattttccaacttgaatccttctctatttatacttctcaactgccctcttccttctttctgtcatttttctttgatataattctcttgcttgtctcttcaccttatttttgtctcattttttacttaactaactcccattctctacttctctttagcttcctatgagtctgtctttccctcctgtgctttctttgatcaattgtatatttttaaagcagctttattgagacataattgacacagaataagttgcatatctttaatgttataccattttataagttttgatatgcatacatttctgacagtttatgtacagttgtattacttcttccttaagtattaggtagaatttaccagcgaagccatctcgtcttagagtttgcttgtgggagatttttaaatgatagttttcatttctttaataaatttggggctattcaagttattttttcttgagcgatcctccctaatttcttaaaagaatttatccatttcatctaagttgtaaaatttaatggcataaagattttcataatgctccttatttattaatatctgtaatgatgtgtcctccctcattcctgatatttataatttctgcctttgtactgatcaatctggttagcgatttatccgttttattgatcttaagcagtttttggttttatttttttttctttttttgttttctcattcattgatttctgattcaatatttattattctgcttactttaggttcaattttgctctttttataagtttttttaggtgatagctaagattattgatttgaaacatttcttcttttctaatatatgacgtgctataaattggagtactttataatattgtgctatgaattttaagttactctataagtctgtgtagctctcttctctctggtattttatcatataaactagctaccttggtttctcttggactctcagctcttatcttctctactctggggctttcctggccttcccctgggtcccccctccctgtaccatggcctgttaattatggtaaaacaatagtaaactgggacaatcgtagggctcacctcatttttttttccaactctttggaatcactatccatttttgatgtcttgtgtcttgaaaactatttttaagtcaattttgtctgtcttttttttgggggggcagggttgtttcaagcaggagtgttaaaccattcatgttactccatcctagatggaaggagaaatttctgtcacttgagcatttattaagcaccaaatctatcccaggcattgtgctaagaataagaaatataatagtgagcaatctttataagggattaataagtaatccctacctcattgggttgttgtggtaggtactgtttaataaatatagtgggctggtgcataaaatgggatcacattttgaaaaggttctagaaattaggtcaaaaggagacaaaactagaggttggaaggataatttggtaactattgcagtaattcacataagaattataggtgacttagtctaaggtaagggagtgaagtagtggagagctaaccagaatttatagtaactgatggttgaatgggtgtgggagttaaaggagaagagaaattaaaattcactttaggttacaggcttggaaatcagcgtttgatgatgatacacttcactgagataagacagaacaatgcagaaaaacccagtagaatagagatagtaattatttctctaatgggcaaagtagcctgaaagtggttgcatgacttctacatggagagatcttgaaagaaatccagaaggcagtggaatatatgtgcctaggtgatgcacataggtgatgttgtttagacttctaggtttaggagttcttagtaataatttgtgctagtcactgaagcctttggaatgagcacagtcacaaagaaagcttgtagagtgggacatatgaagaagaatgctgaggaataccagtgtttaaataattgacagaaagaggaaccctcaaaagagacgaagtaggagcagacagagagatgagaagccaggaaaatgtatttgaggcagcagtgagggtcctgctgatattgttaaccatgaattaatagtgtatcatttttttttcatgcagtacttggtattttgtatttggaatccaacagtcagttggattgagacaaaactgaattttttgccaagcaagtgtgaccgaaggtagtggaacaggattttaatgattgagaatcatgttgatggataatagagaggtgatatagtttggccatgtccccacccaaatctcatcttgaattgcagctcccataattcccacatgttgtgggagggacctggtgggagataattgaatcatgagggtggttcccccatactgttctcatgatagttaataagtctcacgaactctgatggttttaaaaggggaaacccctttgacttggctctcatcctctttttgcctgccgctgtgtaagatgtgccgctgtgtctcctttactttctgccatgcttgtgaggaaggggtccagtttcagttttctgcaaatggctagccagttttcccaacactatttattaaatagggaatcctttccccattgcttgttttttcaggtttgtcaaagatcagatggttgtagatgcgtggtgttatttctgaggcctctgttcttttccattggtctatatatccgttttggtaacagtactatgctgttttggttactgtagccttgtagtatagtttgaagtcaggtagtgtgatgcctccagctttgttctttttgcttaggattgtcttggctatacgggctcttttttggttccatatgaaatttgaagtagttttttctaattctgtgaagaaagtcagtggtagcttgatgtgaatagcattgaatctataaattactttgggcagtatggccatttaccacagtgagataccatctcacaccagttagaatggcaatcattaaaaagtcaggaaacaacagatgctggagaggatgtggagaaataggaacacttttacactgttggtgtgcgtgtaaattagtgcaaccattgtggaaaacagtgtggcgattcctcaaggatctagaaccagaaataccatttgacccagccatcccattattgggtatatacccaacggattatgaatcattctcctgtaaagacacatgcacacgtatgtttattgcaatactgttcacaatagcaaatgcttggaaccaacccaaatgctcatcaatgacagcatgaataaagaaaatgtggcacatatacaccatggaatgctatgcagccataaaaaagaatgagttcatgtcctttgttgggacatggatgaagctggaaaccatcattctcaacaaactaacacgggaacagaaaaccaaataccaccacatgttctcactcataagtgggagttgaacagtgagaacatatggacacaggagggggaacatcacacagcggggcctgttggggtgggaggcaaggggaaggatagcattaggacaaataattaatgtatgtggagcttaaaatctagatgacgggttgatgggtgcagcaaaccaccatgccacatgtgtaacaatgtaacaaacctgcacattctgcacatgtatcccagaactagtataaaaaaaattagaattatattgttttgtgctgtaaatagcttttttcttaataatatgctgtaagttttcatgtcattattttgagtgcataaatttttccaaatattcctgtttttagaaaatctaaatctgccttttgttagaaatttgattctaatatatatacagttttgctattataaataacactatattgatgattgatatctttattacatcagtacttttgtaattgtctactcatttctttgggataattcatttcctgaggatgagttcctagaaatagaattactcagttatagagtgtagccagtttttcctgaaataattttaaaataattgataattgaaaatgcagttgctgggcacgttggcttacgcctgtaaacccagcactttgggaggttgaggatggcagattgcttgagctcaggagtctgagaccagcctgggaaacacggtgaaaccccatctccacaaaaaatacaaaaattagctgtgtgtggtggcatatgcctgtcatcccagatacttatgggactgaggcaggagaatcacttgagcctggaagattgagactgcagtgacctgtgttaatgccactgcattccggcctggatgacaaaatgagactgtctcaaaaaaacaaaccaaaccccagaaaatgcagtttagttacaacttcttagaaagtgcataaagaaaaataggaattcatgtttgtgactaggttctttatacattaatccaacttgactgcaatttagcaaatatttattcattatatggcacatgccaatcatctaagtactgacaaaaagcaaagaataagatgaacatagttcctgccctcatgaagctttcattctaattaaaaatatagaggacataataaactattaaaatgcaatatattaaatgcagtgatggaaaaagtataaggtgcatgtgggagcacgtaggaaaggtgtattttatccatatattgggtagtactgataagaaaagtttttccagagaaagtaatcttttgacataacagttttctttctcatagtttgtccaaaggacagaaatttactcaaagatatatagatgaagatatagatatagatatataaaatacaagtatttattatggtgaagaattggaaaatatgaaattttaatcatagaaggttaattaaaatactagtatagccatttattctgatatggctattaaaattatatatgcatcctagcctaactgaaaaaaagaaaagaaaacctatgtgtgcagcattccctatggggcttttagattccttaacctattaccattaagcggagactgcaagcatgcaggcatatgtaagtttggtgtcactctatcattcattcattaaatggcttggtacaaggcattttgggagatccctgatgaactctcatatttctctcctattgattaaatgattgccaaaattctacagtcatggtgttatatcttagtttaaggatttgctgctaattaaaatataagtacattattgaggagtaacactttgagattgtcactttgaggtacaatgggaggcttctatggtcacattgttacttgaaggggttcaattgacctacatttttcttcattcctgagcatcagtcttacctttataagtgcttggaaaggcaaatatagttcaatttaaattgtatgtattcagctattttaactcatagaaataaaaattgcatatggtgctacttattttttataaagtaagggaatatgtgatattctgttacttacctaaatcagtgagttaaaatgtttttataatgatgtcttatataatgtttgtttacaaattacatagagatattttttttttttttcccgagacagtgttttactcttgttgcccaggctggagagcaatggcatgatcttggttcaatgcaacctccgcctcctgggttcaagtgattcttctgcctcagcctctcaagtagctgggattacaggtgcccaccaccacgcctggttactttttgtatttttagtagagatgggatttcaccatgttggccaggctgatctcgaactcctgacctcaggtgatccacccgctttggcctcccaaagtgctgggattacaagcatgagccaccactcctggcctacatagagataattcttattttaatggtttactatacaacttacaacttatatacttttgcactttttaccatattccaaaattgtatcgaaaaatacatatttttcccctttttttttttttttttttttggagacagagtcttgctctgttgaccaggctggagtgcagtggtgcgatctcggctcactgcaacctccacctcccaggttcaagcaattctcccacctcagcctcctaagaagctgggactacaggcgcatgccaccacggccagctaatttttgtatttttagtagagatggggtttcaccatgttggccaggctggtctcaaactcctaacctcaagtgatctgcccgcctcagcctctcaaaagtgctgggattacaggtgtaagctactgtgcgtagctctatttctgtataatatagaacactcagctcagtgtaagtcacccaggtttctagtgggatagaacatcactcaactcattttgacagataaaaaaaaagtctgatagatattttccctttatacccaacaaattattgatttctgctatttgcatataaaaggataaatttaagttaatctttttttaactacctgaatgtatatgaaacaatttaaaagaatgttatctctacttatagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggaggtaactttttttggatacttatcaatttttgttttgcttgttgaaaaatactgcttggggacataaggcatcatttgagtggaatttgtatatacataatcaccttggtcagaattgaaatagtgattatattaaactagaattcattttaaaatggtcttgatttattcttttaacaaatattactggagataaagtggcaaggaagcaatgacattgtctctgacttcatggaacttgccagtctaatgcaggggttggtggtgatggtgatctggaaggtatagtagtagttagatagtaaaaaagtaatcagacacataattaaaatagttataaattgtggtaaatttaatgaagtgaaggggtggcctgcacctccacacctgtgggtatttctagtcgggtgggatgagagactgagaaaagaaataagacacagagacaaagtatagagaaacaacagtggacccaggggaccagcactcagcacaccaaggacctgcactggcaccggcctctgagttccgtcagtttttattgattattattttcattatttcagcaaaaaggaatgtagtaggaaagcagggtggtaataaggagaaggtcagcaaaaaacgtgtgagcaaaagaatctatgtcataattaagttcaagggaaggtaccatgagtggacgtgcacgtaagccagatttatgtttctctccacccaaacatctcagtggagtaaagaataacaaagcagcattactgcaaacatgtctcgcctcccaccatagggcggtttttctcctatctcagaattgaacaaatgtacaattgggttttataccgagacattcagttaccaggggcaggcaggagacagtggccttcctctatctcaactgcaagaggctttcctcttttactaatccacctcagcacagaccctttacgagtgtcggactgggggacggtcaggtctttctcatcccacgaggccatatttcagactatcatatggggagaaaccttggacaatacccggctttcaagggcagaggtccctgcggctttccacagtgcattgtgccccaggtttattgagactagagaatggcaatgacttttaccaagtatactgcttgtaaacattttgttaacaaggcacgtcctgcacagccctagatcccttaaaccttgatttcatacaacacatgtttttgtgagctccaggttgggtcaaagtggctgggtcaaagtggctggggcaaagctacaaattaacaacatctctgcaaagtaattgtttaaagtacaggtctttttcaaaatggagtctcttatgtcttccctttctacataggcacagtaacagtctgatctctctttcttttccctacaatgaaggacacaaataataggcatggtgctgtagtcaattagatatattaatatagaatttattggaaagatctaggttagaaatactaattttggtgtcaccagcatatagatggcatttaaagccatggaaatatatgaaataatctatacaaaggaagagaaagtattagaagaattcataagttgaaaatgaaaatggcaaatgtgtcaccaccttagttttactttcttattggttgacattgcttcaaagatctctcatggaactgcccacaagttcatatttttttcccttgactggatgaaagtcaaaagtgtgtcataggctttgctgaagtgatagcaacatatgctctgggaggtttctttaagaaacctacttaacaaatccttctccccacctcacagtttccctttctatttctttctgtaaaaattttattgattatgagaaaaccatcattttagagatttcagactttttttcttttttttttttttgagatggagtctcgctctgttgcccaggctggagtgcagtggtgcaatctcagctcactgcaagctccgcctctggggttcacgccattctcctgcctcagcctcccgaatagctgggactacaggcatccgccaccgcgcccggctaattttttgtgtttgtagtagagacgggatttcaccgtgttagccaggatggtcttgatctcctgacctcgtgatccaccccccttggcctcccaaagtgctgggattacaggcgtgagccatcacgcctggccgagatttcagacttttaagtcaaacgtatattcagagcataaaacatgatggcattatgaaaatcttagtgtgtaagataataatggctgctttaacttacagggtaggagatggaagttatctttttaagataaatatttgaagtctatttatattggtaagataacagatagaaactcataaaacatatagaaacttataaaacataaatattatgttccacccaacatgctggggcagttgctatcccactgggcccagttattaggcatatttgtgtggggcagcaaagacactgctttctcatgctcttcccaggtagaatccatacagaatgtcctggtgatgctgccaacaatctgcaagtgcccagctgccttttgaggccaaccctctagggtaaagttggggcttcccttactctaattcacctgagtagttggttagctgctgttgcagctcaccccagagcccagatatttgttctctcctgggcctcatcttctgtgccagggagaggctagaattggttgtgaaatcatttagtctaatgcatccagaccaagtggagcagcttgtgatttctgacttgtcagattttcagtggttgcatacacagcctgtcctgacatgtagatactgcagatcagcagccccaggatccttacagttctttgaacttcctccactgagctcctggcaaaagtgaaggaagagtgccaattaataatcagtatttgaggtgcatgcgatagacagatactaactggaagacatggtttagaagttgtaatatttattttcatcttattatatgaactctttttgcagtgtctgctacatagttacaaactaagtgtcatgaataaagaatgaaggaatgaaagcttaaaaaaaaccccaaacattagtagtatgtataaggtacacatggacttaattttaaaacactaaattagtgtgtcatctttgaaatgcagtcaaagaaagcttggttacaagtaaaacttgttaaatattgtgggattcaaattatctccttggggtcataacagctaaaaattctttttgttgttttgacaaacttagaagtgagccaaactcaaagatcttttttacattatttctgttgtgttagggttctccagagagagagagagagagtgtgtgtgtgtttgtgtgtgtgtgtgtgtgtgtgtgtgtgtgtgtgtaaagagagggaaaagggagagacttattttaaggaattggtgtacatgattgcggatgccaccaagttcaaagtcagtctacagggtaggccagcaggaaggatatccagggaagaggtagtgttggagctcgagtctgaaggcagtctgctggcagaattcttgcttagaggaggtcagtctttttttattgaaggcctccaacttcaatacaaagcaattggatgaggtccacctacattatggagtgtaatctgatttacctagagtctagagatttaaatattaatttcatctaaaaaatattttcacggaaacattttatgtttgaccacatacctaggtactgtgactgagccaaagtgacatacaaaattaaccatcacagctattaaggcaggtcttatgctgttgatttgggactaaatttgtaacagctaggatttgaaattggctctttattttttttttttttttttgagacagagtctctgttgcccaggctggagggcagtggcgcgatctcggctcactgcactctctgcttcccaggttcaaacaattctcctgcttcagccacctgagtagctgggattacaggtgtgcactatgcctggctaatttttgtattttcggtagagtcggggtttcaccgtgttggctgggctgttctcttaactcctggcctcaagtgatctgcctgcctcagcctcccagagtgctgggcttacaggcgtgacccatcacacctggcctgaaattattagctctttgagttagttcctagtttatgtgtggacctaagcatattaaccatttagcttcagtgtcttataaatataaatatcaggattgcattagctgggcatgttggtacatgattgtaatcccagtttcttgggaggctgaggtcagaggttgagcccaggagtttgaggctgcagtgagctaggattgcaccactgcatgccagcctgggtgacagaatgagacccattcactaactacctaactaaataaatacatttcaggatcatattccatagacctaggactttttcgaggttcaaataaaatagttcatgtaaaacacattgtgaactctaaaatttttggtaaaccaaatgtatcattttttattctacatttgtaaaatgaggtgcttactaaccaaaaaaatccaaagtagacagataactactgaaagttcattttaaaggtttaaaattactatattatttggtacattaataacaaatagttctttattcataacttcattggtattaacacctaatttagttctatatttcacaagctactaaagagcacatggtcatttagaaaactgaatattcagtttgtaaaaatgtttaattggtgtggtagaggattgaaacagtctttcatttttctcctctgagaattttaactgcagttaaattctgcaatgaagtagcagtgctaaaaagaacaaatcttttttttttaacagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggtatgtttttaacttcaaatttctttctgctttcctctttctctcttttttcttctatcttcttccctccccttccttctgtcttttccctccttcctcccctctttctccctcctttccttctttctttccttctttttgtttagtttgggcaaaataagatttgtaaatctgtttctaatcagctaattccattcagacatctctaaattgtctatgttattagtcgttgtgttgattttttttctttgaatgaaagttcctagttctgttgtaacaaaattcctcagtatatattcatgttttcctgacttccctgtagctcctcattttccatttttctccctttcccccatcttctccctatccctagtgtggcatatatcccaaatgaatcttttatattgatattaggaatatcaaagtattagaggtgcaaagagaggatgatcattagtagatggtggagtttaacaaatatttgggagatggatggaacagagtagaaggaagcagaacttagaaagagccttcatctaatgttggatccagtgtgctctgtggaatgtggctggtttctgagctcagcaccagcgcatacagagggtcagttagtgctgggatgacattgctgcataagcataaagttctcattctggcattataggggatcctcagacctacctacctcaaaatgaaacctactagttcacaagactcacctttgcaaagccctgaggtgttacacagcatttttactcagggagaatcctaacagaaaaccagctttacatttacagcattgtaggaaaccccacccttactagctggaataatcaaactagtcctttattgttaaatatgaatggtcagatatgaagaaaattgtaaaaaccccaagcatgaatgaaattaagataaatagaatcatgttttctgaaggaaacagacaattgaggtgacagaaaaggaagtagacaaacaaaaaagaagctctgacattctaagaggattttgagaagataatataagaaatggatcccaccaccaccagctcacccaaggataggagagttgctggaaatccaaatattattgctgaaaatttgaaacaaaaacactgaacatgtaattagaagtattgagttggaatatttggttgaggcaatctcccaggacggagaataaaaaagcacagggatggaaaatgtgataaaacttaagagtgatgttttagttcagaaggtccaattccagaatgagtgttacagaagaaataattgaggaaatggaaggcaattctttaaagaagtatagtactctccttttatctgcagggaatatgttccaagacccgtcgatgcctgaaactttgggtattaccaaacctatgtttggatagtacccaaactatattttttcctatacatacatatgtatcataaagatgaatttataaattaggcacagtaagagttgaacaactaataaaatagaacaattataacaatatactgtcataaaagttacgtgaatgtggtctgtctctccaagtatcttaatattttcagacaccagttgacctgaccacaggtaattgaaagtgcaggtaagggtgagctgctgtaaactgtccagacctaagtaaatattgaaggaagctcttagctataatgaatctactgagtttccagcagattgggtaaactaagattccacatacaaacacattttcatgagatgtcagaatggtaaagctaagattttctgaagtttcagaaaaaaaaaaggctgcctgtcagggacttagaaaaaaaatgattgcatgattgatttttgttgttttttatttatcatcaataaaacatgatgaaatagaatccctggatggtagaagacaatggaggaatctattcagaattctaaggaaagtggtttttgaagctcagattctatacacagccaagccatcacccaaaatgtgaaaagaaaataattctcagatttcctgtgactcagttttcttagacttcttcatacccattcgtaaaagaaattagtttgaaagtgtatttcagaaagtcaggaaatctaggaaacagaaaaatatggggttaaaaaaacctaggcctactcaggagtgcactgaaaaggaatctccaaattatctatgtgaataggctagaaattaactggctttcattaaaaagtaaatgagaatgctttaaggaaagaaaaaaaaagccatatggaagaatgtcttatagaagaaaaatagcatgaattccacatagtatgtaggatacagagttagctatattatataactgatacagacaggaaagtgttttctgcgcttaagaaagaaatttctataccatggtgcagaagtgaagtggactaaattttgcataattttgagccattgttagaatgtgagaagagaacctcttatttttcagagatgcactcatcgtgacagtgtagcagcagaggcagtattactgtaaatctcattgaaaaatactacatggtcatagttaaacaacacatggaatacttcttatgtaaataaaaaagtaaatgttatgaactatgataacttagaagtaaagacattactaaccaaagctgtaaagaggaagatggatcaggggaaacaaatagtaaagccttaaagagtgagagaaaatgtctgcaattgatgtaacaagaaatagatgtttgaatatgtcattttaatcgttttcttctggaaatttttacacatataccaaagtagaaggaataaggtaatgaacccacatgtactcatcacccactttcactaattttttttttttttgagacagagtctcgctatgtcacccaggctggagtgtagtggtgcaatctcggctactgcaagctctgcctcccgggttcacgccattctcctgcctcagcctcctgagtagctgggactacaggtgcccaccaccacacccagctacttttttgtatttttagtagagatggggtttcactgtgttacccaggatggtctcgatctcctgacctcgtgatccccctgcctcggtctcccaaagtgctgggattacaggcgtgagccaccatgcctggcccactttcactaattaatatcatatggctactttgttactgcccacactctgctcttcccccttcttcctccagcccataagattattttaaagcaaatcccagatactataccattaattgctatttttccataagcaataaggacattactttttaaatatagtaacatcatcaccctaaatattagcagtgcttccttaagaccatgaaaatatccagttagggttcatctttctcctaaatgtctcattacaaggcctggttttttttaaataatgataaaagtgtcaattcacaaagaagatgcaacaatcctaaatgtgtgtatacctaataacagaactttaaaatatatgcagcaaaattgacagaactaaagaagaaaatacacatatacagaatcatagttggggatttgaacacaccactcttggtaaatgataagatatgaacaaaaaaatcggaaagaatatagaagatttgaacacagtcaacaaaattgacataattaatgtaatacaatgttacactcagttgcagaatacctttttgtttttaaacacttcctggaatgtttacaaagatgcaccattttgtggaccattaaattttctgaccacattggattaaattagaaggtagtaacaataggatgtgaaaaagcttgaacaatttctaaataacccatagatcaaaaagaaatgacaagggaaattaagaagttgtttgaactgaatgatcatgaaaataaaatatatcagaatttgtggaatgcaactaaaacagtggtgaaagaaatttgtaactgtagagtaagatattagaaatgaataagttttaaaatcaaagattaaatcttctaccaccagaaactagaaaaagaataggaaattaaacccaaagtaaatgaaaagaagacagtaataaaaataatagaatccaacaaaagaaaaacagagaaaatgtttaaatgtatattttttcaaaattttagatttctgttcattaaagatacagtaacaagataggagaaacccaagcctcagacttgatgtatgtatcttttatccagagtacattagcacttttataaattaatagcaactttttaaaagcaaaataatgaccaaaagatttggatacttgagagaggatgctatgtaaatgggcagtgaacacatgaaaacttgttcatataattttttttttttttcttttttgagatggagtctcgctttgtcacccaggctggagtgcagtggtgtggtctcagctcactgcaagctccgcctcccgggttcacaccattctcctgcctcagcctcccaagtagctgggattacaggtgcccgccaccatgcctggctaattttttgtacttttagtagagacgggttagccaggatggtctcgatcgcctgacctcgtgatccgcctgccttggcctcccaaagtgctgggattacaggtgtgagccaccatgcccagccgttcatataattatttatcaggaaaacttcacagttcaccagatgagataagttgtagaagactgacaacatcaaaggttgacaagaatgtggaacagctgcaattctcacatacgactgataggaatgtgaaatagtattaccactttggcaaagaatttgaaagttaatatgtacctacctttaacagagcaattccagacctaggtatctactcccaccccaccccaaaataagtgcatatatacacaaaatgactcatttaggaatacgtatagcagacttatttatagtagcccaaatctggaaacaactcaaatgttcatcaataggaggataaactatttcattccatagagtgcatgactagctataagagtgaactacttgtacatgcagcaacatggttgaatctcagaaacattattttgactgaaagaagccacacacaaaatagtacaatctgtattactccatttatatggaatttaaaaaatatacaaaattcgtctatgatgattgaaattagaatggtagagaggttgggaattggctagcaagtgttaagagggaactttctggagggatataagtgttcagtatcttaattgaagtagtgactatgtggaaatatacacttatcaaatttcatcaaatagttcatataagatacatgtatttcattgtatgtaaatttttatcacaattgaaaatacattacctggcataatggtacttttctctgaagttagatataatgagaattagaaagtgctgcgttttcattttaagctcatttaatatgtgcatataatgccttgattcaaaattcaaatgtagaaaacaaattttgaattcttctgattagtagaaaaattttaaaaatgtctcttggttttagttttttaaagtaaaatttgaatactgaattatgtgccagttactgtaatatgcattttacatgtgctattttacttaatctccaaacatactcagtgattagttctatttttccttggaacagaacagaagtaggaacagaagcatcaagaggaaatagaaacaccaagtgttcaattaatattcccaaattattatggaaagagtcctaagccagaagttactgagttttacatctgaattttctaatattttattttcttgaatgtcattttactatacctgtttaataattctattaaatctatttcaagggtattttaatgagctacttttcatgatattttcttttattaaataactttaattttttcaaggagcaactgtggtgacagctgctgtggtagaagtacattcacgtgccttactagttaagacaacactaaacataagcttcaaaactgatgatctcaccatggtgctgtatagtccaggtcctaaacaggtaagtccaggaagaaaagaaaatgtattttcacatgtgaaatttgcataggttgatgtttttaaagtaacaaatgttaatatttaacatttattttgtagtatctgtccctctgagaaaaatgatctttttactttaataataattataactatttcccttttaaatgagttatctatcatatagctaatgtgaaaaataaattgtaaaattaaagtgatatgtatatatttttagcctttcattagagcccttcggagacagaattttgatgtttgttataagcagaggcaataatttgtagtagttcatatcatgaaatacactttagacttgtgtttctttgtaattttgtgttggtttctcctttcataggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcggtatgtattgtaatgatgttctaaggttttacttgagaaatcgttgatatattttacagaattcatctccagaattgcacgttcattttctgagtgcatcctaggttctttaaagcttcaattcagtcagctcgtagtactcggttaacatttaaaatgtcctggttctgttatgtactattcttactggataattgatagattggttgagtaactagaaataatcagtgcaattaaattggtttttacattctttaaattacattctctaatataaatctaatataagttattgttaatccatgctaattgcaatgggaagtacataaaaaattgaaaagaaaaaatatcctgagattcaaactcttataatttattgaacatacacttcctcatttatgatacatttgtgttccagaagtttgtaagtttgttatttggaacactttatggatcttcccaagagacatgacttcagaatgcttttttttgtcagtaaaagagataagaggtctttgagttttactcatatgtttgattacttctaagttactcatacataggaattgttgttattgtgttttccagaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaaggttagttattggctaaaatatttaatatttgttttattgaagtgctacaacaggacttaaccttgattagccttttagatcatcaaagtaaatgctttaagaaattaaaattttatttttcagagtagaaggaaaaccttaatgtgttttcttggaggatgtatagtttgcattttttaaaggtgtcagtatatattgcatttaaaaattatgaaacctatgttagaataagtaattgtacttctcttcaggcagtaatttgaaggaatttgtctagtggaaaaaaacaagcagagcaaataatgaaccaaccataccttttcacaattaagataatatttcaatttaaagcactcatttatttttgttgtatttattcctagcttttaacgtacggtttctctattatctttttataatatgtgatttactgtggtatagtagaaagagtatcaagttgagagttagaaactagattagtttctaggctttccaattaaatagtggagatttcccctcatttaaaaatgttcttatgcctatagcttcttcaagtctttactaagggttgtagttgattcctttgggatctaagattcttttgttttactttttactattatttcattttaatattttcttataaataataaattattcataatatatagcaaatattttaatctatttttatttgttttagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgtgagttaactatttgatcatctgcttaattgtaactattttggatgtagtgtataccattttaggaaacaaaaactacctacatgctttccaaccttgctctgtaaaatgtctttctctctgcttagagagcttaatttagaatattatttaccagctttgaaactctttcattcttccagatgctgctcattattgttagtatttgtgggaatattgtcactaagaagttgggttcatcttgacagttttcagttaagatctactttgactttctaaccatgtcaattccaaattgctctttggacttttaagactttctgccagttgtttgctgtgttgtttcaattttattgtttcaacttttttctcccgtttggatgtttttgctcaaataatgagtttttccttgtctccatgtaacttcatttgaaccttcagccatttgctttgacatacttcacattgatattttactctctagtaacctcttggccttcctcctcttcataactctacttaaaattcattcctttacagacatcttttcaagttaactggctgacttccagcgaatacttacaaaaatatttgagcttctgaaggagtaatagaagcataagtttttgtttgtttctttgtatttttttcctgatgcttggtatgcatctatagaagcataaatgttctaaacattgtcaccatagaaatataagatgtaattttgatacaatgaatacatatatattaggatataagataaactgttgcccaaatttgcaagacagttggccctccactaagcaaagagagagaatagaaaatggagggtataccaattctctcttagtttttgacttagaagttttaaatatatatttcttctattcacatcttttttggcttgaatatagctgtatgaccacactttacttcagtaaaggttggagactgtggtatttttttctgagctaccttgtgctcagataaaacttctattactgtggaagaatagaacagatattaggttctagatgtcctttatatgggataattaaggagtgtattattaagtcactttttaaatagttgtttttattaacttgtttatttgacatacctattactaggaaagtctttaaatagaaatatttttatatttaaacattaatttagtggtattgatttttctctcataggttttgcagccctgtgacttgttttatcaaactactcagaaaggtacagatccacaagtgatcgatatgtcagtaaaatccctgacactaaaggtaaattaaaatataatcatttgaatatttagtgcacttaaaaaaagtagtaaagcctagaaagttattatagcaagtcttttaattgttatgcaaacaaaataggtgtgtttttgaaaatacgtttttatgagatatttacaaagtaatattatttaatacacattttatgaatgttattctatattttattatttacatttgtgtggttaacatctaatatccctaataaatattattgaaattactttatacttcatcagtttaataatatctgcaattcatgtatattaataatatcatgtaattcatggaataatatctgcaagattcatgtaaatatctgcaagattcatgtaaacacataacaagaattatggtaatttaaaaaattttataaacaataaattgtatcttctattttgtggtagtaatgttaattcagtatttaatttctcataatatatatttaatatttcttgacgtagtatgtttgaaagtgttttgtatagacttattaatttttttccatttaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtaagcatatttttccagttttataacagataatgatacgtatggaatattatgacagataatgatacatatggaatattatggaatcttgtgtagctatttaagcttattgtaaatatgatattgggtcaaaaacttttagaaaaaagttttcaaattttgcccttgaataattgcttttatgtatacattccttttacttttaaagtacatgtccacattaagtttatatttcaactgattttatcaacttaaagataatatattattcgacagttgttgattagattcagaatattttttttaaagagttaaattgaggccaggcccagtggctcacctgtaatcccagcacgttgggaggccaaagcagaaggatcgcttgagcccaggagttcaagatcagcctgggcaacatggtgaaaccttgtctctactaaaaatacaaaaaattagccagtggtggtggctcacacctgtagtcttagttattcgagagactgaggtggacgatcacttgagaatacctgggaagtcgaggctgtggtgagctgagatcttaccactgcactccagcctggggttcaaagtgagacccagactcaaaaaaaaaaaaaagaaaagaaaagagttaaagttgaatacccttttttttttaaggatatagacagaatttctgaatatgtggataataatctcttctaatagaaatatgaagaattagaaatatatgccttatacttttatgtaatgtagaatcaaggaaagatgcttaaaaaggggttttatctggactaaattgtgaagagcgaatatgtactatgaagttagccaggtgaggaaaatgctgagggagtgcttataggaagctactgaatggcatgtagactggtttttatatagaagaaataacagggctaaaaaacatggtgggaaacaggatggaagatcatttttaatttaaaaaattctctctgtaggtgcattattataatgaaatgtttggtgtatgggagcctttgcttgaacccttagaaattgatcagactgaggattttagaccatggaatcttggtatcaaggtatatctatatatgtctatgtgtgtatatatatatatatgtattttaaaagactttatttttttaagaacagatttaggttcacagcaaaattgagaagaaggaacagagatttcccgtataccacctacttctgcacatgtatagcctccccctttattaacattccctcatcaacgtatatttgaagactgaaaaaattttccaaaattgagaatgtttataccacactcgacactttattttaatcacaacaaggttcaggttgtctcatcatgagccttgcccacatgcttccttgtttgccctctgaatataattttcaaatctaaggccaatgttgcctatgcttctaatacaattatgtaacaagtattatgttacttgttacataatttagaacaatttagaacataatttagaacacagtttagacattgttctaaatattttaatccttacaacaactcttggaggtagatacagtttttatttaacatgtgaagggactgagaccagggaggttaagagacttcttgaagtaataatagctacaaagtggaaaagatgggatgcaaatccagctgcagaggcgttaaatccactctaaaccactatgctataatgcctgtgtcatcatcttgtaggttgttgtctatcctgagtttccttcatcctttggatgtttgcatgtgtgcaggaatgtatattatttgtttgaaatatattgtggatttatataatcatgagaatcggggcctttaggtggatgaaattttgcttctgaagcaagagactgcagaattactcacgtgtttcctacctaataatgacttggtcaacctgcagacagattttcagtggcttaaagccagttaaagtaacaacagaggtgactagcttagcatgttgagctcttttcatattagatcacttaattttattttccagatattttagatgaaggatatgaaaaggaattccttggtggtttttaggttagaatacacatggtcagcagatctgtgactcctaaaaaatggtaaagggtattgattcttatgagctctaggtttataacactgttctgctactattgtctgcctttgtaagtctctaggtttctgttctttattattagcatgaccaatacattaagttacttttttctgtctgagtttttatgttgctttgaagtatgtgcttttatattcagatcccgggtacacatagtaattttaggtttttatttttccttctaaattgtgtctgccattttactatcactgatgatgacatgatttattttctctaatacttctgtcctttatgaccttagttggctgatgtccaagtaatttcaataaggcaatagaacttactgaaattagaaaagataaaatgtactgacctttctaatgttggtattgggatttgtctagttatgttgtgttcttagaatttttccttatatttctatgatttatcattttagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggtaagaaaagaaatttgaaactttaaatattgagatacttgtctgattgatctgtctgttgaataagaagtttaataacttagttgtcatttgtcctttactgttctccttgtcatttaattttacacatttcattttatttagcataactctttcttattaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttagtaagtagttgaaaaattaccttcctggggctattttgttttaaattacaatttacatgttattttactcttttgtagaatcttagcaaggttttttttgtttttgtttttgtttttttaaaatatcctttctaataggtcaagaactgttttttgtctttgcagtgtcttggttactattgttactaaaactttgtattccaaactctttctttatcctctgcattatttagagcatggcaatttactgctttgttgttgggaggaaaaatattagatctcgccctcattctgcttttatagaccgtggatgtttagatgtttgtgggggttcttttattcacatttggtatccgttgatagtattccaccagttttgcaactgaaagaattctaagtgtgaattcatgcagatggcaatttttaatggctttaggatttataaatggtttttttttttttatgttctgcctgttgagatgaaggttttttcctttgtcttttctgcttcccaaaagtttttcatttttattggaggtgaaatatatacattcttaaagtatcataatatgtagtcattgtgaagttaaatagtcccagagcctcacctacaccactttttgatactctggcatttaagtaattattgaggagggcatcatttaaaagattaattagacataggggggtaggctactaaaatagcttgtgtttctagttagaaaataacatgtaacaggtgtttcaggtgttgtcatagcgttgtaattaatgttcttataaattttacgtctttttttttaacatttttatggatgggatggtaaatgaaatttatgcaagtaagtaattttatccccaatacaacatgtgttttaggtaaatatatataaaattttatttaatcaagtccaagatataaaggaaaagtgacacaagttgttggaaaaattaaaaacaaaaattgtagtcaccttgatatttaccaatgtctaccaaaaggtattatgctctggttattctgacagcaaaccagagatcagtattcttgtattttatagtacttgctctcattactcatttttgaaacgtttgctattgttgtcttgggttaaactcctgaatgggagttttttaattaatgctgtggaaatatatgctggcttcttaaaatatcccttttatggactatatccaaagactctagtgactattatttataagtttaagaatcatctgaaatttctaatatgtaacatatgtaaaattaatatgtaatgaattataataaaaacttttaaacatacttacttaatttagcacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcaggtatgaaatgatcaattttgggggatgtcctgttatgcatatctgtgtgctaataaaattaaaaacaacaacaacaaattattactgaaagaatataaaccgtaacagtaatacagctgatatcaaaaagaagactcactaccaccagttgcgctacttggttatgacgggtggtaggaatttgttcaatatacttcttataattttttaataggaatattttgtaaaatcttcttacggtattttttataaatagtcatcagtgttttgctttaggtctttgtaatgtatttatatcctttctatttgattagataatttttagagaaataaaaaaattttacagctttattgaggtatgtacaataaactgcatatatttaaagttgatgacttttgacacaaaaatgcacctttgaaactgtcatcacagtcacggtaatgaacatatttatttcttagaaaaattttctgtttccccactttcccattcccaggcatccactgatctgtcctcattgtacattagttatatggcctaggattttacataagtggaatacagtacagatggagtttgactttcattcagaaaaattttgtatgtatgtgtcaacttatgtgtatccatgttattacatgcagttacttgttgttgctcagtagtaatctattatatgtatatgccgcatagccattttgagtgaacctttgtatacagtgtgaagttaagaattgaggttttgctttttttttcaccatatggattttttttccagaggattttaggtccttctcatttttatataaatttgagaatcagattatcaattttataaaaaatctggataaaattggcttgtcctttaatttttaaattctgattactcattgatagtatttagaaatacaggttatattaacctctacttgcagatttaactagacttacatattctagtagatttgtgtagatttagatagttatgatagctgcaaatgaagacatttttactttttctttttcaatctggatgtgttttattttatcttgtttatattgcctatcacactggctagaatacaattcgagtagaagtggtgagagcatgtttttgccttgtccattctttcacctttaaacatgatttgtgttgttttgtagatgccttttcttaggttgtaaacgttcccttctattcctagtgtgctgagagtttttatcagagttgattttggattttgtcagatgctttttctgtacaagaggaggatatattttttaatttgttagtatgatgaattacattcactgattctttttaaatattagatcaaccttgcattcctaggattaatctcacataatcatgacgtcttactaaccttttagtatattgttggattttgcatttatattcatgagggatattggtctagagtttcaatgtctgtctttctgtctttcttttcttgaatcttgctctgtgtccaggctggagggcagtggtgccatcatggctcactggagccgcatctcctgggtttaagcaatcctcctatctcaacctcccgagcagcaaggactgtaggtgcacaccaccacacctattctcccatcttgctccgcctctcattgtttaactttttaactcattaaagcagcagtacccaacctttttgacaccagggacctgtttcatggaagacaatttttccacgggtggggggctggggcatatagtctcaggattcctttcttaggaatagaaagctccacccatgtgtgttcccatcccctgcagggacaccaagttaacaactatctacacagaaaaaacaccttcataagaaccaaaaatcaggcaagtactcacagtacctggatttaaccacagatcatcaggcattagttaaattctcataaggagcatgcaacctagatcccttgcatgcgcagttcacgctcctatgagaatctaatgctctggctgatctgacaggaggcagagctcaggtggtaatgctctcaagcctgctgcttgcttcctgccgtgcagcccacttcttaacaggccacagaccggtacagcccatggctcaagggctggggacccatgcattaaagtatatttaacgtggggtttctgtagccaccatgtagttagaccttgttttttttttttttttttaacataatctgaaaatctgtgccttttaacagggataattaaaccacttatatttaaagttgttgttgatatggttgggcttaaacttgctattttttttttctatttgtctcatttgttctttgcttccatcttccctttgttttctctttttttttattaattgagcatttttgttatggattcattttatttccttgttggcttattggctgtatctctttatacttccttgtctttttgttgttgttgttgatactttagggctttattacatacatattgtattagtctaccttcaagtagtattttgccccttcacatacagaatcaaaactttagaccagtatacttccacttctcatctcccacattcgtataattatgttcatacatttttgtgtctatgtatgctagccaccccataatacaagttactatttttcttaaatgaattatttatgttttaaataggtttaaaatacaaactgtatttgatatttattatcactttttcttctttcagtaatctcacagtgtggatctgctggtgatgaattctttcagttttttcacatatatgtattacagatattttcactgggcatagaaatctagattggcagggtttttccccccatactttaaaaatgttgttctgctgtctgctgtattgcattgtttctgatcagaagtctgctttttttcctatatttgcttttctacaaaatgtgtcaatcttttcttcagcagcttttgagattttttttctttatcattggttttgagcaatttggttatgatgaatcttactgtagttttttttatgttccttgtatttggggtttactgaccttaaaaatgtggatttatagttttgatcaactttagaaaactttttgccattgtttctaaaattttttctgtctttgccctctcttctctcctttaggtaccagttagatatacgttagggtgtttgaacttgccccacagctcagtaatgctctgttcatttttacttttagctttttcctcgtttcttttttcatagtttctcttgctgtgtcttcaatttcccttctctttttcagtggccaatctgctattgaccccatctgatatatttttctcaatagtagtctggatttttttgtttttttattttccattgtctctttttaacatccttagtcttctaactttttagtgatattggatataattttaataaatgttttaatgtccttgtctaccaattctattacatgtcatttctggtttgttttattgatgtttcttttcattatggtaattttttcattcctttaatgtacctgataattttttattggttacctaaaactactgtatatatcagaaccagacttcattcttcctgtttcttttagacggatctttactgagccttagataatctacacatgtcctgatcattactcagctgaagttttgacagggaggggacactcagttttccagaattctgtccgtacagctcttgcctctccatgcaggtctctcccctcaagtacaacatgctgtgaatttcagtcacgttggcttccccagattttcagatcttgtctcttcaacttggctgcctgctcctcacacagcagactagaaactcactctccagacagcaagctgggtagtcatagggcttatgtagtttttttgtttttgtttttcccttgtgccgcctcttgccccgtatcggaaactgtggtttgatgtttgttgtttttcttcctgctttttagttgattagggtgggaagctatatctggtccccgttattctagcatggctgaaaacagatatcccttctctttcactttttatttagttaactattttaaaaggtgactaacagctgcactcattactgctgattattttgccatttaaatagttgaacatgaattttgaatttcttacaggtactatgtgtagaaatatttctgttgcttcaaatgtatagagcaaatagtttttctagaattaaaaatatagtacagttaagattattcatttatgaaattcttagttctcatgttttatatgctgctatgaagtttttaaagtagattttggtaagatatagaaagattataagataattgttttactaaacaacttgttattatctattccaaagataaatatgagtatttggaggttttctgatattattattattattattatatattaatcagaataatacatttttgcctgaccattatttgctacttactggatgagataatcttcatacttttctctctaaagaaaattgcaacaattcagtcacctcttcaggctccaattctaattctagttctcttgctatatccaccatatctgcagtgacttgctccattgaagtcctgaattcctcaaagtcgtccatgagggttggaaccagctgttaattttgatattttgacctgttctcatgtatcacaaatgttattaatggcgtctagatgatgaatcctttccagaaggttttcaatttactttgcccagatccatcagaggaatcactatctatgggagctgttgccttaaaaaatgtatttcttaaataatgagactaatattatttaagtcaaatatacaatgttacatataatattaagaagttgaaattactccttgatcaatttgctacagaatagatgttgtgttagcaggcatgaaagcaacattaagctcctgtacatctccatcagaactccagtgacaatgtgcatggccaatgagcagtagcattttgaaaggattttttttccctgagaataggtctcagtagtgggctttaaaaattcagtgaaccatgctgtaaacagatgtgctttcaaagtcagtctttgtttttccatttatagagcacagagtagagttagcatattcttaaaggccctgggattttcataatggtaaaagaacattggctaacttcaggtcactagcttcattatccctttaagaagagattcagactgtccttcgaagctttgaagctaagcattgacttcccttctctagctatgagagtcctaaatgtcatcttcttgcaacagaaggctgttttgtctagtttggaaatctgttgtttagtgtagccatcttcatcaatgatcttagctagaccttctggataacttgctgcagccacttgccacttcatcttgcacttgtgtgttatgcaggtggtttcttcccttaaacctcgtgaacaaacgtctgcttccaactttttttctgcaacttgctcatgtctctcagccttcatacaattgaagagagttagggcctatcttaggagaatgttatagctggtttgatcttctatcctgtattaggccgttttcatactgctgtaaagaactgcccaggacttagtaatttataaaggaaagaggtttaattaactcatagtgcagcatggctggagagacctcaggaaacttacaatcatggcagaaggcaaatgggaagcaaggcactttcttcacaaggcagcaggaaggagaagtgaatgcaggaagaactaccacacacttacaagaccatcagatctcgtgagaactcattcaccatcacgagaacagcatgcaggaaactgtccccatgatccagttacctccacctggtttctcccttgacacatggggattgtggggattacaattcaagatgagatttgggtgggggacctagccaaactgtatcatatccagaccactagagtattcttcctgtcagcaataaggctgtttcactttcttatcatttgtgtgttcactgggttaggacttttaattttattcaaaaacttttcctttgcattcacaacttggctgtttgatgcaagaggcctaccttttagcctatctctggttttgacatgcacttcttaacattaatcatttctagcttttgcttttgatttaaaagtgacagacatgtgcctcttctttttatttgaaagaggccattggagggttattaattgtcctaatttcagtattgttgtgtttcagagaatagggaggtccgaagaagagggagaaagtggggagaatgtccaatttgtggagcagtgagaacacacacatttattgattataacacatatagttaaaatgaaaagattgaaatattgtgagagttaccaaaatatgacagtgaggcacttagtgagcacatgctgttagaaaaatggcaccaatagacttgcttgatgcagggttgccacaaacctttaatttgtaaaaaatgaaatatctgcaattcacaataaagcaaaacattataaaacaaggtatgtgtatatatgaatttactacttttgatagtcaggagaaatggtattattcaaaataaaatttgcccacagttacacagctagtaatcagcactgccagtatttatctcaggtttttttcagtttaacatctatgttcatcctgctatcatattgctgttgtgtagtcataaactttaggaattgttccagcaggatagcttaccagcttacctgcaacacgcttctgtttctttcttacctttgtagtttttgagacacagggtcttgctctatcgcccaggagtgcagtggcatgatcagtgctcactgcaaccttgacctcccaggctcaataatcctctcacctcagcctctgcagtagctcggactacatgtctgcaccaccatacctggctaatcttttaatattttgtagagacagggtctcactatattgcctaggctgctcttgaactcctgaggtcaagtgatcctcctgcatcagcctcccaaagtgctggaattataataggtgtgagccactgcgcccacccacttttatacagacggatgcttccttttcctctgctcccttagacttttcaagcttatgctcattccgttttccagacttttgatctttccttgaaatttcaactactagttattctcagcttccaaccaactttttccgcactaaatttgaaagggaaaacaaaggaagcaatatcagactttggtaactaacttcacattccaaacaggcaccatttagaagcatgtgtttcttaataggctccatttacatcagtgataagttgaatgtgaagtttatttggaattatatttataatcagaaaatatgttggaaaacttgcagttaatgtctgttgtggaatgctctggatgttggttattggtttgatagtggactttgaagtttattgtaatacagatgtctccatccacaccatggaatttaaaaaatatagacatttaaaaatgtttccctcaaattaaaaaaaaaaatacatgaagttgaagtcagctgttttgtttccctcttagtccacattccctccttccttcttccttgaggtaatatcaatttggtgatacgttgtgtatatttccagtaccatattttaaaaactattattcctgtccagaaaatatatacttgtgtttttagtgtcttacagaaatgttacactgttcaccttgttttgctatgttctgttttcattcagatattcgaagtgtaaccatatactgatatataggtcattattttaatgatgttacatgattatatggatttgaagaaaattttcttatttttctattattgagattgttttcattttcatttttttttataatgaaagtggtgtggtgaacatcagtgtcttgaatgaatgtagtgaacctgaatgaatacacatgtgtaaacatttctctaggtatggaactaggagcagaattcctaagaagaaagtacattttcatttttactaagtttttgctgaattattcttcaaagttattttatcaatttacattctaccagtagtgtatgtgagttcctgttcacatcattttcaactgttgatatcaccatacttctgattttttttgcagtttgttggtattaaaagatactccatgaatataatttgtattttcttgattactaggaatgtcaagtatcttttcatctgtttattggtcagtttttccattctgtgaatcatgtttacattctgttcctgttttcctcttgattgcaacttttttaatgatttttaggctttttgagtgtggtggttataaaccctttgtcaagtatattacagatatttcccagcctgtagattgtcacttttatcatataaatatttaaaattttgatttttttctgtgaatttttttctactatttttatctaaacaaaaacttatctttaaacaaattagtccctatcctaaaatcaaaaagatattatcttattcccctgtaggatgcttaaagtctgtttttgagattcctattatataaaactatagagatttttcttgtatgttttaggataaataatatgtttgtttcttttctaatttatataagcaagatgaatattgcctgatagttcctttgttaagatagttacatggacatattttttttacacatctttagattcttagattaatgatactaaatattatttgtttttctttcccagataagaaatcatttttcagtcccactgtctgtttacgaaggggataccttattgggaactgcctcacctgaaaatgaattcaacataccattaggatcttaccggtattttgtctttatcattttatttactctaaaatctcttgtagaatttttagtttctgatttcacatggataactttgatcaaatccatcctgctaatagcttatctaacgtatttaggtttcagtgcacttagatcttaaaaaagaagtattatttaatttattgtaataacttataccaagcacactatatatgcttttctcttaaatataattatattttgattgcaatataaccgtcataagcatagtcatatgattatgagttttaaaaatgtctaatagatcatgcctggtggtttctgaatttatatatactattatgaagtaatttgtacttctcaaaggttttataatacaatttttttgaaattcctttagtaaacaatattttatccttttcttttcatatttgttcattgttcagggttggagttgtaatataaatagaagtatatactatattaattttaaatttttaaagtaattaaatttgatacaatatgttttaagaaaatattaaaattataacaaaatatgagctagtcttatagattttatatcataacaagtaagtattagtcaagatatgtaatctggaattgaaaataatctcttatgtggaaattgaaccttattggagaataaaactgttctcagaattaagcattgtagtttgtttaaataccattttagaatacacactagaaataggtacttacctcaatgctacagaaggacagaggcaaaactgcaaacagtgcttacctgttctcttgtccagaagttcagaatgggatcctcaatgctccgaagacaatctagcagttttaggcacctattttcacatagatcgacctgctaaacctaaagagtgttttattgcttagttcagacttgctgagggaaagaattgtattgttgagagaacaacaaaatagtcatttacagtatctgaccttgctctagagaggatttggggtgggttacaagactagattaaatatggcatgtaagatatatttaaaaatttctgtgaagaactttcattttcttcttggataataaaagttaatgatattctactttttaatacatttctgctatatattttgtatctctgtccatagtagagaaaacagtacctttatactttttccaaggctgaatattaatttgttacatgatagttaatccatcttaatgagaattagtagtgattaattcatcttaatgagaattgttactgactaagtacttcatcttaagtagaattattagtgactaaccagcttggatttctcattaggcattttttttttttttttttttttgagatggagtttcgctcttgttgcccaggctggagtgcaatggcgggatctcagctcccaggttcaagcgagtctcctgcctcagcctcctaagtagctgggattacaggcatgtgccaccatgcgcagctaattttgtatttttagcagagacagggtttgtccattttggtcaggctggtctcgaactcataatctaggtattcttttaatctagtacttcagtataggtgcacttatatttaagatgtgaggttttaaattaacaaatggctatctttctctattctatttctattcttagattaatgatacagataaatatagatgcagataaacacaggaaaacaatttatattttattaaaatatttaagtagaatttaaatatactgattcttttattcatttaacaaatatttatcaaggttttctgtgggtgagacactcaataccaagatgaattgcatgtggctattgccatcaaaagatggatatattacataaatgtataaagtaggaaacagtgggttatagagagttatagaaagtgttagagttgccaaaaactgtggaaaacataaaagggattaatgactgactcctgggcaagatacatgaagtacggtaacatctgtaatatagtaatatggagattagaaggaaaaggctatctaagaggaaggcatgcatgaacaaagataaggaagcatgaaagcatagtgttaaaaggaatagttgggaatttgttggaatgtagagtgcatgttggaagataaaatttgaaagataagttcacagttagatggttgctccctcattttcttgctccatttttataaattttatctccatctattagtttgatctgtttttttcttcttgtctcagataatttgatgttctgtttcaagaccattcacactaccatatcttctcatttaaaacctcctgtcattgattatctttctttcctgttttccttattcattccttgaactttcctttgacgttttatatttctcttactcagattttctcttcagaacaccctttttgggaaaattgtcacttggcaaataccttgcagtctgtctagaaagagccaaccactctgccctcagtctactctaaacatatgttttttggtacctatcacaatgcagtagttatcttttaacattttaacatttcccacctgattatgatcttactcatttgtttgttttcaattttgccttcttgttggtacataataggtccaataaatgttttgataaactggataagtgtattacgattagtttaatttggaaaaaattaaggttttgtctttaagtattagaagtaagagtggaaaatagaatgaaaattatagaaggaatgtagaagtagaataggctatatctgttaactgttttgacaaataatttatatgcttcagtcaggtaagaaggaagtctaattgtttcacagtccagggtgccagtagctggaagtcactgaaaaaggacatgcagaaaagtgggtagagtgggttcagtgttcagtctagcaaatttaaggtgccatcagaaattactacagaaatacatcatagatatttgacattttaggagtagagcttaggaaaataatcagggttgaagatagttttgaccattgttcatctataaaggacagtgttgtctcataactatagctaattagttttacaaatataaaaatatttatgaaatgtttattcttggctacagtgtgggttcaaaaattaagtataaaatattgctgaaatgtaaacaatgtaatattcaaatataaagattaaccatgtgacaaccaataattttgtcaccattttcttaaaactactcttctgcaatggcaaaaaaatccaaaattgacaaatgggatctaattaaactaaagagcttctgcacagcaaaagaaactatcatcagagggaacaggtaacctgcagaatggggagaaatttttgcagtctatccatctgacaaaggactaatatccagaatctacaaagaactgaaaaaaatttacaagaaaaaaacaacccatcaaaaagtaggtgaaggatatgaatagacacttctcaaaagaagacatttatgtggccaacaaatgtatgaaaaaaagctcatcattactggtcattagagaaatgcaaatcaaaacaacaacaagataccatctcacgccagttagaatggcaatcgttaaaaagtcaggacacaacagatgttggagaggatgtggagaaataggaatgcttttacacttttggtggtagtgtaaattagttcaagcattgtggaagacaatgtggtgattcctcaaggatctagaaccagaaataccatttgacccagcaatcccattactgggtatatacccaaagaactataataaatcattgtactataaagacagatacacacatatgtttattgcagcactgttcacaatagcaaagacttggaaccaacccaaatgcccatcaatgatagactggataaaggaaatgtggcacgtatacagcatgaaatactacgcagccatagaaaagaatgagttcatgtcctttgcagggacatgggtgaagctggaaaccattctcagcaaactagcacaggaacaaaaaaccaaacaccgcatgttctcactcataagtgggagttgaacaaggagaacacatggacacagggaggggaacatcactccctggggcctgttgtggggtgaggcgctaggggagggagagcattaggagaaatacctaatgtagatgatcgattgatggctgcagcaaaccactatggcatgtgtatacctctgtaacaaacctgcactttctgcatatgtatcccagaacctaaagtataattaaaacaaaaacactaaagcagaaaaaaaaataataaagtaaaatatcatactgatgtttaaaaaaaaacagcactgttccgcatctattgactacgttttaataacattaaatattgattgaaaactttcatttgattaatgttggaaagcttgcgattattttttcaatagtaattttttttagtttatgaattcagtcatggcatttatttccttttaggcccatgtatccagaaaagccaaattctttcagttatatatgcaagtcacagatgattctatgtggttttctttgcatatataactgatacgattcatgtatttttatatgaaaccatttataagtgtacttttaagatagtaagtttgtaagaaaaatattctcctcttaaaagtcaaacaacttgatgagcttccagaaagttaagatgatatctatttatctatcttttttttttttttttttttttgaggctctgtcgcccaggctggagtgcagtggcgcaatctcggctcactgtaagctctgcctcccgggttctctccattctcctgcctcagcctcctgagtagctgggactacaggcgcccatcaccatgcccggctaatttttttgtatttttagtagagacggggtttcaccgtcttagccaggatggtctcaatctcctgacctcgtgatacgcccgtctcggcctcccaaagtgctgggattacaggcatgagccaccgcgcctggccttatctatcttacttatatcgtaaaaagtatatgaaaatataaaaatgtactacaatattatgaaaggaggtaagtttgttattctaaagctgtaattatatagtttaatatgttttcctttaaaacattttaaactgtatcatttaatctcatgcagatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagaggtatcggcaaactgatttagtgccttcctgtttttgattttgtagtttcagttttttaagattaagatcaataaaaactattttaaagatctaataaaaattagaatactagtaaagaataggtaatgcagatattcttttgcaacaagtatgagaattattattgaaataacatttaagaactagacttcagtgacaaaaaagcatgctacattatgttgtattcttttagtgctgattttcttaaaagattgtatactttgtgaagttgctttttttctttcatactctgtgtggtttcttcctgttgttataggaatccatacatcttaagattttatgtaaatatttcatttgcagtgcttatcaaatggaagaaagtagttcttcattgtcatctattataggtttattttacttttagaattaccatttgctttttaaaaaaatttttttgagactaggtttctctctgttgctcagactggagtgcaatgatgcgatcatagctcactgtagtctcaaacttctaggctcaagtgatccttccacctcagccccccgagtagctgggactacaggtgcatgccatgcctggataatattttttaatttttaattttgtagggacagggactcactatggcttgtcttgaactcttgggctcaagtgatcctcccgcttcggcctcccaaagtgctggaattacaggcatgagccagtacacccagccgtttacacttttctgatacatgtctcttttggaggaaaaagttaacatatttatggttttaaatgtgtatttccatattgaataacaaattatcatagtggttaagaatttgtactttgctgtcaggtagatttgaaattgcatcctagctctgtcatttgctagctgtatgttcttaagcaggctttattgcttttctaaatcttttgctgtggtctgtaaaatgagaataataataaaatttgcttggttaagacatgggggaaatcaaattagattgtgtatgtaaaggatttggtacagtgcctcccagacacagggttgccatttatttatcactctagcactaccaccaccattgttattttgtggaatattatttaacttgtaaagaatcaagaactccttacttttgctttaattaatttaaaatcatgagatgaagagattcctatattataataataggaaaagaataggatagagatgctggaaaaactggtgagatattcagatgtactgtcaatttatatttctgttctcatagaacttttaattggatgctgttagtgatcacattctgtctgccagtttccaaagggtgtgatcagtttttagaaagacaattgagccatggtgtggggaagggactagaggggacaagagcggttaggggactcttaaactgagacgtcatatagtgacatgaactaagataatagaagggagggtcgagggaaatgagcagtttggagagatacatatgacgtaataatataaacagtgattggaaatgggtgatgagggattgtggaggtagtagggattacttattttggattaccatcagtttttgcccacattttacgttgttttgtagttttcaaaataaaaatcacgagtggttaagattgtctttttgtcgttgttttaccaattatagtgttttatgtttataatttccaggggagtttcccattatgttatttaatcttcacagtttgtcctttgaagtaagtcatttagaccattttacaaatacagtagctcaaatctcagattaaataccgtgtagaggtttacacagttgacaaagttagaacttgaatgtaagtcttctgacttgttctgataggtatttcaaaagcattttttgcagcatttggaatacataaatagaattttgaggcatattattctgcaacattttaaattttgttttgttttttttttttttattacagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggtatgcgatgtttattctgtttttcccttgtctttagctacttgtcactttttagtttttaaagttctgagtaataaatattatgaaacttggatagaaataacttgttaaatatttgaggccaaaaagattagaatttaatattataaaggtttagtgcattaacaatataatattttgtttatgctaaaaagtaatttatcagtttaagcaggaatttttaaaggtacctaaattgtgatgtatttggaatatttttttcctaggttcaacttatggtaactgatagtgagttgtccaatcagttttcaattgatactgttggtagtcatggagctgttaaatgtaaaggcctgaaaatggactatcaagtgagttcattctatgcttatcaagaaacttttattttaaatgtttctattaactacttaattaaattttataaagatgttatacataacagtttttgagctgttaatttttttttcttaggttggtgtcactatagacctgagcagttttaacattactagaattgtgacatttacccctttttatatgattaaaaacaaaagcaaataccatatatcagtggctgaagaaggaaatgataaatggctctctcttgatttggagcaggtgggtagatgaatttcaaaaatatacctctttggattctattttctccttgaagttagatacctaaagtcaccatgtaatgttttaactctccccttactccaattttgttttagtttcatgaatctttattgaatatttgtgccctgctctagatagatgggaaggttcaatttttaataattaggtaactaggaatgcccagcttgttaagggaggtagacgtttaacaattactaaccactttggttaaataaagcagccaaagactagataagatgtaaatgcaccaaagagaaggaaattacttattctctctaggaagctattaggaatgctttcagagagtagggtaagccagactcttcttcaagttatttgaggagagtagtaacttagaagtgaaattttgattttgtgccatcattaaatctttgaataagagttttctgaatgactgacagaggttgatggaatattttatttttgaagaacttttattctaaaagttaggattagagaagtttttgctgtttctattcattattcctttttgcatacaaaaccgtccttgttgggattattcttgaagtatattctttagaatttcttttagagctggttttgaaggtaaataccatcagtgtctctagaaaaatctctctggcgggagggacaatgatcgggatataaacccaggcgttccagggggcaacggcaaccccctttaggtcccctcccatttatgggagctctgttttcactgtattaaatcttgcaattgcaaaaaagaaaaaaaagaaagaaaaatctctctggctgccttcagtcttctctttgtctttgatgttctgcagtcacactgctatatgtctatatgtggtttactttttatttacccttcttgaggtgctttacccctagatctgtggattaatgtatttcatgctttctgtaaaatttgctactattgtttctttaaatattgcctctcctccattcttccgtttttttccatctaagccgttaaatcagacatgttggacattcatactctatcctccatgtctcttaatagctcttttatattttccaactctctttgcttcattctgagtaagttctacatggacatctttcctttttttttttttttttttttttttttttgcttttgctgtgtctgaactactatttaagtcttcaactgagtatttgaataattatagttcttattcccagaaatttcaccttttttcaagtatattcattctttcaacaaatattgtttattttttatgtgacttgcaatataatagttaaagccacagtagttaaagcccatctttatgtagtttacgttttagtgggtataaggggaaacattaataataccgtaatcaattagtatatagtatgtttcaaagtgacaagtctaatgtgggaaagtctgatgtaggataagggacattgagagttcaagagccaggggtggtctctaattttatgtaaggtagttaggatgggactcattggagtgacatttgaacagtgccttcgaggaaatgagaaagttagcaattgtcgagagctcagctgaggaggagagagctgagctgccaggtgtcggaatagctgattaacacaaaccacaatgaaagtaacagtcaaacctttaatcacttactgtgatagtacagattgagcatccttaatctgaaaatacgaaatcaaaaatgctccaaaattcgaaatattccaaaatccagaacttttcaagtgccaccatgatgccacaagtgaaaaattctacacctgacactttatgtttttcactttcttaactgtcatttttttttttttactgttaagtacttatgtgtgaataagtgtaagaaaatgattgtttattggtaacacaaattgagagtcagaaatgatggtgatgccacacaaccacagattgtcaacatgggtggttgagatagtgacacattctctttctgatggtccaatatgtacaagttttgtttcatgcacaaaattatttaaatattgtataaaattacttttgggctatgtgtataaggtgtatgtgaaacataaatgaattttatgtttagagttagataccatccccaagatatctcatcatatatatgcaaatattccaaaatccaaaagaagtccagaatgtgaaacacttctggtaccaagcatctcgaataggggatactcaacctgtgtaagcaggaggctaaatcagagaaagcacaattaccacctgtgctggaatggcactggacaagggttaggtggatcagcacaaacatggggattgtctcaccgtctaggaaaccttgaacaaagtgtccggcagttttatggacctgggggatggagtaggacaaagcggaggagctaggaatggaaatatgctgagcactgagagtagacaaaaagtgtcttcactttttgtgaagtgactatacccttgttttaaactgatcatctgtgttccagttctcagctcaggcgctccctttcccccgataaagaggtcctgcaggagctctcaaggaaggcctctgccaaaaagctctcataaagagcttccgaatgaagtgcctgggctaggaatgcagacatggataaaagctttgggacagggttgcttgaatccttaagactgcagtgccctggctgtgcgcaaagtcaggttatattcctaagcatgtctcatatctagttccattaattccattttatggttgaataaaactgtctttaacaagctaagacacttagctctaacaaccaggttctgctacattgtcctcaagtcatgtgatgatgatcaggtatcacacatgagcagtctcactgaaatatatgaagggatcagtctggtcagggcctaagatggagttgacttaatagcttacagacaaggctggttcttcattctttttcttttagctctgtttccagattcttttgtccagtcttctctgtagtaccttgactatctcctattcttttagtttggtttccagatcactcacgttgaagttatttcgtacaattctgagcttctttcctactctgaactttgaatactacttttacttttttacccttatttgacaaccagatgctagatttaatacttgttttgcgtactttgatttctgcctaatttccagataatgttcatacctgattttgatttttagtaactgaatgtacacttgttttaagcctgatcatctgtgtcccagttctcagctcaggtttcttgctgatttttcaacccttctctgtaagatcatgaccacattaaagtctcttttctcgccagcagttcacttaccatagctcttcaatttgctatccactgcttcttgaatgcatagtgctgacaagtgacaatccatcttcaagttgaaagtttacagctgtttaaacaacccaataactagagcagtgttaaaacaggtttttttatagtttaagtctattctgatgggaatattaagatgatttatatatttatggtgaaatctgtttatttttataaacatatataatgtatattttagtgtatccccttttggcctgagtatgcttctagtaaacttcttattcaagtcgaaaggagtgaagatcctcccaaaaggatatattttaacaagcaggaaaattgtattctattgcgtctagataacgaggtaagtttttttttcttttttgcatgtgtcattaggaaagctaaaatatactgactagtattgtatttattttttgtatcaaataattacttctgttgatttttcccctttccccaaaaacgaacaaacatttctttttgtagaaggaaacagagatctaagataatttaattgttaaataaaaagttagttggggccgggtgcggtggctcacgcctgtaacaccagcactttgggaggccgaggcaggcggatcaggaggtcaggagattgagaccatcctggctaacacggtgaaaccctgtctctactaaagaaatagaaaaaattagccgggcgtggtggcgggtgcctgtagtcccagctactcgggaggctgaggcaggagaatggtgtgaacccgggaggtggagcttgcagtgagccgagatcgcgccactgcactccagcctaggcgacagagcaagactccgtctcaagaaaaaaaaaaaaaagttagttggaatgcctggaatactagaatataccacatctggaatgtcacctatctgtaatacagtgattgagattatagatttccagaaatgcagtacaaaattctgaattgttttctcagtcatcccaaaaattaaattatcaagttatgaatagtctgttcttaaatgttattagttaatattcttgggaaaatgattacattaaaatgttttctttttctttcttctagcttggaggtattatagcagaagtgaatttggccgagcattctacagttattacatttttagattatcatgatggagcagctacattcctcttaataaatcacacaaagaatgaacttgttcaatacaatcaaaggtaagattatcacaaatacagtaactcttgatggtgtaagtctagatgatgaggcacagttttttttgataatttcttaagagtataaacactgataatagcattgtagctgtgtaaaacagtgttccattaaaaaatgtacttgaagcatgtaggggtaaaactgacttgatgtctacaatttattttgaaatgcttcaaagaaagaaaaatggaagagctgaagcaagtgtggcaaaagcttgttcattgttgactctgatgaggagtctgtcagagtttgttaggagtctctgaattttgtctatttttgaattttttcatgtgtttaatatagtgtaaatatgtaaaatttcagatttttttttcaaacagtaggtaccctcttgttgagctgtcttggggaaaggactgcttccttaaaggctataattgaatcttcatggtttaggactactcttcaacattattcattttatttgctgttatatcttcttagtgccactacaggttatgcaagtttctgatcctctacttagtagttccaggctgtcttgaatttattttgtttcctttctttctttcttttcacctgttacttttcaacaagcacatatttatcattgcacttccactttccttccactgctaactgtacaacttctaatcattgattaaaatcaaacagacattgagtagggaccacagggctggactagcaagtacctaaaactcgtttggggtagcattctctcatctatttaagatgttaagaaagagggatgcctgttttttttaattatccatattataaaaataataagttgtttctaaacatgtgtgcaagtgtctttttaatataatgacttctcttcctttgagaagatacccagtactgggattgctggatcaaatgatagttctgcttttagttctttaaggaatctccatactgtttttcatagtgtttgtactagtttacattcccaccagcagtgtgaaagtgttcccttttcaccacatccatgttaacatctatttttttttaatttaaattatgatcatttttgcaggagtaaggtggtatctcattgtggttttaatttgcatttccctcataattagtgatgctgagcttctttttatatgtttcttggccacttgtatatcttcttttgagaattgtctattcatgtccttagcccacttttgatgggattattgtgtttttgtttttgttttcttgctgatttgtttgagatccttacagattctggatattagtcctttgtcggatgcatagtttgcaaatattttctcccattctgtgcgttgtctctttactctgctgattattccttttgctgtgcagtagctttttagtttaattaggtcccatctatttttattttgttgcatttgcttttgggttcttggtcatgaactctttgccaaagccagtgtctagaagagtttttccagtattatcttctagaatttttatggtttcaggttctacatttaagtctttgatcgatcttgagttgatttttgtataaggtgagagatgagaatccaattttattcttctacatgtggcttgcccacgatcccagtaccatttgaataggagatagtcaaagtaccagaaagaagactggacaaaagaatctggaaacaaaagagctaaaagaacaagagtgaagaaccagccttgtctgtaaaccattaagtcaactctatcttaggccctggccagactggtctcttcacatctagtcccttcactagaataaggtgtcctttccctacttcatgtttttgtttgttttgttgaagataattggctgtaagtatttggctttatttctggtttctctattctgttccattggtctgcatgcctatttttataccagtaccatgctgttttggtgactataggcattgtagtatactttgaagtaggataacgtgatgcccccaggtttgttctttttgcttagtattgctttggctatgagggctccttttatggttccatataaatttcaggattttttttctagttctgtgaagaatgttgatggtatttttatgggaattgcattgaatctgtagattgcttatggcagtatggtcattttcataatattgaatctaccatccatgagcatgagatgtgtttccatttgtttgttaaatttaaacttttaaataaatattcccttcttatgtaatctcccctgccattatcctagttcagtaaccctccatttcttatctatttgagtagatttttatgcgttgttttgttttatttgagtagatttttcttttttgttttgttttgagacagtgtctcaatctgttgcccaggctggagtgcagtggtgcgatccaggctcactgcagcctccaccttccaggctcaagtgattctcatgcctcagccttccaagtagctgggtttacaggcatgtgccaccatgcctaactacatttgagtagattttttatctatctctatatatctagtcttatctttagtaaatctcccattttccactagaatgagttttctaaaataagaaatataatcatatctctctagtttaaagtttttctttttttacccatttctttaaaaatatacttctaggctgcctttctaaacatttatctttccgtggcctaaatcttaccctatacaaagtgaagtttttttttttcctgaatgctctgggtctttccatgtgtttttacctgaataggtgtttctttcagctagaaaaatgccattctgtaattattaaaaaatcaagaaacaacagatgatggcaaggctgtggagaaataggaacgcttttacactgttgctggaagtgttaattagttcaaccattgtggaagacagtgtggtgattcctcaaagacctagaacccaaaataccatttgacccagcagtccccttcctgggtatgtactcaaaggaatagaaatcattctcttataaagatagatgcacacacatgttcaccgcagcactattcacaatagcaaagacatggaatcaacccaaatgcccatcaacgatagactggatgaagaaaatgtggtacatatacaccatggatactatgcagccgtaaaaaggaacgagatcattcctttgcaaggacatggatggagctagaagctattatcctcagcaacaagaacagaaaaccaaacaccgcatgtccctgcttataagtgggagctgaacaatgagaacacatggacacagggaggggaacaacgcacactggggcctgttgggggcatggtggcagggagaacatcaggataaatagctaatgcatgtggggcttaatacttaggtgtaggttggtaggtgcagcaaaccaccatggaatacatttacctatgtaacaaatctgcacgttctgcacgtgtattctggaacttaaatttaggaaaaaaaaaaagaaaaatgccattctatgtgatcccttcccttgccaccttaatctatgtaccccagtttttgatagcacctttacatatgtagattgcagcattcgtcacattgtgttactttcttgtgagtttgagacatgtacacacagatagtgaatagtctgaggactatggttagtttcccttttcttggaattttcattgcctgtcccaggtagtccagtacgtttttgcataaggaatactctgcaatgaattaaacagattaaaatttgtatgaattaagagcatttttaaatatttttaaaccaaatttatttgataatcaacacatttacatttgattttttttttcatggaaaaatgaagagtatgattttgttttctcctccacatttccttctcttggcttttaaaaaaatatggatgttatttcctgcatataaaagtaatagttgttaaattactgttttaaaaaatactacagaaaaaatgtgaaagaggaccataatccctgtaatccaaatactgtcaacattttggttcattgcttttcctttcctttcctccctcctttgttctctccctccctccctttcttccttccttatgtatctctcacatttgacagctattgtgagcatatcaatttgcttcaaagcacaatttttttttctttctaacttttattataggttcaggggttacatgtgcaggtttgttacatgggtaaattgcatgtcacggggttttggtatacagattgtttcattacccaggtaataagcatgatacccaataggtagtttttcgattctcaccctccttttactctccacccccaaataggttcccgatgtcagttgttccttctttgtgtccctgcaaagcatgatttttactgaatgcgtgatattctatcatttagatgctctacaattaaataaatacttaattgttcagaatttttatttcaacttttataattttagaatcagtttatcttctttttttgttgttgtttatttgttttttgagatggaattttgttgttttgcccaggctggagtgcagaggcgcgatctcagctcactgaaacctctgcctcccaggttcaagcgattctactgcctcagcctcctgaatagctgggattacaggtgcgcgccactatgcccggctaattttcatatttatagtagagacagggtttcaccatgttggccaggctggtctcaaactgctgacctcaggtgatccacctgcctcgacctccgaaagtgctgggattacaggcatgaaccaccgcgcccagcccagtttatcttctaataacgatcctcaacccatttgtaatcattgtaataactagtttataattccttaccatatttttttgtagtatattgtcttctaatgattttttggaaaatacatattctgtttcggttatggataattccttttttgttattgaaggtttcgatacatttaaaatcaattttaagattgaaacagtatctgctagcttacccataaaaaattgtaatgcttttttaccttttcttcaacctctttccaaattcttactttcttgtgaatataatttggtatgttttcaaacagattaatataaaatggttagcttttcaaaatatgtattatttcattcaaggcccttttggtatttgcattgattttaatgttttaacaaaaaaatgactttcttaaactggtttaattgttcactacaggttcctcaatatttctatatcctagttgttaaaatgttgttctgagttcatctctagcttggttggaaaaagtctgagttatttttttagtaaagatttgtggatagtgttatgctattgcttgttcgaaatgtcttattcttacaaatttatgacaatttgacataaaattttaagtgataacgtttttctcaaaattgtataggtattgtgccattgttttttgatattaaacatcattgaactgtgagagtaacatttttattttcttgcgagtgactatgattttcctagatatgtgttagggttttttcccccctattttcttacaaagatatgtctagaatgatactgttttcatttatgtctgatacccagtgaagtcttttaaatctgcagagttaattccttcttctactcagaagagctatattttattacttgtttggtttataacttttgtaatgtttttttctttctgagcatctttttgtgagtcaactgaatttcttagatgtgtatttcatgttttgtgattttaaagaataatttagttactttgtttttgctctagtaagaccaatacttaggaaagagttaccaattaaattatcttagaattggtataaatagggtaaaatagttggaataattttccataattaatttgtattaaaaaattgacaaaacagttttaaagacttgaagacctttatttcctaagtagaacatgtattttctaagtgggaaaataatgagaaatattcattagtgaacccttttttaattgtataaggtaagaatttcagccttgttttaatcagaacgatcacagatctcagtgaactaagaattaatgaagtattattttagtttttttttaatctcttcgtgtacttgcatttaatttaacgcgtatttttgctactgtgtcagttctctcagtgaaatagaagattccctccctcctggtaaagccgtgttttatacatgggctgatccggtgggctctagaaggctgaagtggagatgtagaaaaagccatggtgaagtaacacagaaggatgtaagtattgggttattatggtgttcccagcagccttttttaaaaaaggtatttgggccgggtgcggtggctcacgcctgtaatcccagcacttttgggaggctgaggtgggccatgagttggagatcagcctggccaataaggtgaaaccctgtctctcctaaaaatacaaaattcactttgggaggccaaggcaggcggatcaccaggtcaggagtttgtgaccagcctggccaatatggtgaaactccgtctctactaaaaatacaaaaattagcctcgcatggtggcgggtgcctgtagtcctagctactaaggaggctgaggcagaagaatcgcttgaacccgggaggcagcgattgcagtgagccaagatcacgccactgcactccagcctggcgacagagcaagactccgtctcaaaaaaaacaaacaaaaaacaacagtatttgattttcagccttcctagttttaaggactttttgtggccacacttctgaaaaactgccaaacgtcttcaaaatagtattcaagtatttacttaaccaaaaatgtttaaaaccaaaagtagtcttattttgtttacatcatttgcttctactgtgttataaagaataaagttgtgtttagagaagtgctttcagcattcacctgaaaaacaaatatgttctctgcattgacaatcatactaggtagatttagcttctgtaaggaacatttaaggatccactgagtgaactaaaacaaacttatttctgagtggcaagctatgatgataaagttatgcacatatattttctggtaacattttaaatactttcagaaaatttttaaaagtttttaatccttcaagattcatcttaatttgactcctgatgtttttttttcttaccactggtgattttttcttcctgcttatcagtaggtggtattttctcattgtctttcagtgctgctgttgaggagtctgctgtgggtattgtttacattgtatttaagaggattgcctataagtggcctttcagttttaaaaattcattactattagatttattcaggaaaaaaaattgtactttgatataaaaagtcttattcatttgatctgttgattagtactttgcatatttatatcatagtgatagtttgaagcttataaagataaatcagacattcactgtaaaatattagaaagacttcagtgaaataagttagtcttcttgattctcaatgtggttttagtgatatacatatatatacttagaaagtattacaagtaaggtaagtatccccagataattattttatggtaacaactcacagtttttaatttctgtatattgcaacgtgaaggtatactatatagtaaaattttctgaaaatcagaatattaactagaaattaatggctgaatattaattatgagaatttgctatgtttatcttgtcattgaccctcaaaaccctgatatcagcacatttatgtgagattcctgcagaaatagcctcatgatgaatatacatgctttgtagaacatacaattgagatacaagatattttttatcctgtttgattcagctatgaaaggaaatgtgaatttcaaactgaaacaacttttaatacatatcacattgctgtagtcttagaataaagcagaaaaaaatactttgtgttacagattagcctacgtgggaaggttcaattttattaaaatgtttaaattaaaaaagtaaacaattggcctgtctttatgagtaataattttataacagataacatcaaatgatttcaataatgtaaatttgcaagtattctacaaatattaattcatttagttgccactaaccccatgaagtaggtgccattaatagtctcattttataaatgtgaaatctaaatttcatgttctttgggaccaaattctaattttttggtttttttttttttttggtggttttattctaggatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaaggttagatgcattaaattttggatacatttaaatgatcagtttctaattgttaagaaattgttattgtaaaatctcaaatgatttagtttcagttttgtgctttgactattcattgatactgtggtagtgctagttttaaatgtgcttgagggaattttttgccttttgaaataaagatatggcagaaatcaaatttataaactccttattatgttaatccttccacttatctaaaaagttatatttattcaacttgccaaaagtatgttttgcatatcatacaaaatgcttagttcattttccattaccatctagcacagttcagggtacatatgctgtagctgttggaggattaacatagacaatcactttctaatttgaccttggcactttaagatctaataagatctaataaggtgatcactgtatttatcatttctcgtataagacatcaccattaaatcttttatctctcccttatgtccttattattcctattcataaacagttgttttaatttacatatattagtgcttaatgtgagaatatttcttctgtataaccaggataatgtaattttaatccttttcttgaattaaattcttgaatatatataaaggtatatgatacagatgtaaatttagttttctatgtacattaatctatacgtgtccctgacctcttattgaattgaatcaatgccattttaaaaggaatattaaaatctatattcttaagaatttttattctcaaaaaatgtttttactatttaaatagatcaaatacaccatagatttttaagacctttagacctattatatgttatcttctaagctaagtgatgttaatgcaaagatgaataatacatggtctctacctttctgtttcttaaatgaatataagttctataaggaataaacaaatagaatgctttaataaaattaaacaacttaaatatttaagtaacatatgaaagtaacatatgaaagtgagaaagcagagttagcagagcaagaaattgcagtggcgcactctatatcctagataactattttatacttgtctccccttaaacccccattgtgtcagcttactaccttgcattccacttcactgaaaaaattgaacccatcaaaagcaaacttccagagacccatctcaccccccaatatcacagcttgctatctaccagcgtttgcatactacttgctgtactgacatactctcaacagtttacagtagatatatgtgctcctgtttaaacagatttttctctacttttgcactgtacttcatttcctcttacctacttgaggacattgttccagcagtcctcttcttcatctctcctaagtcaacagcttttgggtctctactgaattgtttcagtgttacttctctcaacataaaaaattctcttgagcctactttccttgctacctgttgctcatttctttctttgcatttataaccaaacacctcaaatgtactgtctgtttcaaaggaacttaacatatcctgtgttctccaactatttttcatccattttctctttaaccactccaaacagggttttgctttcaacacaccatgaaactggttttgtcagcattaccagtgacctccataatgccatatccagtgtagaattatcggtctttacttaataacatttaacacagatccctccttgatgtagtttctttcacgtgacttccagaatacctcaccatcttggtttttcttcctatccagtctcattcattggttccttgtcttctctcaactgcttacattggctaaatgccttgaggctcttagacctggtccttttctcttgtggatttcagttttatgatttcaaatactgcccagaatttctctcttaggtatgtcttctgtcacacctgtcatctgaccttaagacttcatatatccaactgtgcatgcaaaatctctattcagatatctaagagacttcttaaacttcatatgtgtacactaaaccttttatttcctccttctaccaaaactccagctttccaatcagagttaataaaaaatagctccttctagttatgcagcccaaaaatattgaaattgtcttcgattcctctctttatcttacaccccagacctaattcatcaagaagatctgtgctggttctaccttcaaagtgcacatagatctgaccacttttctagtatctcactgttaatagcctcatcagggccatcaccatttttcaactggcttactgtagtacactaacaagttttcctgcttctaatcttgactccactcttttttctttccatccacttcaacacagagtgtattcttaacgaaatgtaagtcagattatgttgttagttgtcttataaccgatcagtggtatctcatctcactcagaataaaactcagagtctacagtggtctacaatgctttacattatttggccccccactataagtcttactttattttctattcctaatgtgttcctgacatgccagcctccttgctcttcttcatatactgcaagtgtgcctcctgctttagctggcctctctacctgaaatgttttcctcctcttgtctgctggataattctctcagctcatttaaggttgccaaaatctcactttctcaatgaatcccccattgaccactctaatattgaagaccccaccactttacatattgcagttctccggatcccccttgccttgtctacattttcttctttcaaaagcattttcacctcctacatattaaattttactaatttattttgtttactatttattttcactcccccactaaaatgaagctccagaatgacagagatgttcactgataacggctgtaacacctagaatagtgcctcagtagtagcttaataggtagtagttgaatgaattcatgtttttaaatttgtaatatgctcacttgtaattgaggctgttctgaaattttagtgaaggtattgtaattcatgtaataaaccagttaaaataaatgttaataacttagtattaaatactatgatttttgctttcttaaataagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggtaatatttttaagtactgatgtgaagttttaattttttgcctgtcgtagtttggtgaatcactagtgaaatttaaggaaagtttggcttccttataaaacaaaataatcctgtcatacataccttgtataaaatgttttaaagaggtgtttatctatattaagaaatcaggctgggcgcagtggttcacacctgtaatcccagcactttgggaggctgaggcaggcggattacttgaggtcaggagttcgagaccagcctggccaacatggcaaaccctgtctctgctaaaaatacaaaaattagccaggcatggtggcaggcgcctgtaatccccgctattcaggaggctgaggcatgagaatgccttgaacccaggaggtggaggttgcagtgaaccaagatggccccactgcgctccagcctggctgacagcaagactctgtctcaaaaaaaaaaaaaaaaaaaaaaaaaagaaaagaaaactttcttttaagatactagatgctaatgatctgttctttgggttagcaggaaacttaaaaatgttttattttttcactgtactttctttaaatattttatttttcctttattcatttttattgtggtaaattttagtacatttatgtaaaaagtaatgcagtgaagctttgtaagaattatatgaatatgtgaattttatggacatgggatattaagatctaaatctaaactaatacaaatatgtagcttactgttttaaaaagtttttggcattaatttctaattctagtcatttatagataaattaattttttcatttggggggacatatttttcaggttcgcctaacccctactggtcataacatgaaaattctgcagccgcatgtaatagctctacgaagaaattatcttccagcattaaaagtggaatataacacatctgcacatcaatcatcatttagaattcagatttacagaatacaggtaagtctttctgaaaatataggcaaaattgtattctaaaggaatgcaataagaaaccagatctattcccatggtctgctttatctagtattcagtttcaatgttgtgctagcctttttttttttttttttttttgagacagagtctccctctgtcgcccaggctagagtgcagtggcggaatctcagctcactgcaaaccctgcctcccaggttcaagcgattctgctgcctcagcctcctgagtagctgggattacaggtgcccaccaccatggccacctaatttttgtatttttagtagagacggggtttcaccatgtgggccaggctggtctcaaactcctgaccccagatgatccacccgcctcggcctcccaaagtgctgggattacaggcgtgagccaccgtgcttggtcaccgctagactttttgattctttttgttcctcaaatcctgttattctggtcaggttgtataattgacatattaatatactgatgtgtttttattttcttagatccaaaatcagatacatggtgctgtatttccctttgtgttttatcctgttaaacctccaaagtcggtcaccatggattcaggtttgtttttatttttagatttccataaaagcagttgtattagctatttgatttactttactataaaaatatgaagtgaaaccattcttgggtttaatttttataggataattggaaaattaaactgcttgaaaaaggaccagcaagtactatacacaactaactttgataagattttgagtgaatcttgaagaaaagattgattagaaacatatattgaaatttttagaaatactaatttaaaaagcagataatctgtaaacctgcgatttaaaaacctttaaagcctttgaatgaacaataaggaagttcaaatctagagtgttttctaacagcagaaactgtcctatgttctccaaataagaataacggacaagtcctttctacccttttctttccctttgcctttcttgtttcctgcatatccctcttccccctactttctcttccctcctcactaccctacttaactttcttctccccttgctttcccacctccaccccacaccacttcttctaaactatcctggggggagtactctttataactcgctcagaagctttttggccagtataatgcgtaagcccttccacctagaggtctggagcaagtccccagaatctgttttcacaaagtttccctgatgattctaatgcatacttctaaactgctaattgtagaattagttatcttcagagtaactatagatagttttaaaaacaatgctagagtctgaaattaagattgtagtagattttgccaatatcagtaattttaactgatatttattatttagtaaatgatttaattttccattgtggtgtatattggaagaaaatgcctagcttttgcttaaagcatcatgggagtaattatatttataacctttacagcaccaaagccctttacagatgtcagtattgtcatgagatctgcaggacattcccagatatcacgtattaagtaagtgtcttaatacatttcttgtatatttatttaatgtttgatttaaatatatgaattgtttgtactctttaaatgttggacaagtcaaagatttaagcataaaatattaattataaacgtcaaataaaaaaatataatgttgtggctcacgcctgtaatgccagcactttgggagacctagacaggctgatcacttgaggtcgggagttcgagaccaacctggccaacacggtgaaaccccaactctactaaaaatacaaaaattagccaggcgtggtggcacgtgcccagagtcccaactactcaggaggctgaggcacgagaatcgcttgaacccaggaggcagagcttgcagttagctgagatcacaccactgcactccagcctgggtgacagagcaagactgtctcaaaaaaaaaaaaaaaaaggcggctctggatgaaatacatctaggtatttataatcattgtttctggattttggatattttattattctcttgtacttgtatttgttttttgtttggggttgtctataatcatatattgttttgaaaaaggaaaacaataatattttcgtcttcactcactacccattccaagaaacagaagatggactgaaacatctatgtaataatctcctgtctaatttcccttaccttgtcaccaagataacctatctttatttccttgctgtttaaaatatagttttattgttcatgtgtacctaaacattatgccttttagttttaatttttttctaatttttagaaaattgtttcaggccggaaatagatgttgggacttgcttttgttcattcaacatttttattaaaatttattcattttgttgtatgtagccatagtttattcattatcactaatatataatattctgttttatgactctgtatgacagtttacttatctggttcctctttatggccattttcatattttgactttgttgctgttattaacagtgttccatgattttttaaaatttagtcaactaaatagtcctaagtttcaaagttctaatattgatctcatacttttttctcatctaatttttgtaatacagttgttaattgatgatttttaaaaaatgttttctactttgtaatacaggtatttcaaagtattgattcaagaaatggatctcaggttagatcttgggtttatctatgctttaacagaccttatgacagaagctgaggtgactgaaaatacagaggtaagacttaaaataataacatttgatggaaaggattagggaaaagatattattataaatttttaaaggtattaaaatgactttgttgcattttaaaaatacaattaaataaattttattactctcttgtggtacatacctttttagaaatcttattttctgatgatagaaaattagcaaacaggaggaaaggcttggggtgaatagcagggagaaaaggataatttgtcatgttcacatcacttttttcctcttttattttcctggattactttggctttgctttcactttaataatttagaaatttagggtatgtccaggatatttaatgggagaaaggataggaaaattaaaaggtggtatcatctgggtgactggaagaccataaaatcatagttataaagtgggtcagatatagtctgtttttcacttgccctcatagattcatggatggagaaagagcaaattagtaacagtctattgaggtatagatcacataccatacatttcacccatttaaaagatagggttcaatgacttttaatgtattcacaaagttgtacaatcatcatcactctctaattccggaacattttcatcatccccaaaaggaactgcctgtgcagccactgatacactttgtgtctttaggtttgcctattctgaatatttcatacaaatagaatcatacactgtgtagtcttttgtgaagggcttctttgacttagaataatgctttcaaggtgcatctatgttgtagcatgtatcagtacttcattcctttttatggttaagtgatattccattatatggatgggccacattttgtttatccatatatctgttaatggacgtttgggttgtttacacattttggcttttatggataatgtaatgaatactggtgtacaagtttttattggacaaaaactttattaaaagtcttaaactatttaaacttaatcaccatgtgattaagcaattccaatcctaggtatatagccaaaagaaataaaattttattagaagtggaattgctcaatcacatagtaaccttatatttaatcatttgggactgttaggcagttgtgcaaagtgcctccaccattttacattcttaccagagcatatgagggctctgatttttccatattatccccaacacttgttactatctgtctttgattctagcaatcataatgggtgaatgtgaaatagtttgtcattgtggttttgacatgtaattacctgatgactaatgatgttgagcatctttgatatgttgattatcctttaatatgttaagtagttaatttgcatatcttatgtgaagaaatgtccattcagatcctttgcttattatttaatgagttatttgtcttttttcttataaaagttatttgcatattctcgatacaggtctcttatcagatacataattttcaaatattttctctcattctgtgtgttgctttttcactttcttgatgttgtctattgaaaatcaaaagttaaagttaatgaagttcaaattattttttattttgttgctcatgcttttggtgtcatttctaagaatccttagccaaatccaaggtcatgaatatcttacgttttacgaattttaaagatctagctcttatgattaggtctttgatcaatttttagttcatttttgtatatgatgtataaggatccaaattattctttggcatgttgctatccagttgtcctattaccatttctttaaaagactatttgttctttgaatggtcttgacaccctagttgaaaatcagttaacaacacacatgtgattttattccgtcgatctgtgcatctgcccttgtgcattgcacactgtcttagttattgttttgtattaagttttgaaattgggacatatgtatcttcctactttgtccttctttttcaagatgggtttggctgttctgagtcctttgaaatttcatatgaattttagaatcaacttgtcaggttcttcaaagaagtcagctggacatctgatagagactgcattgaatctgtaaatcaatttgggaagtattgccatcctaacagtattaggtctttcagtccttgcacatgacatgtttatccatttatgtagatttttaattttttttaacaatgttttgttgtttttcagagtgtaagttttacacatttttcattaaatttattcctatgtattatattcttcttatagtattatgaataaaattgattttttaattccatttttggattgttcattgctactgtataaaaatgcagttgatttttttatactgatcttgtattttgcacccctactgaattgttagctctatttgttgttccgtatattcttttgggatttctatacataagatcgtgtcatctgagaggagaggtagttttacttcattctttctgatctgaatgcctttgtttcttcttcttccctagttgttgtgtctagaaattggtgacacattaaacagaagtgccaagagcagacattcttcttttgcctctgatcttggagggtaaattttcagtctttgagtatgatattgaccctgggtttttcctagacatcctttttcaggttgaggaagttcttttcttagttggttgagtgtttttaatcatgattatatattttgtcattctttttctgcatctatggaaatgattgtacactttttgggttttgttctactgatatgttttattacattaatttttttttttttatttttttttttttttgagacctaggctcgctctgtctcccaggctggagtgcaatgctgcaaaagcaatctcagctcactacaacctccgcctcgtgggtttgtgcaattctcgtttttcagcctccctcccgagtagctgggattacaggcgtgtgccaaaatgcccagctaatttttgtaattttagtagagacagggtttcaccatgtttctgtgtttttttgttctgacctcaggaaaactcctatttgtcactttctctgattttctcctgcaaactattaggtctacaggttagccagtatcttctgtaaatcaatgactttccttttagttgtctttcaccacatctgctgtttctgagagcccttaggctcgaactgcactatatgttataagtgaaattagttcctttgggaagagattaatagttacctgttttaaaacctactttccccatcagcaaaaatccctaaaccaggcctctgaagctggcggtgggaacagttgtgacacccttctatttgagtaacaccccagtttaggagctgagcactatgtgtggtggggtaagaggggcagtggcctgagatgatctcagcttgcctttgctggcatggaaccaccacattacaggcctgggcaagagtgatcagaactctagtattctcagtggtactgtacccaaggcagagcttttttaccctgcacagaggctggacagagaaaggaagccctgccaagtacggtggctcacgcctgtaatcccagcactttgggaggccaaggtgggtagatcacttgaggtcaggagttcgagaccaccctggcaacatagtgaaaccccatctctactaaaaatacaaaaattagccaggcgtgttggcaggtgcctgtaatcccagctactcaggaggctgaggcaggagaattgcttgaacccaggaggcacaagttgcagtgagccgagatcgcgccactgcactccagcctaggtgaccagagcgagactccgtctcgaaaaaaacaaacaaacaaaaaaaaacccataaaggaagcccccgcctcacagttgcactcaaccataacttaacctcagcagcaggtagctgggaacaggatgagaaatgctgacgtcctgttcttcccaggaaggaagtcctccaattgaggactgggccaagaaggagctctgtgttcttgggtatactagtctagagtagaattctggctcattagtctgggagaggggacagagggaatggcctttgttaaaacaccacggattcgcttttcttaccaaattctttaggttttcttaaatagatgtttcttcatttgcttatgaccttaaaaccattcctagaggccttaaatttgttgttgttgttgtttaaattttatcagtttagctggggtgctggtttgaagagcttcccactgtcatttcagaaattgatttctaaatatactttttataaggctatcatttcttatgtttttatgaatatgttaaaatgtgaatcttggggctcatttttcaacacatagaagttacttccgtctgagcatttaaaggagaagtattgatgaatatcaagaatgaaaccaccaatcaattaatgcaaaattgttttcaacaccttctttattttattatattactgatctgtgtaggatgcattaaagcaattacaagtagactacaaaatacaagttgactgtatgattatgtttaaagaaacaaatatacccaagagagtgttgatggtatggattaatgtcattttgggataagatttatagtcacatggagaaaagcttagtgtcttttaatggtttggatagaaatatagaagataatgcttgttggtttgtcagtggcagacagaactgtcctatagatagagatgttactttcccttctgaggcaatcataagcaatgttgagtctggatcttatagaagagttttggcagtgtgtcttctatttgcttaaatatctcatgcaggtaggtccctttagttttaatattttgtgttccttttataggttgagctttttcataaagatatagaagctttcaaagaagaatataaaacagcctcattagtagatcaatcacaagtcagcctctatgaatattttcatatatctcctatcaaggtaggagaaagtcatttttattgtccttgataatctaggtaatagcaaattgatgtagcatttatattgtgttcttcagtaatatataaaatctgtaaatatacaattaaactaagtaacaaaggaattacccttttacatttttatttatttttaaataactttttatcatgtggagccacctatagcatgtatttatgtttataatttgacctaacattattttaccttgattttctgttaagctgttaggtgacaattttcaaaattttgcatatgatgatttgtgtattagttttaaagtaatttataaagtagccttaagaactgaagactgaatggtatcaaatctaagttagtttttagtgcaaaattcctataagctaattatacaataatagaagaaaattactaaacaaccatatatgtagagtatatatgcaatacaatacaaaagtgttttttaactggctattaacttctgaaataattgaaacatatacttttggagatacaaatacctttcagcttatgacagagttacatctcagtaaagccatcatgagttgaaaatcttgtaagtcagaaatgcattgaatacacctaacctactgaacattaaagcttagcctagcctgtcttaaacatgctcaaaacagctgggcaaaatcatctaacacaatgcctattttctaataaagttattataaagaattttgaatcaaaattcaaagtacagtttccactgaaggtgtattgcttttgcagcattgtaaagttgaaaaatcataagtgaaacataagtcatataagttggggaccatatgtatttgagtcattttcaacagcttcaacttttagatttttaatgttattaacaaatatataaaaattaatattttcttaggtttgccaaaagaatgggataggattaaatatcatgctatcttaaattgttgaattgaagatttaaatagagctatgttagattttaaatttcttcatatttctacttagtgattttaacataatccagataactttgaaatcttatttatggtgtagtgaatttaaaattaaactgattttttaagagttaaaattgtcaatatgaagaaaatacttttaaatatttatctctttatctttttagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagtatgtttagtattcaaatctgtaaattgatggaaatatttctattttatatgtccctaaaaatttcgtaaatgaaaaagtgtgtgaagtacgttgcagatcataggcaaaatgaggtttttgcattcaagtgaagtgcaatctgaataacaccaacgtatgatttgctaacccctaattgctaaattacagaattattaaacaatttccttaagaaaaagagtcataggccatgcaagtttcacattttaaaagatctttctggcttagggaaggataggatgtgtatgcccaaagatatggtgcctgaaatgtatggatttgaagctaataggaataagactcttcaaagcatttgcaactagaacagaatgaatgcgataataggggaaatgaaaggatcaactttaagtgttgtaatcaggaatttatattttaatatgagtcataatgaagcttatagagtatctgaccaaagagattcagaatgtctgagttgagactttagaagagaataaccctttcaagtagcatctagaattgattattaagaacagtcgtaagaatcaataagtccaacacgaggtaacactgaacctgaagttaggtaagtgtcaaataaaagtacacaggtatgatgttagcagaaatagtattctacttagcaacaagaagcatagagcttttcagttactgtatcaggtatatgctatggatgggttataagtaagctaatcttagtatatattctgtgaatggagttataagtaagcaggcaaaacctgctgcagctgaacctggccattcgtgagcaacctctttatcagtgtgtcagacattttctatgtgggccatgataggacagaattgggaaataaagttctagtggtacatgaatgggattcacaggatctcagaactctcgaatttacatgaaaatttatgtgtactggtgacttgtctgaagataagatccatgtcttttatcagattcttagaaggttctttgattaggatatgcagagatgtatgtaaaaagtaaatttcctgattggcatgggaaaatgtactagaaggaaaggtttggagaaaagattctaaagaaaataaagccactcattaatattaaaaatactttcttcatacacatgtacagacaatatatttttacgcttttttcaggcttgcattttttgaactcaactatcagttccatacaacatccgatctacagtctgaagtcataagacactattcaaaacaggtttgtctaagattatattacagagggacagagtgatacagactggtaaaaccttttgtgtctatacatatataatgtggaactattgaggaactaaatagccattttcaaattattaaagcatgggtattttcctcagaattataaaaagaaattaagctcaatcactatttgaattttttgtccttatattttttagccactgagagaaattttttgtggatcagcaggactggaaataaataaatctttaaataaaatattaactaatttatcacacttaattaaaaaatgggttcatggaaactattagtaactaactgatgaacacgggatatttttagtgtaactagttgttaagtcagccagatgtatttttttaacagatgtttttccacttctagagagactcttgggttttaggatataacttagagtatctgatatagctgtggtatgacagatcactgagcatgactcaggagatttggatttctcccacttttgccatatacccactatgtgaccctgagtatcatctgacttatatgtttctccaatctataaaacggtggtggtaatgacagtggtcacagataattgtaaaagtgaaagtattttaaatattctagagctttacatgaatataatgtcatattatttttaatactataataccaaattactttttaaaagctaagaatagcgatcaataagcctggcatggtggctaacgcctgtaatcccaacactttgggaggctgaggctggtggatcacttgaggccaggagttcgagaccaccctggccaacatggcgaaaccccatctctactaaaatcacaaaaattagccaggcatggtggtgcatgcctgtagtcccagcttgggaggaggaggcacaataattgcttgaacccgtgaggcagaggttgcagtgagccgagatggcgccaccgcattccagcctgggcaacagagcaggactgtctcaaaaagaaaaagaaaaaaaagagtagtgattaataaaatgagatggtttaggagttgaaattggcattaaaggtgttggcctgagaaaactgggcgtgtgttttaaataatgtataagaaaaaatagatctaattatctgaattgattaatgttcatattttatttttaggccattaagcagatgtatgtactcattcttggacttgatgttttgggaaatccatttggcttaattagagaattttctgaaggtgtagaagcatttttttatgaaccttaccaggtaaaatagttatttttgtggttgtgcaatatgtcactaatacttttgaatagataatacttttctattgttaagttgagttaataagtgcaaacagattttggaacacacacaaaaggacatcattttgcagcaaacaatggtaagaggttttgggggacatttttacccttttcctcaaaatttaaacttaagattttgttaagctacgctgaattgtaagtgttctcttggaatataaaaggtggataaagtagaaagaagatcaccacatcttgctttgcacagtagtgtggaactataaaaataatcatgcaaactgacacctggccaagcaatcttaaaaatcagtgggaaaaattatgattgttctatgtcctttaaaactttttcccaaaagactcctacttccacgtataaatgtatagggaaataaaaaataaagttaacattaattttgcacattgtaattaaaaacattaaaagcattaagaattttaaagtgtttatttgaaatttttattaaagacttatcaagagtagtttgaactgtgcttgcattttgctcataaacttacaatatggaccaagcacctttctgtactttggtgagttgccgtactcctttctaagggtcagcgtctaacattatatccttcacactttcagcgtccagaaatatccctaggaattcttttaatgtgaaactttttgctgatattacttcctctgggacaacattatccatttttgttactacctctttcgtcgtatatatccgtaagctcatctttaaaagtgaatataactcactcactcatttatttactatttggccctttagggagccatccagggtcctgaagagtttgtggaaggaatggcactaggacttaaggcactagttggtggagctgttggtaagaaacagaatatctaccaagtatttttgtgctagaaagtaatggcatcattacttttactaaagataatttctgtcaggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctgtaagaaatttcacagggttgtgaagattttgggaaatatcttttaaacaaacctacatttgcgaataaggaaatagacatgattctcactccttaaattattatttggatattttaagagcagtgggtggtagcatataaaacatgtcagtagcctctaaaacattctgtttaaataaaatacttaggagatctgttaattcttatgctatataaaaagcagaactctgtattttttgtgtaatccaaacttggttcttctaggcatcataaaaaagtattgtaaattttcagttgtgttttccttctagggatttgttagtggcataacaggaattgttacaaaaccaatcaaaggcaagtatagtagttcctttgcaagtctttctaagttgattctgttttcattcttggatgcaattgtcaaaaactcttttttctttccaggagctcaaaaaggaggagcagctggtttctttaaaggtgttgggaaaggtttagtaggagcggtagcaaggccaactggaggcatcatagacatggctagcagtacatttcagggaataaaaaggtaaatcctctttggtgtaagatatgagttaaaatgctgaagccatgagaaatggaatttatctgctctttggcttcaggcatttagttattgtctttgttttgtgctgctataacataccacataataccacagactgggtaatttataatgaacagaaatttattggctcacggttctgaaagttaagaagtccaagattgagaggcaacatctggctagggcctttttgcggtgtcatcccatggcagaaggacaaaaagagggcaagagaagaaaaaagggaaccaaagtcacccttttataaggaacccactcccacagcaacagtattaatgcattcatgggggcagatcctcatggcctaattacctctaattaggccccacctcctggctggggataaagtttccaacacatgctcttggagggacacattcaaaccatagcagttaccagcactacaatatggcaggttgcatatggtcttcctaattcattttgattttttttttttattattatactttaagttttagggtacatgtgcacattgcgcaggttagttacatatgtatacatgtgccatgctggtgcgctgcacccactaactcgtcatctagcattaggtatatctcccaatgctatccctcccccctcccccctccccccaccccacctgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccgcaataaacatacgtgtgcgtgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagttttcctatttctccacatcctctccagcacctgttgtttcctgactttttaatgattgccattctaactggtgtgagatggtatctcatagtggttttgatttgcatttctcggatggccagtgatgattagcatttttgacaaaattcaacaacccttcatgctaaaaactctcaataaattaggtattgatgggacgtatttcaaaataataagagctatctatgacaaacccacagccaatatcatactaaatgggcaaaaactggaagcattccctttgaaaactggcacaagacagggatgccctctctcaccactcctattcaacatagtgtcggaagttctggccagggcaattaggcaggagaaggaaataaagggtattcagttaggaaaagaggaagtcaaattgtccctgtttgcagacgacatgattgtatatctagaaaaccccactgtctcagcccaaaatctccttaagctaagaagcaacttcagcaaagtcttaggatacaaaatcaatgtacaaaaatcacaagcattcttatacaccaacaacagacaaacagagagccaaatcataagtgaactcccattcacaattgcttcaaagagaataaaatacctaggaatccaacttacaagggatgtgaaggacctcttcaaggagaactacaaaccactgctcaaggaaataaaagaggatacaaacgaatggaagaacattccatgctcatgggtaggaagaatcaatatcgtgaaaatggccatactgcccaaggtaatttacagattcagtgctatccccatcaagctaccaatgactttcttcacagaattggaaaaaactactttaaagttcatatggaaccaaaaaagagcccgcatcgccaaggcaatcctaagccaaaagaacgaagctggaggcatcacactacctgacttcaaactatactacaaggctacagtaaccaaaagagcatggtactggtaccaaaacagagatatacatcaatggaacagaacagagccctcagaaataacgccgcatatctacaactatctgatctttgacaaacctgacaaaaacaagcaatggggaaaggattccctatttaataaatggtgctgggaaaactagctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaaacaatggcaacaaaagccaaaattgacaaatgggatctaattaaactaaagagcttctgcacagcaaaagaaactaccatcagagtggacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaactcattttgatattttttaagttgctgccattgcattgtttcaactttatgaagttcccctttatttttcattcattcctagcaggcttgcaggagcagtttggcaagttaagcaagcttttcagttatcttagtttaaatacattaatgctatatatcaattataaaattagcaaatataatctgtatcctttttatgaaatgaagaatggcattttgtatttcttggttcaaactcagtttgtcttcacccttcctttattatcttattttgttataagttgttatagtagtccctcttgatctgcagggatctgcagtggatgcctgaaaccttggacagtacttagccctatatatactgtgttttctcctgtacatacatatccgtgatgaagtttaattttaaattaggctcagtaagatattaacaataataataaaataagacaattataacaatatactgtaatgaaagtaaaataaacgttacttgaacacaagcactgtaataccgcaatagtcaggatgataactgagacagctactatgtcactaatggactggtgatgtataaagcatggatatgctggacagagggatgattcatatcccaggaaggacaaagcagggtggcaagaaattttatcatactactcagaatggcatgcaatttaaaatgtagggattgtttatttctggaattttccatttaatatttttggaccacagttgactgtggataactgacactgcagaaagcagaactgtggataagcggatactagtgtatatgcatatcctttctcttcctttatgcaggtaattttaatacacattgttttttactccaaatgaaatttagtgtaagggtgaaatttagtagtttctttattgttacctgtgtcttagaaatttgtaacacatataacagatgataaaattaatgttaattagacccatcttagaaagttaggtgggtggctgtcttcctaatctttttcctttgtgttttctcttgctttctgctctatagggatatgtattgtcatcatatgagctattcctcttaagccagtatttcatactggttaccataattgggtgtttctggtttcggcatttagaattaaggtgggggaaaaaggaatcattctcctctacctgtaactttaagtttcataaatataatgtgttgagtcgtagtcatcagagaagctcaaaagtcaatgaaacgtaaggaatttgaaacatatgaaggcttctttcaaaagctgctagaattaccttctgtttatctaaaaccttataattctgtacccaggtatattacctttagggattgagggcacaatgaaacatttttagaaaaaataataaagactaagaactattgaaggatgtacctgtgaaaaaagacactgaaagtaaaaggaggaatgggttacaagattcaaagataaaaatataaattggataaatctaattgagctacatgaaagcaacattggaaacattattaaaacataataaaatgcaatttggggagagaatgattggcattaaatattgtcctatttgtaaagaggatgtatttactaatattaggtgaaacagacattaaggcaataaaagcattatttgggataaataaggtaattaggtaatgataaaaagaactaagtaggaagatagtaacaatttcaaacttctactcagttcataaaatagccttaatttttaaaagcacaacttgacaaaactgtaagaacttttcaaatgtacaacaaaggtggaagaacttaatatttttctcaataattgatagatcaggaagacaaaataaaagtaagtaaataattatctgaatagagttaacaagctacctaatacaaacataaataattattcagcacattttagggagcattgtctatgatctagacacttctctaatcacttgagggaccagcaatgaacacaattggcaatggtcctgtgttcatacagcttacattctagtgggagagtaatagacaaaaataagtaactgataaatatatgatatgctaaatggtgaaaaatgccatgaagaaaaataaagcagattaaaggaggtaaggagatgcaaaatggtagggaggagggttgctattttacatattcagtgatcagggatgcttaactcataagattatatttgaggagagacctgaaagaagtaaagggtgagccatgtgagaagaatgtcccaggcagaaggaacagcagttaaaaagccctgatgcaagaatgtgcttggcctatttgagaaacagcaagactagtttgcctggagtagagtgaggaacggggaaagttgaagaagatgttaccagggaacatgcggggaatcacatctcgtagaactcggcaagcccctgtaaggacttaggcttttgcttaagatgagaggccattgaaaggtttcaagccagagaaatgatgtgagctggctgctgcattgaggcgtaaccacaggggattagggcagaaacaacacttaaaaggcttttgcagtaatccaagtgagtgacaatggtgattcgactattagagtactagagattatgtcctgcatgtattttaaagatagtggcaatagcattagttgataaattggatgcaggatatgaaagaaagagaatcgtgaagaataattctaaagtttttatgtgtagtactggaagggtgaggttgtcgttctttttagggaaagggtattagacatttccttttgaatatattaagcttaaaatatctcttagacatccaaatggagacatcacgttattgttgagtagaggagtttgaagtatagagaaaggtccaagctagaggtaaaaattcaagatttgtgagcctataataaggtatttgaaaccatgagattggatgagatcaccaagggaatgagactgaaaagagaaaaataaggtccaaggacttggctttcaggcacaccaactcttagaagttggggaaatgaggaagacccagaaaaggaggctaaaaagaaatggtcattaagttacctaaaaaattttagggtcagtttgtcaatttctacaaaaaaggtagctaggattttgatgcagatggcattgaatctgtagttcaatttggggagtgtagccatcttaacagtattatcttttaacctgtgaaaatgcaacgtctttccatttatttaggtcttcttgaattgctttcaataatgttttatagtttgtaatgtacgagtcttatacttctttttaaaaacttattcctaagtatttttgatgctgtttttttttttttttttttttttttttgagacggagtctcgctctgtcgcccaggccagactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtcccgatctcctgacctcatgatccacccgcctcggcctcccaaagtgctggtatgctgttttaaatggaattgttttcttaattttattgttggattgtttattgctggtgtgttgaatacaactgtttttctttatatttgagtttctgcaatcttactgaacttgtttattagctctaatggttttgtggattcttttgggttttctatatgtaagagtatatcatctgagaactgaggtaactttacttcttcctttctgatctggatgctttttttcttgcctagttgtcctggctagaacctctagtacaatgtgaagtagaagtgctgagagaatagacatgcctatattgcttttaatcttagggggaaagctttcagatgttcaccattaaatgtgatgttagctataggtttttgtgtctttatcatgaaaacatgttagattttatgaaacgctttttctgtataattaagttgatagttggtttttcctttgtttcactaatgtagtatattacattaattgagtcagatcttaaactaatattgcatacctgggataaatcccatttggacataatgtgtaatcgtttttatattttactggatttggtttgatagtattttgttgaggatttttgcatgtatatttataagggatattggtctgtggttttcttgtgatgtctttgcctggtatgggtatcagggtaatattgtcctcacagaatgatttaggaagtgttccctcctcttcaaatttttggaagactttgtggagcgttgatgttaattaaaaaaaaaatttggagaattgatcagtgaaaccgtctgattcttacttttatttctggtgagttttaaaatgacaaattcactctctttacttggtaaaggtctagttaggctgtttcttgagtcattgtcagtagtttttataggaatttgttcaattcatctagatgttctaatttgttgatatatatttattgatcatagtaaatatttactagtattctcatataattatttttcccttatatagtatttattcctagtattcccttataattattttttgtttccataagattggtagtagtgttccctctttaattcctgttattcataatttgggtcttcttttttttcttggtcagtttagtgatggcgtgtcatttttgttgtccttttcaaagaaccagtttttagtttcattgattctattttttctattctctatttcttttatctctgctctaatttttattattttcttccttctgctagctttgggattagtttgctttttctactttctcaacttgtgaagttatattattgatttcagaccttcttttttaatgtagacattcacatctataaatttccctctgagcactgtctttgctgcatcttataagttttggtgtgttgtatttttgcttttatttgtttcaaagtagtgaatttcttttgtgatttttttctttgacattttgttatttatgcttctatgttttaatttccacacacttgtaaatttcataaatttctcttatttacacatttctagttttcttccatgtggtcaggtatcatacttgtatattttcagtccttttttttttttttttttttttttgtgagatagagtctcactcttgtcacccaggctggagcagtggcgtgattttggctcactgcaacctctgcctcccaggttcaagagattcccctgcctcagcctcctgagtagctgggattacaggcacacaccaccatacccagctaattttttttttttttttttgagacagagtttcactcttgttgcccaggctggagtgcaatggcgctatctcagctcaccgcaacctccgcctcccaagttcaagctattctcctgcctcagcctccctagtaactgggattacaggcatgtgccaccacacccggctaattttgtatttttagtagagacagggtttctccatgttggtcaggctgatctcgaacttccgacctcaggtgatctgcccgccttggcctcccgaagtgctgggattgcaggaatgagccaccacgcccggccatttttgtatttttagtagagatggggtttcaccatgttggccaggcttgtcttgaactcctgacctcaagtgatctgaccacctcggcctcgcaaagtgctgggattacaggcatgagccaccacgcctggcctattttcagtagttttatatttacattcaatgttagccaaaaggccaagaagcaaacagtaattttatattattgagacatgttttatgacctaatagatagctaatactgaataatgttccgttgcacttgagaagaatatatattctgttgttgttggtttgaacgttctatagacatctgttgggtctagtggattatagtgttattcaagttctcttttttccttgctgatcttttatctagttggtatccatttttgaaagtaggttgctgaaatcttcaactattatggtggtattgcctttttgtcttttaaattcttagtttttgttttgtgtatttggggcttcttttattagctgcttatatgtttataattttttatctttttgatggattgacccttttttccttataaaatgcccttctttgtgtctaataagaatttttttaaaggctgtttttttctgacattagcatggccactttagctttcttttagttactgttcactttgcatatattttctcctttttagttgcaaccagtttgtgtctttgactctaaatcaggtctcctgtggatagtatattgttagatcatattttttttatctattctgtttttatttttttacttatgtatttattttttgagatggagtctcgctgtgtcgcccaggctggagtgcagtggcatgatctcggctcactgcaacctccacctcccaggttcaagtgattcttctgcctcagcctcccaagtactgggactacatgcacatgccaccacgcccggctaatttttgtatttttagtagagacagggtttcaccatattggccaggctgatctcgaactcctgacctcatgatccgcccgcctcgggctcccaaagtgctgggattacagacatgagccaccacacccggccctattctgttttcagttggagaatttattcatatgtatatgcccatgcatgtgtatacattatgttagcggtccccagccttttaggcatcaaggtctggtttcatggaagacaatttttccacagaccagacaggagggataatttcaggatggaactgttccacctcagatcatcaggctttagttatattctcataaggagtgtgctacctagatcccttgcatgtgcagttgacaatagggttcgccttcttatgagaatctgatgccgctgctgatatgacaggaggtggagctcaggcagtgaaacttgcttgccactactcacctcctgctgcacgactcagttcctaacaggctatggaccggtactggttcaagtcccatgggttggggacctcttaataaatatttgttgaatatgtgatacttgttgagtgaacaaattgagtggtcacttatgaccaaataagcaaaaatgttaaatataatactaccatacacaatttagccgtatgtggtatgtgttttttggttttttgtttgtttttagacagggtctcactctggcatcctgattggagtgcagtggcatggggctcaaactatcctcccacctcagccttctgagtgtctgggacttctgctgcataccaccatgtctgactagtttttttatttttttgtagagcagtgtatgctgcccaggattggggtatgtgtttacagtaatacacatcaagcccagtaagaatgtgaggactgtgagagtatttgaatattagaaaactatataatgtgatttataacattaatagattaaggaaaatataccatgtgatcaaaacaatgccagaaaagaaattcttatttaaaattcattgcctatttaagattttcaaaaacagtaacaaaaaagaactgttggtaaactaaaagtagcaatgaactttcttgacttgttaaggggtgctttaaaaaaaaaaagttgctgataactatacttcacagaaaactcttagaagctttccgtagggtcaggaatgagacaaggatgcttgcaatccctttttgtttatagcattatactaaagaaactagacaacgtaataggaaaagaaaaagcaacaattgctaatattgtgattattatcacaaagaaagttctagagacttaaacttctctatagttctgtatttttctagagaacttacactgtttatgttacaaaaacaatttaaaattagagaatgttgtaatatttttaatctgaaataagattgtttttagtaattgcattttatagtttatttacaagtttttgaataatttttaaaataaagttatattttttttcctctagagctacagagacttctgaagtggagagtctgcgacctcctcggttcttcaatgaagatggagttatcagaccgtacaggttgagggatgggactggaaatcaaatgttacaggtaaattaagagctatcttataaattaagattaatttagtcaagttagattttttttaagtagccatttaatatatattaaattatttgggcttttatctattttgcttaattccacttataagtttcttatatttacttagattttaaagtacatttatttactataagatttttttttcttttttacaggcatcaaaaagtttgatatgaaaagttaatgcatgactttgcaagtgaaagccaacagtagattttagtcttaaaatttacaaactacgtacagctgtttcagtattttgaatacaaagaaaaccttttgtattggtaacttttaataggaattttaatgaatctggtttttttatagggtgttcttagttctgcactggatttgctagatttgttggaagcctttgtaccttatgtatcctcgtcattggtggtacttacttaaccaattaaaccatttctgttgtggggttattaaaccactggtagcttttataccagatatataatccttatatccaattacacatgaagaaggaaaagcaaaactcaggaacactgctattgtgaattactcttggattcttgtgctttgcctttgaaaatgcttaaatggccatgaccctcttcctgctttattctagtgtagtctttataaaacttgtgggatttgataagcagttcacatgcaaaccagtatcttttaataatacaaagtagcatctggaacaatagacagtttgaagttagaatctgcttagacaactttcttacttggtaaattcgactttttaaaacctggattatgctgtaggtaactagtaatcatatataggctataccagtgtcatgttgtttctgtggtttagaggtggaatactaaattaaatcatttgtttgaaaacaa
